United States Patent 11,931,406 (FLAVIVIRUS VACCINE) - sequence listing, part 34

SEQ ID NO: 13421 - RNA, 9879 nt, Artificial Sequence
  derived and/or modified CDS sequence (opt3) from DENV-1__FJ182002__SS-prME
agcgugaccaugcugcucaugcuucugccaacagcauuggcuuuccacuuaacuacgcgaggaggggaaccucauaugaucgucuccaagcaggaaaggggaaaaucucugcuauuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucacaggacaacugacuuggaaugaccuuauucguuugugcaucauggucggcgcaaacgcuuccgauagaauggggaugggaaccacguaucuggccuuaauggcaacauuuaaaaugaggccuauguucgccgugggccuccuguuucgccggcuuaccucuagagagguucugcuacucacuauuggucugagcuugguggcuucagucgaacugccaaacaguuuagaggaacucggggacggacuggcgaugggcauaaugaugcuuaagcuguugaccgaguuccagccccaccagcucuggacaacucugcuaucccugaccuuuaucaaaacgacacuuucucucgauuacgccuggaagaccacugcaauggcucugagcauuguguccuuguucccgcuguguuuaucaacaaccagccagaaaacuacauggcucccuguucugcuuggcaguuuugggugcaagccacugaccauguucuugaucacggaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacuagccacaacauacucguugaagugcaggacgauggaaccaugaagauuaaagacgaggagcgagaugacacacugaccauccuucugaaggcaacauugcuagccgucuccggcguguacccaaugucaaucccugcuacucuguuuguaugguauuucuggcagaaaaagaagcagcgcaguggcgugcucugggauacccccagcccaccggaagucgagcgggcaguucuggacgaugggauuuacagaauacuucaaaggggauuacugggucguucucaggugggcgugggggucuuccaggacggaguguuucauacgauguggcacguuacacgcggcgccguacucauguaucaggguaaacgguuggaaccuuccugggcgucagugaagaaagaccugaucaguuacgggggaggcuggagauuccaaggcagcuggaauacuggggaggagguccaggugauugcuguugaacccggaaagaaccccaaaaaugugcagaccacacccgguaccuuuaagacuccugagggcgaagucggggccaucgcacucgauuucaagccaggaaccuccggcucucccauugugaacagggaggguaaaaucguagggcuguacggaaauggcgucgugacaacgucgggcacuuauguuagcgccauagcucaagccaaggcaucacaggaagggccucuuccggagaucgaggacgaaguguuuaaaaagcgaaaccugaccauuauggauuugcacccaggauccgguaaaacacggcgcuaccuacccgcuaucgucagagaggccauuaagaggaagcugcggacccucaucuuagcgccuacucgagugguugccagugaaauggcagaggcucugaaaggcaugccaauaagauaucagacaaccgccgugaagucugaacauacggggcgcgagauugucgaccuuaugugccacgcuacuuucacaaugaggcugcucagccccgugcguguaccuaauuacaacaugaucaucauggaugaggcacauuuuaccgacccggccuccauugccgcucggggauauaucucaaccagagugggcaugggugaagcggcagccauauucaugacugcuacacccccagggucuguugaggccuuuccucagagcaaugcagucauucaagaugaagagagggacauccccgaacgcaguuggaacuccggauacgauuggauuaccgacuucccaggcaaaacagugugguuugugccuagcaucaagucuggcaaugauauagccaacuguuugcggaaaaacgggaagagagucauucagcugucaagaaagacuuucgacacggaguaucagaaaaccaagaauaacgacugggauuacguagugacaacugacaucuccgagaugggagcuaauuucagggcggaucgcguuaucgacccccguagaugccucaaaccagugauucugaaggaugguccggaacgggucauccuugccggcccuaugcccgugaccguugcaagugcugcccagaggcgcgggcgaauuggaagaacacaaaccaaagagggcgaccaguacguguauaugggucagccacuaaacaaugaugaagaccacgcacauuggacugaggccaagaugcuguuggcuaacauaaauacgcccgaggggaucauuccugccuuauuugaaccagagcgggaaaagagccccgcgaucgauggcgaguacaggcugcgcggagaagcaagaaaaaccuucgucgagcucaugaggcggggcgaccugccuguguggcuuucguauaagguagccucugagggguuucaguacuccgaucgucgcuggugguucgacggagaacgaaacaaucaagugcuggaggaaaacauggauguugagaucuggacaaaagaaggugagagaaagaaacucaggccgcggugguuggacgcucgcacuuauagcgacccacuggcccuaggcgaguuuaaggaguucggggcuggaagaaggucaggcaguggugaucugauucucgagauagggaaacuuccccagcaccugaccuuacgggcacagaauggcuuggacaaccuggucauggugcacaauucugaacagggaggcaaggccuaccgacaugcuauggaggaacucccugauacaaucgagacccugaugcuucuggcccucauugcaguguugacugggggagucacacuguuuuucuuauccgguaagggccuagggaaaacgagcaucggacugcucugcguuaccgcgucaagugcccuucuguggauggcuagcguggagccccacuggauugccgcauccaucauauuggaauuuuuccugaugguacuccugaucccagagccugacagacaacgcacuccccaggauaaccagcuugcuuauguggucauuggccuccuguuuaugaucuugacaguggccgcaaaugaaaugggucuguuagagaccaccaagaaagaccuagggauuggccauguugccgcugagaaccaccaacacgcgacaaugcuggauguggaccucaggccagccucugcauggacucuuuacgcugucgccacgaccguaaucacaccuaugaugcggcauacuauagaaaacaccacagccaauauuagccugaccgcaaucgcuaaccaggccgcgauuuugaugggacuggauaagggcuggccgaucuccaaaauggacauaggggugccccuccuggcucuuggauguuacucacagguuaauccauuaacucugacggccgcagugcucauguuggucgcccacuaugcuaucauuggcccuggucugcaggcaaaggccacacgugaggcgcaaaagagaaccgcugccgggaucaugaaaaaccccacuguggauggaauugucgcaaucgaccuagauccagugguuuacgacgccaaguucgaaaaacagcugggccagauaaugcuccuuauucugugcaccucucagaucuugcugaugaggacaacuugggcucucugugagaguaucacccuggccacagguccuuuaacgacccuuugggaaggcucgcccgggaaguuuuggaauacuacaauugcagugagcauggcuaacaucuuccgcggauccuaucuggccggcgcggggcucgccuucucucuaaugaaaucacugggaggcggucggcgagggaccggagcacaaggcgagacuuugggugagaaguggaagagacagcugaaucagcucagcaaauccgaauuuaacacauacaagaggaguggcauaauggagguagaccgcucugaagcuaaagaggggcuuaagcggggagaaaccacgaaacaugccgugagcagaggcaccgcaaagcugcguugguucgucgagaggaauuugguuaagccggaggggaaagugauugaucugggaugcggccgggguggguggucauauuacugugcuggacucaagaaagucacagaagugaagggcuauacuaaaggcgggccaggacacgaggaaccuauccccauggccaccuacgguuggaacuuaguaaagcugcauuccggcaaagacguguuuuucaugccacccgagaagugcgauacacuucugugugacauuggggaaaguagcccuaauccgacuaucgaggagggacgcacccuacgaguucucaagaugguggaacccuggcugagaggcaaccaguuuugcauaaaaaucuugaauccauacaugccuucugucguggagacacuggaacaaaugcagaggaagcacggugggaugcucguccggaacccccuuucccgcaauucaacccacgagauguauugggugagcuguggaacuggcaacauuguuucggccguaaauaugacgucuagaaugcuguuaaacagguucacaauggcgcaucgaaaaccuaccuacgagcgggauguggaccugggcgcugggacucgucacgucgcaguggaaccagagguugccaacuuggauaucauuggacagagaaucgaaaauauuaagaacgagcauaaaaguaccuggcacuaugacgaagauaaucccuacaagacaugggcuuaucacgguuccuacgaggugaagccuagcggcucagccuccucuauggucaacggggugguacgccuccugacgaaaccaugggacgugauccccaugguuacccaaauagcaaugacugauacaaccccguuuggacagcagagggucuucaaggagaaaguggacacucggacaccuagagccaagcgcggcaccacacagauuauggaagugacugcuaaauggcuaugggguuuucuuagcaggaauaagaagccacgaaucugcacccgggaggaguucacgagaaaagucaggaguaacgcggccaucggggcaguuuuuguggacgagaaucaauggaacuccgcuaaggaagccggagaggaugagcgcguaugggaccugguggaucgugaacgggagcuccauaaacagggcaaguggggcaccgggggauauaauaugauggguaaaagagaaaagaagcugggcgaguucgggaaagcaaagggaagcaggggcauuugguacaugugguugggugcccgcuuucuggaguucgaggcucucggguucaugaacgaggaccacugguuuucucgagaaaauucacuuaguggagucgagggcgaaggccugcauaaauuaggguacauacugcgggauaucuccaagauucccggagguaacauguaugccgacgauacagcgggcugggacacuagaaucaccgaggaugacuugcagaaugaggcaaaaauuacagauaucauggaaccugagcacgcccuccuggcuacuagcauauucaagcuaaccuaccagaacaaagugguuagggugcaacgcccagccaagaaugggacggucauggacgugaucucuagacgggaucagaggggaucgggccagguagguacauaugggcuuaacaccuuuacuaacauggaaguucagcugauucgucaaauggagucagaaggaaucuuccuccccagcgagcuggagacaccgaauuuggcagaacgaguguuagacuggcuggagaagcauggcgcugaacgccucaaaagaaugccuauuuccggcgacgauugugucgugaagcccaucgacgaucgguuugccaccgcucuuacugcccugaacgacauggggaaagugaggaaggauauaccacagugggagccuaguaaaggauggaaugacuggcagcagguccccuucuggucucaccacuuucaucaacuaauuaugaaggauggucgcgaaaucguugugccaugcagaaaccaggacgagcugguaggccgggcaagggugagccagggggcgggauggucccuccgagagaccgccugguugggcaagucauacgcucaaaugggucagcugauguauuuccaccguagagaucuucgccuggccgcaaaugcuaucuggagugccgggcccggagacugggucccuacaucucggacgaccuggagcauucaugcacaccaccaguggaugacuacagaagauaugcucuccguguggaacaggguuuggauagaggaaaauccauggauggaggacaaaacccaugugucaagcugggaagaggucccguacuuaggcaagagagaggaccaguggugcggcucucugaucggguugacugcccgcgcgacaugggcuaccaacauucaaguggccaucaaucagguacggaggcugauuggaaacgaaaauuaucucgauuacaugacguccaugaaacgauuuaagaacgagagugaccccgaaggugcacuuugguga

SEQ ID NO: 13422 - RNA, 9879 nt, Artificial Sequence
  derived and/or modified CDS sequence (opt3) from DENV-1__FJ024482__SS-prME
agcgugaccaugcugcucaugcuucugccaacagcauuggcuuuccacuuaacuacgcgaggcggggaaccucauaugaucgucuccaagcaggaaaggggaaaaucucugcuguuuaagaccucagccgguguuaacaugugcacacucauugccauggaccugggcgaacuuugugaagauacuaugaccuacaaaugcccacagauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguugacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauuccucacccaggacgaaaagggggugacucagaacggacgucugauuacagcaaaucccaucguaaccgauaaagagaagccugucaacauagaaacugagccacccuuuggcgagagcuauauugugguuggugccggggaaaaagcucuuaagcugucgugguucaagaaaggaucuuccaucggaaagauguuugaggccaccgcacgcggcgccagaaggauggcuaucuugggggacacagccugggauuucggaucaauugguggcguguuuacgagugucgggaaacucgugcaucagguauucggaaccgcauacggcgugcuguuuagcgguguuuccuggacuaugaagaucgggauuggcauauuacugacauggcuaggacucaauucucggagcaccucacugaguaugacauguaucgcggucggcauggugacucuuuacuugggggugaugguccaagcugacuccggaugcguuauuaacuggaaaggccgagaacugaagugugguagcgggaucuucgugaccaacgaggugcacacguggacagaacaguauaaguuucaggccgauucuccgaaacgccucucagcagccaucggaaaggcuugggaggagggcguaugcgguauuagaagugccaccaggcuggaaaauauaauguggaaacagaucagcaacgaguuaaaucauauucugcuugaaaacgacaugaaguucacugucgugguuggcgacgcaaaugggaucuuggcucaaggcaagaagaugauucggccucagcccauggagcacaaauacuccuggaagucuuggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauauggcucaagcugagagacucguacacgcaaaugugcgaucacaggcuaaugagcgcugcaauuaaagacuccaaggccguccaugcugauaugggguauuggaucgaaucagagaaaaacgaaaccuggaagcuggcccgugcaaguuucauugaggugaagacuuguacauggccaaaaucucacacccucuggagcaauggaguucuggaauccgagaugaucauacccaagaucuacggcgguccuauuucacagcauaacuaucggccaggcuacuucacucagacagcggggccguggcaccuuggaaaauuggagcuggacuuugauuuaugcgaaggcaccacggugguagucgacgagcacugcgggaaucgaggacccagccucagaacuaccacagugaccggcaagaucauucaugaaugguguugcaggucuuguacucugccuccacuucgcuuccggggugaggaugggugcugguacggaauggagaucagacccgugaaagaaaaggaggaaaaccuggucagguccaugguuagugccggcagcggugagguggacucuuuuuccuugggcauacucugugcuucaauuaugaucgaagagguaaugcgcagucgauggagccggaagaugcugaugacagggacccuagccguguuccugcuccugaucaugggacaacuuacauggaaugacuugauucgucugugcaucauggucggcgcaaacgcuucggauagaauggggaugggaacuaccuauuuagcccucauggcaacguuuaaaaugaggccuauguucgccgugggccugcuuuuucgccggcugacauccagagagguucuacuccugaccauugguuugucucugguggcuagcgucgaauuaccaaacucacucgaggaacugggggacggacuugcgaugggcauaaugaugcugaaguugcucacugaguuccagccccaccagcuguggaccacacuacugagucuuacuuuuaucaaaaccacgcucucccuggauuacgccuggaagacaaccgcaauggcuuugucuauugugagccuguucccguuaugucucuccacuacaucacagaaaaccacuuggcugccuguucuucugggcagcuuugggugcaagccauugacaauguuccucaucaccgaaaauaagauuuggggaaggaaaaguuggccccugaacgaggguaucauggccauaggcaucgugucuauucuacuguccagccuucucaagaaugacgucccucuggccgggcccuugaucgcuggaggcauguuaauugcauguuauguaaucucggguucaucugccgaucugagucucgagaaagcggcugaaguguccugggagcaagaagccgagcauagcgggacgucucacaacauacugguugaagugcaggacgauggaacuaugaagauuaaagacgaggagcgagaugacacccuuacaauccuguugaaggcaacccuacuggccgucagcggcguguacccaauguccaucccugcuacacucuuuguaugguauuucuggcagaaaaagaagcagcgcucaggcgugcugugggauacucccaguccaccggaagucgagcgggcaguucuugacgaugggauuuacagaauauuacaaaggggacugcucggucguagccaggugggcgugggggucuuccaggacggaguguuucauaccauguggcacguuacgcgcggcgccguauugauguaucaggguaaacggcuggaaccuucuugggcguccgugaagaaagaccucaucucauacgggggaggcuggagauuccaaggcaguuggaauacaggggaggagguccaggugauugcuguugaacccggaaagaaccccaaaaaugugcagacuacccccgguacauuuaagaccccugagggcgaagucggggccaucgcacuggauuucaagccaggaacuagcggcucccccauugugaacagggaggguaaaaucguagggcuuuacggaaauggcgucgugaccacaucuggcacguauguuucggccauagcucaagccaaggcaagccaggaagggccucugccggagaucgaggacgaaguguuuaaaaagcgaaacuugacuauuauggaucuacacccaggaucagguaaaacccggcgcuaccugcccgcuaucgucagagaggccauuaagaggaagcuccggacauuaauccuggcgccuacccgagugguugccuccgaaauggcagaggcucuuaaaggcaugccaauaagauaucagacuacagccgugaagagugaacauaccgggcgcgagauugucgaccugaugugccacgcuacguucacuaugaggcucuugucucccgugcguguaccuaauuacaacaugaucaucauggaugaggcacauuuuacagacccggccagcauugccgcucggggauauaucuccaccagagugggcaugggugaagcggcagccauauucaugaccgcuacucccccagggucaguugaggccuuuccucagucuaaugcagucauucaagaugaagagagggacauccccgaacgcagcuggaacaguggauacgauuggauuacagacuucccaggcaaaaccgugugguuugugccuuccaucaagagcggcaaugauauagccaacugucugcggaaaaacgggaagagagucauucagcucucuagaaagacauucgacacugaguaucagaaaacgaagaauaacgacugggauuacguagugaccacagacaucucagagaugggagcuaauuucagggcggaucgcguuaucgacccccguagaugccugaaaccagugauucuuaaggaugguccggaacgggucauccuagccggcccuaugcccgugacuguugcauccgcugcccagaggcgcgggcgaauuggaagaaaccaaaauaaagagggcgaccaguacguguauaugggucagccacugaacaaugaugaagaccacgcacauuggaccgaggccaagauguuguuagauaacauaaauacacccgaggggaucauuccugcucuguuugaaccagagcgggaaaagagugccgcgaucgacggcgaguacaggcuccgcggagaagcaagaaaaaccuucgucgagcugaugaggcggggcgaucuucccguguggcugagcuauaagguagccucggagggguuucaguacucugaccgucgcuggugcuucgauggagaacgaaacaaucaagugcucgaggaaaacauggacguugagaucuggccuaaagaaggugagagaaagaaauugaggccgcgguggcuggacgcucgcacuuauuccgauccacuagcccugagagaguuuaaggaguucgcugcaggcaggcggagcgucucaggggaccucauucuugagauaggaaaacugccccagcacuuaacguugcgagcccagaaugcucuggauaaccucgugauggugcacaauagugaacagggcgguaaggccuacagacaugcaauggaggaacugccugacaccaucgagacacuuaugcugcucgcguugauugccguccugacugggggcguuaccuuauuuuuccuaucuggaaagggccuggggaaaacauccaucggacuccuuugugugaccgcuagcucagcccuguuguggauggcaaguguagagccccacuggauugcugccagcaucauacuggaauuuuuccucauggugcugcuuaucccagagccugaucgccaaaggacuccccaggacaaccagcucgcauaugucgugauuggucuguuguuucugaucuuaacaguugccgcuaacgaaaugggccuacuggagacgaccaagaaagaucucgggauuggacauguggcggccgagaaucaccaacacgcaacuaugcuugacgucgaucugcggccagcuuccgccuggacauuguacgccguagcaaccaccgugaucacaccuaugaugcgucauacuauagaaaacacgaccgcuaauauuucucugacagccaucgcgaaccaggcugccauucucaugggccuggacaaggguuggccgaucagcaaaauggauauagggguuccccuuuuagcacugggcugcuacucccaggugaauccacucacuuugaccgccgcuguccugaugcuaguggcacacuaugccaucauuggaccuggccugcaggcgaaggcuacaagagaggcccaaaagaggaccgcagccgggaucaugaaaaaccccacugucgacggaauuguggcuaucgaucucgacccaguuguguacgacacgaaguucgaaaaacagcuuggccagauaaugcuguugauucuguguacaucacagauccuccugaugcgcaccacuugggccuuaugcgagucuaucacccuugcaacagguccucugacuacccucugggaagggagucccggaaaguuuuggaauacaacgauugcuguaucgauggccaacaucuuccggggcagcuaucuagcgggugccggccuggcauucuccuugaugaaaucucuagggggaggccgaagagggaccggagcucaaggcgagacucucggugagaaguggaagaggcagcuuaaucagcugucaaaaagcgaauuuaacacauacaagcgcuccgggauaauggagguggaucggagugaagccaaagagggauugaagagaggcgaaaccacuaaacaugcagucucucgugguacagcuaagcugaggugguucguugagcggaaucucgugaagccggagggcaaagucauugacuuaggguguggacgcggcggguggagcuauuacugcgccggacugaagaaagugaccgaaguaaagggcuauacgaaaggugggccaggacacgaggaaccuauccccauggccaccuacggcuggaaccuugugaagcugcauucaggcaaagauguauuuuucaugccacccgagaagugugacacacuacucugcgauauuggggaauccaguccuaauccgacuaucgaggagggacgaacccugagaguguugaagauggucgaacccuggcugagggguaaccaguuuuguauaaaaauccucaauccauacaugccuagcguggucgagacacuugaacaaaugcagcggaagcacggcgggaugcuggugcgcaaccccuuaucuagaaauuccacucacgagauguauuggguuucaugcggaaccggcaacauuguaagcgcggugaacaugacaucgaggaugcuguugaaucgauucaccauggcucaucggaaaccuacuuacgagcgugacgucgaucucggugcagggacgagacacguggccguugaaccagagguggcuaaccuggacaucauuggacagcgcaucgaaaauauuaagaacgagcauaaaucuacauggcacuaugaugaagacaaucccuacaagaccugggccuaucacggcaguuacgaggucaagccuuccggcagcgcaucauccauggugaacgggguagugaggcuacuuacuaaaccaugggauguuauccccauggucacccaaauagccaugacagacacgaccccguuuggacagcagcggguguucaaggagaaaguggacacuagaacaccucgcgcuaagagggguaccacucagauuauggaagucacagcgaaauggcuguggggcuuucucucucgaaauaagaagccacggaucuguaccagagaggaguucacaaggaaaguucgcagcaacgccgcaaucggggcuguguuuguagaugagaaucaauggaacagugccaaggaagcaguggaggacgagcguuucugggaucugguccaucgggaaagagaguugcacaaacagggaaagugcgccacuugcguguauaauaugaugggcaaaagggaaaagaagcugggugaguuugggaaagcuaagggaucccgcgccauuugguacauguggcucggcgcgcgauuccuugaguucgaggcacugggcuuuaugaacgaggaccauugguucagccgggaaaauucuuuuucagggguugagggagaagguuuacacaaacugggcuacauauugagagauaucaguaagauucccgggggaaacauguaugccgacgauaccgcuggcugggacacgaggaucaccgaggaugaccuccagaaugaggccaaaauuacagauaucauggaaccugagcaugcacugcuagcuacuuccauauucaaacuuaccuaccagaacaaagugguccgcgugcaaagaccagccaagaacgguacaguaauggacguuaucagccggagggcucagcgugggucuggacaggugggcacuuauggccugaauaccuuuacgaacauggaaguccagcucauucgacaaauggagucggaagggaucuuccugcccucagaguuggagacaccgaauuuagccgaacgcgugcuggauuggcucgagaagcacggagcagaaagacuuaaacggauggcgauuagcggugacgacuguguggucaagccuaucgaugacagguuugccaccgcucugacugcccuaaacgcaaugggcaaaguucgcaaggauauaccccagugggagccauccaaaggguggaaugacuggcaacaggugccuuucugcagucaccauuuucaccaacugauuaugaaggauggaagagaaaucguagugcccugucggaaccaggacgagcucgucggcagggcucgagugucucagggugccggguggagcuugcgugagacagcaugccugggaaaguccuacgcccaaauguggcagcuuauguauuuccauagacgcgaucugcggcucgcggcuaaugccaucuguucagcaguuccaguggacuggguccccaccaguaggacuaccuggucuauucacgcccaccaucaguggaugacaacggaagauauguuaagcguguggaacagaguauggauagaggaaaauccuuggauggaggacaaaacccacguuuccucaugggaagaggugccauaccugggcaagcgcgaggaucaguggugcggcagcuugaucgggcugacugcucgggccacaugggcaaccaacauucaagucgcuaucaaucaggugaggcgacucauuggaaacgaaaauuaucuugacuacaugacuucuaugaaaagauuuaagaacgaguccgacccggaaggugcccugugguga

SEQ ID NO: 13423 - RNA, 9879 nt, Artificial Sequence
  derived and/or modified CDS sequence (opt3) from DENV-1__EU596501__SS-prME
agcgugaccaugcugcucaugcuucugccaacagcauuggcuuuccacuuaacuacgcgaggaggggaaccucauaugaucgucuccaagcaggaaaggggaaaaucucugcuguuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuugcugccguuaugucucucaacuacaagccagaaaaccacuuggcugccuguucuucugggcaguuucgggugcaagccauugacaauguuucucaucaccgaaaauaagauuuggggaaggaaaucuuggccccugaacgaggguaucauggccauaggcaucguguccauucuacugagcucgcuucucaagaaugacgucccucuggccgggcccuugaucgcuggaggcauguuaauugcauguuauguaaucucagguucuagugccgaucugucccucgagaaagcggcugaagugagcugggagcaagaagccgagcauucugggacgagccacaacauacugguugaagugcaggacgauggaacuaugaagauuaaagacgaggagcgagaugacacccuuacaauccuguugaaggcaacccuacuggccgucuccggcguguacccaaugucaaucccugcuacacucuucguaugguauuuuuggcagaaaaagaagcagcgcaguggcgugcugugggauacucccagcccaccggaagucgagcgggcaguucuugacgaugggauuuacagaauaaugcaaaggggauuacugggucguucucaggugggcgugggggucuuccaggacggaguguuccauaccauguggcacguuacgcgcggcgccguacucauguaucaggguaaacgguuggaaccuuccugggcgucagugaagaaagaccugaucaguuacgggggaggcuggagauuucaaggcagcuggaauacaggggaggagguccaggugauugcuguugaacccggaaagaaccccaaaaaugugcagacuacccccgguacauucaagacccucgagggcgaagucggggccaucgcacuggauuuuaagccuggaacuuccggcucuccaauugugaacagggaggguaaaaucguagggcuuuacggaaauggcgucgugaccacaucgggcacguauguuagcgccauagcucaagccaaggcaucacaggaagggccccugccugagaucgaggacgaaguguucaaaaagcgaaacuugacuauuauggaucuacacccgggauccgguaaaacccggcgcuaccugccagcuaucgucagagaggccauuaagaggaagcuccggacauuaauccuggcgcccacccgagugguugccagugaaauggcagaggcucuuaaaggcaugccuauaagauaucagacuacagccgugaagucugaacauaccgggcgcgagauugucgaccugaugugccacgcuacguuuacuaugaggcucuugagcccagugcguguacccaauuacaacaugaucaucauggaugaggcacauuucacagacccugccuccauugccgcucggggauauaucucaaccagagugggcaugggugaagcggcagccauauuuaugaccgcuacuccgcccgggucuguugaggccuucccacagagcaaugcagucauucaagaugaagagagggacaucccugaacgcaguuggaacuccggauacgauuggauuacagacuuucccggcaaaaccgugugguucgugccaagcaucaagucuggcaaugauauagccaacugucugcggaaaaacgggaagagagucauucagcucucaagaaagacauuugacacugaguaucagaaaacgaagaauaacgacugggauuacguagugaccacagacaucuccgagaugggagcuaauuucagggcggaucgcguuaucgacccucguagaugccugaaacccgugauucuuaaggaugguccagaacgggucauccuagccggcccgaugccugugacuguugcaagugcugcccagaggcgcgggcgaauuggaagaaaccaaaauaaagagggcgaccaguacguguauaugggucagccccugaacaaugaugaagaccacgcacauuggaccgaggccaagauguuguuagauaacauaaauacaccagaggggaucauucccgcucuguucgaaccugagcgggaaaagagcgccgcgaucgacggcgaguacaggcuccgcggagaagcaagaaaaaccuuugucgagcugaugaggcggggcgaucuuccaguguggcugucguauaagguagccucugagggguuccaguacuccgaccgucgcuggugcuuugauggagaacgaaacaaucaagugcucgaggaaaacauggacguugagaucuggacuaaagaaggugagagaaagaaauugaggccccgguggcuggacgcucgcacguauagcgauccucuagcccugagagaguucaaggaauuugcugcaggcaggcggucagucaguggggaccucauucuugagauaggaaaacugccgcagcacuuaaccuugcgagcccagaaugcucuggauaaccucgugaugcugcacaauucugaacagggcgguaaggccuacagacaugcaauggaggaacuuccagacacaaucgagacucugaugcucuuggcgcugauugccguguuaaccgggggcgucacacuauucuuucuguccggaaagggccucgggaaaaccagcaucggacuucuguguguuacugcuucaagugccuugcuguggauggcaagcguggagccccacuggauugcugccuccaucauacucgaguucuuucugaugguacuucucaucccugagcccgaucgccaaaggacaccacaggacaaccagcuggcauauguggucauugguuugcuguucaugaucuuaacgguggccgcuaacgaaaugggccuacuggagaccacuaagaaagaucucgggauuggacauguugcggccgagaaucaccaacacgcaacaaugcuugacguggaucugcggccugcuucugccuggaccuuguacgccgucgcaaccacaguaaucacucccaugaugcgucauacgauagaaaacaccacagcuaauauuagccugacugccaucgcgaaccaggcugccauucucaugggccuggacaaggguuggccaaucuccaaaauggauauaggggugccucuuuuagcacugggcugcuacucacagguuaauccgcucaccuugacagccgcugugcugaugcuagucgcacacuaugccaucauuggacccggccugcaggcgaaggcuaccagagaggcccaaaagaggacugcagccgggaucaugaaaaacccaacgguggacggaauugucgcuaucgaucucgacccugugguuuacgacgccaaguuugaaaaacagcuuggccagauaaugcuguugauucuguguacaucucagauccuccugaugcgcaccacuugggcauuaugcgagaguaucacccuugcuacagguccccugacuacccucugggaagggucgccaggaaaguucuggaauacaacgauugccgugagcauggcgaacaucuuucggggcuccuaucuagccggugcaggccuggcuuucucuuugaugaaaucacuagggggaggccgaagagggaccggagcccaaggcgagacucucggugagaaguggaagaggcagcuuaaucagcugagcaaauccgaguucaacacauacaagcgcagugggauaauggagguagaucggucugaagcaaaagagggauugaagagaggcgaaaccacuaaacaugcugugagccgugguacagccaagcugaggugguuugucgagcggaaucucguuaagccugagggcaaagugauugacuuaggguguggacgcggcggguggucauauuacugcgccggacugaagaaagucaccgaagugaagggcuauacgaaaggugggcccggacacgaggaaccgaucccaauggcgaccuacggcuggaaccuuguaaagcugcauuccggcaaagauguguucuuuaugccucccgagaagugugacacacuacucugcgauauuggggaaaguagcccaaaucccacuaucgaggagggacgaacccugagaguuuugaagaugguggaaccuuggcugagggguaaccaguucuguauaaaaauccucaauccguacaugcccucugucguggagacacuugaacaaaugcagcggaagcacggcgggaugcugguccgcaacccauuauccagaaauucaagccacgagauguauugggugucgugcggaacuggcaacauuguuucugcuguaaacaugaccaguaggaugcuguugaaucgauuuacaauggcacaucggaaaccuaccuacgagcgugacguggaucucggugccgggacuagacacgucgcuguggaacccgagguugccaaccuggacaucauuggacagcgcaucgaaaauauuaagaacgagcauaaauccacguggcacuaugaugaagacaauccuuacaagacaugggcauaucacggcagcuacgaggugaagccaucaggcuccgccucuagcauggucaacggggugguaaggcuacuuaccaaacccugggaugugaucccuaugguuacucaaauagcuaugaccgacacaacgccauucggacagcagcgggucuuuaaggagaaaguggacaccagaacuccccgcgcgaagagggguacaacccagauuauggaagugacugccaaauggcuguggggcuuccucagucgaaauaagaagccgcggaucuguacaagagaggaauuuaccaggaaaguccgcuccaacgcagcuaucggggccguuuucguggaugagaaucaauggaacagcgcaaaggaagccguagaggacgagcguuuuugggaucuggugcaucgggaaagagaguugcacaaacagggaaagugcgcuacaugcgucuauaauaugaugggcaaaagggaaaagaagcugggugaguucgggaaagccaagggaucucgcgcgauuugguacauguggcucggcgcacgauuucuugaguucgaggcccugggcuucaugaacgaggaccauugguuuucacgggaaaauaguuuauccgggguggagggagaaggucugcacaaauugggcuacauacucagagauaucagcaagauuccugggggaaacauguaugcugacgauacugccggcugggacaccaggaucacggaggaugaccugcagaaugaggcaaaaauuaccgauaucauggaaccagagcaugcucuacuugccacaucuauauucaagcugacuuaccagaacaaaguugugcgcguccaaagacccgcuaagaacgguaccgugauggacguaaucucgcggagggaucagcgugggucaggacagguuggcacauauggccucaauacuuuuaccaacauggaagugcagcugauucgacaaauggagagcgaagggaucuucuugccuuccgaguuagagacgccaaaucuggccgaacgcguccucgacuggcuugagaagcacggagcagaaagacugaaacggauggcgauuaguggugacgauuguguggugaagcccaucgacgauagguuugccacagcucuaaccgcccugaacgacaugggcaaaguccgcaaggauauaccgcagugggagccuucuaaaggguggaaugacuggcagcagguucccuucugcagccaccauuuucaccaacucauuaugaaggauggaagagaaaucgugguaccaugucggaaccaggacgaguuggugggcagggcacgagucucccagggugcuggguggucacugcgugagacugccugccuuggaaagaguuacgcacaaauguggcagcugauguauuuccauagacgcgaucuccgguuagccgcgaaugcuaucuguucugccgugccuguugacugggugcccacaagcaggaccacuugguccauucacgcacaccaucaguggaugaccacagaagauaugcugucagucuggaacagaguguggauagaggaaaauccauggauggaggacaaaacgcacguaagcucuugggaagagguucccuacuugggcaagcgcgaggaccaguggugcggcucccugaucgggcucaccgcccgggcuacuugggccacaaacauucaaguggcaaucaaucaggucaggcgacuuauuggaaacgaaaauuaucuggauuacaugaccaguaugaaaagauuuaagaacgagagcgacccugaaggugcucuaugguga

SEQ ID NO: 13424 - RNA, 9879 nt, Artificial Sequence
  derived and/or modified CDS sequence (opt3) from DENV-1__FJ898437__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaacccaaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcgaaaaaacgggaagagagucauucagcugucacggaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaauucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgugacaaugcucgacgucgaucuucggcccgcaucugcuuggacccuguacgccguagccaccacagugaucacuccaaugaugcgucauacgauagaaaacaccacagcaaauauuagcuugacugcuaucgccaaccaggcggcuauucugaugggccucgacaaggguuggccuaucuccaaaauggauauagggguuccgcugcuugccuuaggcugcuacucacaggugaauccccugacccucacagcagccgucuugaugcugguggcucacuaugcaaucauuggaccaggccuacaggccaaggcgaccagagaggcucaaaagaggacugccgcagggaucaugaaaaacccuacggucgacggaauuguggccaucgaucuggaccccguuguguacgacgcuaaguucgaaaaacagcucggccagauaaugcuucugauuuuguguacaucucagauccugcucaugcgcaccacuugggcccugugcgagaguaucaccuuagcaacagguccacuuacuacccugugggaagggucgccuggaaaguuuuggaauacaacgauugcuguaagcauggccaacaucuuccggggcuccuaucucgcgggugccggccuagcauucucucugaugaaaucauuggggggaggccgaagagggaccggagcucaaggcgagacucugggugagaaguggaagaggcagcucaaucagcuuagcaaauccgaauuuaacacauacaagcgcagugggauaauggagguggaucggucugaagccaaagagggacugaagagaggcgaaaccacuaaacaugcagucagccgugguacagcuaaguugaggugguucguugagcggaaucuggugaagcccgagggcaaagucauugaccucggguguggacgcggcggguggucauauuacugcgccggauuaaagaaagugaccgaaguaaagggcuauacgaaaggugggccgggacacgaggaaccaaucccuauggccaccuacggcuggaaccuggugaagcuucauuccggcaaagauguuuuuuucaugcccccagagaagugugacacacugcuaugcgauauuggggaaaguagccccaauccuacuaucgaggagggacgaacccucagagugcugaagauggucgaaccgugguugagggguaaccaguuuuguauaaaaauccugaaucccuacaugccaucuguggucgagacacucgaacaaaugcagcggaagcacggcgggaugcuugugcgcaacccucuguccagaaauucaacucacgagauguauuggguuagcugcggaaccggcaacauuguaucggcggugaacaugacaucuaggauguuacugaaucgauucaccauggcucaucggaaacccacuuacgagcgugacgucgauuugggugcagggacgagacacguggccguugaaccugagguggcuaaccucgacaucauuggacagcgcaucgaaaauauuaagaacgagcauaaaaguacauggcacuaugaugaagacaauccauacaagaccugggccuaucacggcuccuacgaggucaagcccagcggcucagcauccucuauggugaacgggguagugaggcugcuaacuaaaccuugggauguuaucccaauggucacccaaauagccaugacagacacgacccccuuuggacagcagcggguguucaaggagaaaguggacacuagaacaccgcgcgcuaagagggguaccacucagauuauggaagucacagcgaaauggcuuuggggcuuucugagccgaaauaagaagccucggaucuguaccagagaggaauucacaaggaaaguucgcaguaacgccgcaaucggggcuguguuuauugaugagaaucaauggaacuccgccaaggaagcaguagaggacgagcguuucugggaucucgugcaucgggaaagagagcugcacaaacagggaaagugcgccacuugcgucuauaauaugaugggcaaaagggaaaagaaguugggugaguuugggaaagcuaagggaagccgcgccauaugguacauguggcugggcgcgcgauuccucgaauucgaggcacuuggcuuuaugaacgaggaccauugguucucucgggaaaauucacugagugggguggagggagaagguuuacacaaacugggcuacaucuugagagauauuuccaagaucccagggggaaacauguaugccgacgauaccgcuggcugggacacgaggguuaccgaggaugaccuccagaaugaggccaaaauuacagauaucauggaacccgagcaugcacugcuagcuacuagcauauuuaagcuuaccuaccagaacaaagugguccgcgugcaaagaccugccaagaacgguacaguaauggacguuaucucucggagggaucagcgugggucgggacaggugggcacuuauggccugaauaccuucacgaacauggaaguccagcucauucgacaaauggagucagaagggaucuuucugccaagcgaguuggagacacccaauuuagcugaacgcgugcuggacuggcucgagaagcacggagccgaaagacuucggaggauggcaauuuccggugacgauuguguggucaaaccgaucgacgaucgcuucgcgaccgcccugacugcucuaaacgacaugggcaagguuagaaaagauauaccucagugggagcccaguaagggguggaaugacuggcagcaggugccauuuugcucucaccauuuccaccaacugauuaugaaagauggacgggaaaucguagugccuuguaggaaccaggacgagcucgucggccgagcccgugugagccagggugcagggugguccuugagagagacagcuugccugggaaagucauacgcccaaauguggcagcuuauguauuuucaucgccgggaucugaggcucgcagccaaugcgaucuguagugcuguucccguggacugggucccaaccucuagaacuaccuggagcauucacgcccaccaucaguggaugacaacggaagauauguuauccguguggaaccgcguauggauagaggaaaaucccuggauggaggacaagacccacguuucaagcugggaagaggugccuuaccugggcaaacgggaggaccaguggugcggcucuuugaucgggcugacugcaagggccacaugggcuaccaacauucaagucgccaucaaucaggugcgaagacucauuggaaacgaaaauuaucuugauuacaugacuuccaugaagcgguucaaaaacgagagugacccagaaggugcacugugguga

SEQ ID NO: 13425 - RNA, 9879 nt, Artificial Sequence
  derived and/or modified CDS sequence (opt3) from DENV-1__FJ024480__SS-prME
agcgugaccaugcugcucaugcuucugccaacagcauuggcuuuccacuuaacuacgcgaggaggggaaccucauaugaucgucuccaagcaggaaaggggaaaaucucuguuguuuaagaccucagccgguguuaacaugugcacacucauugccauggaccugggcgaacuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagaacaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaaacuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggcaagaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugauggcuucaguggaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauugucuccuuguucccgcuguguuuaucaacuacaagccagaaaaccacuuggcucccugugcugcuuggcaguuuugggugcaagccacugacaauguucuugaucaccgaaaauaagauuuggggaaggaaaucuuggccccucaacgaggguaucauggccauaggcaucguuuccauucugcuaagcucgcugcuuaagaaugacgugccucucgccgggccccugaucgcuggaggcauguugauugcauguuaugucaucucagguucuagugccgauuuaucccuggagaaagcggcugaaguaagcugggagcaagaagccgagcauucugggacgagccacaacauacucguggaaguucaggacgauggaacuaugaagauuaaagacgaggagcgagaugacacccugacaauccuucugaaggcaaccuugcuagccguguccggcgucuacccaaugucaaucccugcuacacuguuugugugguauuucuggcagaaaaagaagcagcgcaguggcguacucugggauacucccagcccaccggaaguggagcgggcaguccuggacgaugggauuuacagaauacuucaaaggggauuacugggucguucucagguuggcguggggguguuccaggacggagucuuucauaccauguggcacgugacgcgcggcgccguucucauguaucaggguaaacgguuggaaccuuccugggcgucaguaaagaaagaccugaucaguuacgggggaggcuggagauuccaaggcagcuggaauacaggggaggaggugcaggucauugcuguggaacccggaaagaaccccaagaauguucagacuacccccgguacauuuaagaccccugagggcgaagugggggccaucgcacucgauuucaagccaggaacuuccggcucucccauugucaacagggaggguaaaaucguggggcuguacggaaauggcguagucaccacaucgggcacguaugugagcgccauagcucaagccaaggcaucacaggaagggccucuuccggagaucgaggacgaaguuuuuaaaaagcgaaaccugacuauuauggauuugcacccaggauccgguaaaacccggcgcuaccuacccgcuaucgugagagaggccauuaagaggaagcugcggacacucaucuuagcgccuacccgagucguggccagugaaauggcagaggcucugaaaggcaugccaauaagauaucagacuacagccguuaagucugaacauaccgggcgcgagauuguggaccuuaugugccacgcuacguucacuaugaggcugcucagccccguccgugugccuaauuacaacaugaucaucauggaugaggcacauuuuacagacccggccuccauugccgcucggggauauaucucaaccagaguaggcaugggugaagcggcagccauauucaugaccgcuacucccccagggucuguggaggccuuuccucagagcaaugcaguuauucaagaugaagagagggacauccccgaacgcaguuggaacuccggauacgauuggauuacagacuucccaggcaaaaccgucugguuugugccuagcaucaagucuggcaaugauauagccaacuguuugcggaaaaacgggaagagagugauucagcugucaagaaagacauucgacacugaguaucagaaaacgaagaauaacgacugggauuacgucguaaccacagacaucuccgagaugggagcuaauuucagggcggaucgcgugaucgacccccguagaugccucaaaccaguuauucugaaggaugguccggaacgggugauccuugccggcccuaugcccgucacuguggcaagugcugcccagaggcgcgggcgaauuggaagaaaccaaaauaaagagggcgaccaguacguuuauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucguggagcucaugaggcggggcgaucugcccgucuggcuuucguauaagguggccucugagggguuucaguacuccgaccgucgcuggugcuucgauggagaacgaaacaaucaaguacuggaggaaaacauggacguggagaucuggacuaaagaaggugagagaaagaaacucaggccucggugguuggacgcucgcacguauagcgauccgcuggcccuaagagaguuuaaggaguucgcugcaggcaggcggucaguuaguggggaccugauucucgagauaggaaaacuuccacagcaccugaccuuacgagcccagaaugcuuuggauaaccuggucaugcuccacaauucugaacagggcgguaaggccuacagacaugcaauggaggaacugcccgacacaaucgagacucuuaugcugcucgcguugauugccgugcugaccgggggcgugacauuauuuuuccuauccggaaagggccuggggaaaaccagcaucggacuccuuugugucacugcuucaagugcccuguuguggauggcaagcguugagccucacuggauugcugccuccaucauacuggaauuuuuccucauggugcugcuuauccccgagccagaucgccaaaggacaccucaggacaaccagcucgcauauguagugauuggucuguuguuuaugauccugacggucgccgcuaacgaaaugggcuuacuagagaccacuaagaaagaucuggggauuggacauguggcggccgagaaucaccaacacgcaacaaugcucgacguugaucuucggcccgcuucugccuggacccuguacgccguggcaaccacagucaucacuccaaugaugcgucauacgauagaaaacaccacagcuaauauuagcuugacugccaucgcgaaccaggcugccauucugaugggccucgacaaggguuggccuaucuccaaaauggauauagggguaccgcugcuugcauuaggcugcuacucacaggugaauccccugacccucacagccgcuguuuugaugcugguggcacacuaugccaucauuggaccaggccuacaggcgaaggcuaccagagaggcccaaaagaggacugcagccgggaucaugaaaaacccuacggucgacggaauuguggcuaucgaucuggaccccgucguguacgacgccaaguucgaaaaacagcucggccagauaaugcuucugauuuuguguacaucucagauccugcucaugcgcaccacuugggcacugugcgagaguaucaccuuagcuacagguccacuuacuacccugugggaagggucgccuggaaaguuuuggaauacaacgauugccguuagcauggcgaacaucuuccggggcuccuaucucgccggugcaggccuagcuuucucucugaugaaaucacuagggggaggccgaagagggaccggagcccaaggcgagacucugggugagaaguggaagaggcagcucaaucagcuuagcaaauccgaauuuaacacauacaagcgcagugggauaauggagguggaucggucugaagcaaaagagggacugaagagaggcgaaaccacuaaacaugcuguaagccgugguacagccaaguugaggugguucguggagcggaaucuggucaagcccgagggcaaaguuauugaccucggguguggacgcggcggguggucauauuacugcgccggauuaaagaaagugaccgaagucaagggcuauacgaaaggugggccgggacacgaggaaccaaucccuauggcgaccuacggcuggaaccuggugaaacuucauuccggcaaagauguauuuuucaugcccccagagaagugugacacacugcuaugcgauauuggggaaaguagccccaauccuacuaucgaggagggacgaacccucagagugcugaagaugguugaaccgugguugagggguaaccaguuuuguauaaaaauccugaaucccuacaugccaucuguggucgagacacucgaacaaaugcagcggaagcacggcgggaugcuugugcgcaacccucuguccagaaauucaacucacgagauguauugggucagcugcggaaccggcaacauugugucggcuguuaacaugacaucuaggauguuacugaaucgauucaccauggcacaucggaaacccacuuacgagcgugacguagauuugggugccgggacgagacacguggcugucgaaccugagguggccaaccucgacaucauuggacagcgcaucgaaaauauuaagaacgagcauaaaaguacauggcacuaugaugaagacaauccauacaagaccugggcauaucacggcuccuacgagguuaagcccagcggcucagccuccucuauggugaacggggucgugaaacugcuaacuaagccuugggauguaaucccaauggugacccaaauagcuaugacagacacgacccccuuuggacagcagaggguuuucaaagagaaggucgacacucggacaccgagagcgaaacgcgguaccacucagauuauggaagugacagccaaguggcuuuggggcuuucugagcaggaauaagaaaccucgaaucuguacccgggaggaguucacaagaaaggugaggaguaacgcagcuaucggggccgucuuuguugaugagaaucaauggaacuccgcaaaagaagccguggaggacgagcgcuucugggaucucguacaucgugaacgggagcugcacaagcagggaaaaugcgcuacuugcguguauaauaugaugggcaagagagaaaagaaauugggugaguuugggaaggccaaaggaagcagggcgauuugguacauguggcugggcgcacgcuuccucgaguucgaggcccuuggcuuuaugaacgaggaccauugguucucucgagaaaauucacugaguggggucgagggagaagguuuacacaagcugggcuacauauugcgggauaucuccaaaauuccagggggaaacauguaugcugacgauaccgccggcugggacacgagaaucaccgaggaugaccuccagaaugaggcaaagauuacagauaucauggaacccgagcaugcucugcuagccacuagcauauuuaaacuuaccuaccagaacaaggugguuagggugcaacgcccugcuaagaacgguacagucauggacgugaucucuagacgggaucagagggggucgggacagguaggcacuuauggccugaauaccuucacgaacauggaaguucagcucauucgucaaauggagucagaagggaucuuucugccaagcgaguuggagacacccaauuuagccgaacgagugcuggacuggcucgagaaacacggagcagaacgccuuaagagaauggcgauuuccggugacgauugugucgugaaaccgaucgacgaucgguucgccaccgcucugacugcccuaaacgacaugggcaaggugaggaaagauauaccucagugggagcccaguaagggguggaaugacuggcagcaggucccauuuugcucucaccauuuccaccaacugauuaugaaggauggacgcgaaaucguugugccuuguagaaaccaggacgagcucguaggccgggcaagggugagccagggugcugggugguccuugcgagagacagccugccugggaaaaucauacgcacaaauguggcagcuuauguauuuucaucguagagaucugcgccucgccgcgaaugcuaucuguagugccguccccguggacuggguuccaaccucucggacuaccuggagcauucacgcacaccaucaguggaugacaacggaagauauguuauccguguggaacagggucuggauagaggaaaaucccuggauggaggacaagacccacgugucaagcugggaagagguaccuuaccugggcaaaagagaggaccaguggugcggcucuuugaucgggcugacugcccgcgcuacaugggccaccaacauucaaguugcaaucaaucaggugcggaggcucauuggaaacgaaaauuaucuugauuacaugacuuccaugaagcgauucaaaaacgagagugacccagaaggugcucugugguga

SEQ ID NO: 13426 - RNA, 9879 nt, Artificial Sequence
  derived and/or modified CDS sequence (opt3) from DENV-1__FJ873814__SS-prME
agcgugaccaugcugcucaugcuucugcccaccgcauuggcuuuccacuuaacuacgagaggaggggaaccucauaugaucgucuccaagcaggaaaggggaaaaucucugcuguuuaagaccucagccgguguuaauaugugcacacucauugccauggaccugggagaacuuugugaagauacuaugaccuacaaaugcccacaaauaaccgaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuguggcauuuuuccuggcccaugcuauuggcacaucgaucacccaaaagggcauuaucuuuauacucuuaaugcuggucacgccaucaauggccaugcggugcguggggaucggaaaccgcgauuucguagagggucuuagcggcgcgacuuggguugacguggucuuggagcacgggaguugugugacaaccauggcaaagaauaaacccacucuggauauugaacuacucaagacagaggugaccaacccugccauccugagaaaacuuugcauugaagcuaagaucuccaauacgaccacagacucuagguguccaacucagggagaggccacccuggucgaagaacaggaugcaaacuuuguuugccggcgcacauucguggaccgaggcugggguaauggguguggauuguuuggcaaaggcagccuccugacuugcgcuaaguucaagugcguaaccaaauuagaggggaagauagugcaguacgaaaaccugaaauauuccgucauugugacaguucacaccggagaucaacaucagguggguaaugagacuacggaacacggcacaaucgccauuaucacaccccaggcgccuacuucagagauccagcucaccgacuacggggcccuuacacuggacuguaguccaagaaccggauuggauuuuaacgaaaugguccuacugacuaugaaggagaaaagcuggcucgugcauaagcaaugguuccuggaccuuccgcugcccuggacaucuggcgcauccacgucacaggagaccuggaauaggcaggauuugcucguaacuuuuaaaacagcucacgccaagaagcaagaaguugugguccuggguagccaggagggggcuaugcacaccgccuuaacaggcgcaacugaaauucagaccaguggaacgaccacaauauucgccggccaucugaaaugccggcuaaagauggacaaacucacucugaaggggaccucuuaugugauguguacaggauccuucaaacuugagaaggaagucgcugagacucagcacgguaccguguugguucaagugaaguacgagggcacggaugcgccuugcaaaaucccauuuagcacacaggacgaaaaggggguaacccagaacggacgucugauuacugcaaaucccaucgucacagauaaagagaagccugugaacauagaaaccgagccacccuucggcgagucguauauuguuaucggugccggggaaaaagcucucaagcugucuugguuuaagaaaggcuccucaaucggaaagauguucgaggccacugcacgcggcgccagaaggauggcuauucuuggggacaccgccugggauuuuggaaguaucgguggcguguucacaagcgucgggaaacuggugcaucagguauuuggaacggcauacggcguguuguucuccgguguuucuuggaccaugaagauugggauaggcauccuccugacuugguuaggacugaauagccggucaacaagucuauccaugaccuguauugcggucggcauggugacacucuaccugggggugaugguccaagcugacagcggaugcguuaucaacuggaaaggccgagaacuuaagugugguucugggaucuuugugacuaacgaggugcacaccuggacggaacaguauaaguuccaggccgauucaccgaaacgcuugagugcagccauuggaaaggcuugggaggagggcguaugcgguauaagaagcgccacaaggcuggaaaauaucauguggaaacagauuuccaacgagcucaaucauauccuguuagaaaacgacaugaaguuuaccgucgugguuggcgacgcaaaugggauucuggcucaaggcaagaagaugauccggccucagcccauggagcacaaauacucuuggaagucguggggcaaggccaaaauaaucggggcggauauucagaacacuaccuucaucauugacggaccagauacaccugaaugucccgacgaucagcgcgccuggaauaucugggagguggaggacuauggcuuugguauauucacuaccaacauuuggcuuaaguugagagauagcuacacacaaaugugcgaccacaggcucauguccgcugcaaucaaagauucaaaggccguccaugcugacaugggguauuggauugaaagugagaaaaaugaaacguggaagcuggcccgugcaucuuucaucgaggugaagaccuguacuuggccaaaaagccacacacuaugguccaacggaguucuggaaucagagaugauaauccccaagauuuacggcgguccuaucagccagcauaauuaucggccaggcuacuuuacccagacugcggggccguggcaccucggaaaacuggagcuugauuucgacuugugcgaaggcacaaccgugguagucgaugagcacugcgggaaccgaggacccucucugagaacgacuaccgugacaggcaagauuauccaugaaugguguugcagguccuguaccuuaccuccacuccgcuuucggggugaggacgggugcugguacggaauggagauaagacccgugaaagaaaaggaggaaaaucuggucaggaguaugguuagcgccggcucuggugagguggacuccuucucacuuggcauucugugugcuaguaucaugaucgaagagguaaugcgcagccgauggucgcggaagauguugaugacugggacacucgccguguuucugcuacugauuaugggacaacucaccuggaacgaucugauccgucuuugcauuauggucggcgcaaaugcuuccgacagaauggggaugggaacaacuuauuuggcccugauggcaaccuucaaaaugaggccuauguuugccgugggcuuacucuuccgccggcugacgucuagagagguucuucugcuaacaauaggucucagccugguggcuucagucgaauugccaaacagucuggaggaauuaggggauggacucgcgaugggcaucaugaugcugaaacuucugaccgaguuucagccccaccaguuguggacuacccuccugucccuaacauucauuaaaacuacccugucucuugacuacgccuggaagacgacagcaauggcucucagcaucgugucccuguuuccguugugucugucaaccacuagccagaaaacaaccugguuaccuguucuccugggcaguuucgggugcaagccacuuacuauguuucugauuacagaaaacaagaucuggggaaggaaaucuuggcccuugaaugaggguauaauggccaucggcauuguguccauccuccugagcucgcuacugaagaacgaugucccucuugccgggccccucauugcuggaggcaugcugaucgcauguuauguaauaucagguucuagugccgacuuguccuuagagaaagcggcugaagugagcugggagcaagaagccgagcauucugggaccagccacaauauucugguugaagugcaggaugacggaacgaugaagaucaaagaugaggagaaggacgauacucucaccauccugcuuaaagcaacacuguuggccgucuccggcguguacccaaugucaauuccugcuacccuauucguaugguauuucuggcagaagaagaaacagcgaaguggcgugcugugggacacacccagcccaccggaagucgagcgcgcaguucucgaugacgggauauaccggauccugcaaagaggacuuuuagguaggucucaggugggcgugggggucuuucaggacggaguguuccauacuauguggcacguuacccguggcgccguacugauguaucaggguaagcgccucgaaccuuccugggcgucagugaaaaaggauuugauuaguuacgggggaggcuggcgguuucaaggcagcuggaacacgggggaggagguccaggugaucgcuguugaacccggcaaaaauccaaagaacgugcagacaacucccgguaccuucaagacaccugagggcgaagucggggccauugcacuggacuuuaaaccaggaaccuccggcucucccaucgugaauagagaggguaagauaguagggcucuacggaaacggcgucgugacuaccucgggcacauauguuagcgccaucgcucaagccaaagcaucacaggaagggccucugccggagauugaggaugaaguguucaagaaaaggaaucuuacgaucauggaccugcacccaggauccgguaagacucgacgguacuugcccgcuauuguccgcgaggccaucaagagaaaacuaaggacccugauacucgcgccuacacgggugguugccagugaaauggcagaggcuuuaaagggcaugccaauucgauaucagaccacugccgugaaaucugaacauacagggagagagaucgucgaucugaugugccacgcuaccuuuacgaugcgccuucugagccccgugaggguaccuaacuacaauaugaucauuauggacgaggcacauuucacugauccggccuccaucgccgcucguggauauauaucaacacgggugggcaugggugaagcggcagccauuuuuaugaccgcuacacccccagggucuguugaggccuucccucagagcaacgcagucauccaagacgaagagagagauauucccgaaaggaguuggaacuccggauacgacuggaucacugauuuuccaggcaagacagugugguucgugccuagcauaaaaucuggcaacgacauugccaauugucuccgcaagaacgggaagcgagucauccaguugucaagaaaaaccuucgacacagaguaucagaagacuaaaaacaaugauugggacuacguagugacgaccgauaucuccgagaugggagcuaacuuucgggcggacaggguuauugauccccgccguugccugaagccagugauccucaaagacgguccggaaagagucauucuggccggcccuaugcccgugacaguugcaagugcugcccagcggagggggcgcauaggacgaaaucaaaacaaggagggcgaucaguacguguauaugggucagccacuuaauaacgacgaagaucacgcacauuggacugaggccaagaugcuacuggacaauaucaacacccccgaggggauuaucccugcuuuguucgaaccagagagagagaaaagcgccgcgaucgauggcgaguaccgguuaaggggagaagcacgcaagacauuugucgagcugaugagaaggggcgaccuccccguguggcugucguauaaaguagccucugagggguuccaguacuccgaucggcguuggugcuuugacggagaacgcaauaaccaagugcuugaggaaaauauggacguugagauuuggaccaaggaaggugagaggaaaaagcugagaccuagauggcucgaugcucggacuuauagcgacccguuggcccugcgcgaguucaaagaauuugcugcaggcagaaggucagucaguggggaucuaauacuggagaucggaaagcucccacagcaccuuacgcugcgggcccagaacgcuuuagacaauuuggugaugcugcacaacucugaacagggcgguaaggccuaccgacaugcaauggaggaacuccccgauaccauugagacacugaugcuucuggcgcucaucgccguguugacugggggcgucacccuguucuuuuuauccggaaaaggccuagggaagacaagcauuggacugcucuguguuaccgcuucaagugcccuucuguggauggcaagcguggagccucacuggaucgcugccuccauaaucuuggaguucuuucugaugguacuccugauucccgagccagacagacaacgcacuccucaggauaaucagcuugcauauguggucaucggucuccuguucaugauuuugacaguggccgcuaacgaaaugggccuguuagagacgaccaaaaaggaccuagggaucggacauguugcggccgagaaccaccaacacgcaacuaugcuggauguggaccucaggcccgcuucugccuggacacuuuacgccgucgcaaccaccguaauaacaccaaugaugcggcauacuauugaaaauacgaccgcuaacaucagccugacagccauugcgaaucaggcugccaucuugaugggccuggauaaagguuggccuauauccaagauggacaucggggugccgcuccuggcacuuggcugcuacucacagguuaaccccuuaacucugaccgccgcugugcucauguuggucgcacacuaugccauuaucggaccaggccugcaggcgaaggcuacacgugaggcccaaaaacgaaccgcagccgggauuaugaagaauccuacuguggauggaaucgucgcuauagaccuagaccccgugguuuacgaugccaaauuugaaaagcagcugggccagauuaugcuccuuauccuguguacgucucagaucuugcugaugaggacaaccugggcacucugcgagaguauuacucuggcuaccgguccauuaacaacucuuugggaagggucgccuggaaaauucuggaacaccacaaucgccgugagcauggcgaauauauuccgcggcuccuaucuggccggugcaggccucgcuuuuucucuaaugaagucacuagggggaggccggcgagggacgggagcccaaggcgagaccuugggugagaaguggaaaagacagcugaaccagcucagcaaguccgaguucaauacuuacaaaaggagugggauuauggagguagaccgcucugaagcaaaggagggacuuaaacggggcgaaacaaccaagcaugcugugagcagagguacugccaagcugcguugguuugucgagaggaacuugguuaaacccgagggcaaggugaucgaucugggguguggacggggcggguggucauauuacugcgccggacucaaaaaggucacagaagugaaaggcuauaccaagggugggccgggacacgaggaauccauuccaauggcgacguacgcuuggaauuuaguaaaacugcauaguggcaaggacguguucuuuaugccucccgagaagugugauacccuucugugcgacaucggcgaaagcucuccaaaccccacaauagaggaggggcgcacucuacgaguucucaaaaugguggaaccuuggcugagaggaaaucaguucuguaucaagauuuugaacccguacaugcccuccgucguggagacccuggaacaaaugcagaggaaacacgguggcaugcucguccggaauccacuuucacgcaacagcacacacgagauguauugggugucgugcgggacuggaaauaucguuucugcaguaaacaugaccaguagaaugcuguuaaacagguuuacaauggcccaucgaaagccuaccuacgagcgggauguggaccugggcgcugguacucgucacgucgccguggaacccgagguugcaaauuuggauauuaucgggcagagaauugaaaacaucaaaaaugagcauaaguccacguggcacuaugacgaagauaacccuuacaagacaugggccuaucacggaagcuacgaggugaaaccaucaggcuccgcuucuagcauggucaauggcgugguacgccuccugaccaagcccugggacgugauaccuaugguuacucaaauugcgaugaccgacacaacgccauucgggcagcagagggucuuuaaagagaagguggauacccggacucccagagccaaacgcggaacaacccagaucauggaagugacugcaaaguggcuaugggguuuccuuaguaggaacaagaaaccgcgaaucuguacacgggaggaauuuaccagaaaggucagguccaaugcugccauuggcgcaguuuucguggacgagaaccaauggaauagcgccaaagaagcuguagaggaugagcgcuuuugggaccuggugcaucgugaacgggagcuccacaagcaggggaaaugcgccacaugcgucuauaacaugaugggaaagagagaaaagaaacugggcgaguucgguaaggcgaaagggucuagggcaauaugguacaugugguugggagcccgcuuccuggaauuugaggcucucggcuucaugaaugaggaucauugguuuucacgagaaaacagucuuuccggcguggagggggaaggacugcacaaguuagguuacauccugcgggacauuagcaaaaucccuggcgggaauauguaugccgaugacacugcaggaugggauaccagaauuacggaggacgauuugcagaacgaggcuaagaucaccgacauaauggaaccagagcaugcccuccuggcuacaucuaucuucaaacuaacuuaccagaauaagguugugaggguccaacgccccgccaagaacggcaccgugauggauguaauuucgagacgggaccagagggguucagggcagguuggaacauauggccuuaacacuuuuaccaauauggaagugcagcugauccgucaaauggagagcgaaggcauuuuccucccuuccgagcuggagacgccaaacuuggcaaaacgagucuuagacuggcuggaaaagcacggggcggagcgccucaaaagaauggccaucaguggagaugacuguguggugaagcccauagaugaccgguuugcuacagcccuuaccgcacugaaugauauggguaaagucaggaaggacauuccgcagugggaaccuucuaagggcuggaacgauuggcagcagguucccuucugcagccaccauuuucaccaacuaaucaugaaagacgggcgcgagaucgugguaccauguagaaaucaggaugaacuggugggacgggcuagggucucccagggcgccgguuggucacuccgagagacugcaugcuuggggaagaguuacgcccaaauguggcagcugauguauuuccaucguagagaccuucgccuggcggcuaacgccauuuguucugcagugccuguugauugggugcccacaagccggaccacuugguccauacacgcccaccaucaguggaugaccacagaggacaugcucucagucuggaauaggguguggaucgaagagaacccauggauggaagacaaaacgcacguaagcucuugggaggaaguucccuacuuaggaaagagagaggaucaguggugcggcucccugauuggcuugaccgcucgcgccacuugggcaacaaauauccaaguggcuauuaaccagguccggaggcugaucgggaaugagaacuaucucgacuacaugaccaguaugaaacgauuuaagaaugaaagcgauccugagggagcccuuugguga

SEQ ID NO: 13427 - RNA, 9879 nt, Artificial Sequence
  derived and/or modified CDS sequence (opt3) from DENV-1__JN819403__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuguguccuuguucccgcuguguuuaucaacuacaagccagaaaaccacuuggcucccuguucugcuuggcaguuuugggugcaagccacugacaauguucuugaucaccgaaaauaagauuuggggaaggaaaucuuggccccucaacgaggguaucauggccauaggcaucguguccauucugcuaagcucgcugcuuaagaaugacgucccucucgccgggccccugaucgcuggaggcauguugauugcauguuauguaaucucagguucuagugccgauuuaucccuggagaaagcggcugaagugagcugggagcaagaagccgagcauucugggacgagccacaacauacucguugaagugcaggacgauggaacuaugaagauuaaagacgaggagcgagaugacacccugacaauccuucugaaggcaaccuugcuagccgucuccggcguguacccaaugucaaucccugcuacacuguuuguaugguauuucuggcagaaaaagaagcagcgcaguggcgugcucugggauacucccagcccaccggaagucgagcgggcaguucuggacgaugggauuuacagaauacuucaaaggggauuacugggucguucucaggugggcgugggggucuuccaggacggaguguuucauaccauguggcacguuacgcgcggcgccguacucauguaucaggguaaacgguuggaaccuuccugggcgucagugaagaaagaccugaucaguuacgggggaggcuggagauuccaaggcagcuggaauacaggggaggagguccaggugauugcuguugaacccggaaagaacccaaaaaaugugcagacuacccccgguacauuuaagaccccugagggcgaagucggggccaucgcacucgauuucaagccaggaacuuccggcucucccauugugaacagggaggguaaaaucguagggcuguacggaaauggcgucgugaccacaucgggcacguauguuagcgccauagcucaagccaaggcaucacaggaagggccucuuccggagaucgaggacgaaguguuuaaaaagcgaaaccugacuauuauggauuugcacccaggauccgguaaaacccggcgcuaccuacccgcuaucgucagagaggccauuaagaggaagcugcggacacucaucuuagcgccuacccgagugguugccagugaaauggcagaggcucugaaaggcaugccaauaagauaucagacuacagccgugaagucugaacauaccgggcgcgagauugucgaccuuaugugccacgcuacguucacuaugaggcugcucagccccgugcguguaccuaauuacaacaugaucaucauggaugaggcacauuuuacagacccggccuccauugccgcucggggauauaucucaaccagagugggcaugggugaagcggcagccauauucaugaccgcuacucccccagggucuguugaggccuuuccucagagcaaugcagucauucaagaugaagagagggacauccccgaacgcaguuggaacuccggauacgauuggauuacagacuucccaggcaaaaccgugugguuugugccuagcaucaagucuggcaaugauauagccaacuguuugcgaaaaaacgggaagagagucauucagcugucacggaagacauucgacacugaguaucagaaaacgaagaauaacgacugggauuacguagugaccacagacaucuccgagaugggagcuaauuucagggcggaucgcguuaucgacccccguagaugccucaaaccagugauucugaaggaugguccggaacgggucauccuugccggcccuaugcccgugacuguugcaagugcugcccagaggcgcgggcgaauuggaagaaaccaaaauaaagagggcgaccaguacguguauaugggucagccacuaaacaaugaugaagaccacgcacauuggaccgaggccaagaugcuguuggauaacauaaauacacccgaggggaucauuccugcuuuauuugaaccagagcgggaaaagagcgccgcgaucgacggcgaguacaggcugcgcggagaagcaagaaaaaccuucgucgagcucaugaggcggggcgaucugcccguguggcuuucguauaagguagccucugagggguuucaguacuccgaccgucgcuggugcuucgauggagaacgaaacaaucaagugcuggaggaaaacauggacguugagaucuggacuaaagaaggugagagaaagaaacucaggccucggugguuggacgcucgcacguauagcgauccgcuggcccuaagagaguuuaaggaauucgcugcaggcaggcggucagucaguggggaccugauucucgagauaggaaaacuuccacagcaccugaccuuacgagcccagaaugcuuuggauaaccuggugaugcuccacaauucugaacagggcgguaaggccuacagacaugcaauggaggaacugcccgacacaaucgagacucuuaugcugcucgcguugauugccgugcugaccgggggcgucacauuauuuuuccuauccggaaagggccuggggaaaaccagcaucggacuccuuuguguuacugcuucaagugcccuguuguggauggcaagcguggagccucacuggauugcugccuccaucauacuggaauuuuuccucaugguacugcuuauccccgagccagaucgccaaaggacaccucaggacaaccagcucgcauauguggucauuggucuguuguuuaugauccugacgguggccgcuaacgaaaugggcuuacuagagaccacuaagaaagaucuggggauuggacauguugcggccgagaaucaccaacacgcaacaaugcucgacguggaucuucggcccgcuucugccuggacccuguacgccgucgcaaccacaguaaucacuccaaugaugcgucauacgauagaaaacaccacagcuaauauuagcuugacugccaucgcgaaccaggcugccauucugaugggccucgacaaggguuggccuaucuccaaaauggauauaggggugccgcugcuugcauuaggcugcuacucacagguuaauccccugacccucacagccgcuguguugaugcuggucgcacacuaugccaucauuggaccaggccuacaggcgaaggcuaccagagaggcccaaaagaggacugcagccgggaucaugaaaaacccuacgguggacggaauugucgcuaucgaucuggaccccgugguuuacgacacaaaguucgaaaaacagcucggccagauaaugcuucugauuuuguguaccucucagauccugcucaugcgcacuaccugggcccugugcgagaguaucacauuagcaacugguccacuuaccacacugugggaagggucgccuggaaaguuuuggaauacgaccauugcugugagcauggccaacaucuuccggggcuccuaucucgcgggugccggccuagcauucucucugaugaaaucauuggggggaggccgaagagggacuggagcucaaggcgagacacugggugagaaguggaagaggcagcucaaucagcuuagcaaauccgaauuuaacaccuacaagcgcagugggauaauggagguagaucggucugaagccaaagagggacugaagagaggcgaaacuacaaaacaugcagugagccgugguaccgcuaaguugaggugguucgucgagcggaaucugguuaagcccgagggcaaagugauugaccucggguguggacgcggcggguggucauauuacugcgccggauuaaagaaagucacggaagugaagggcuauaccaaaggugggccgggacacgagggcccaaucccuauggccacauacggcuggaaccugguaaagcuucauuccgggaaagauguguuuuucaugcccccagaaaagugugacacucugcuaugcgauauuggagagaguagccccaauccuaccaucgaagagggucgaacacucagaguucugaagaugguggagccgugguugaggggcaaccaguuuuguauaaaaauccugaaucccuacaugccaucugucguggaaacucucgagcaaaugcagcggaaguaugggggaaugcuuguccgcaacccucuguccagaaauucaacccacgaaauguacugggugagcugcggcacagguaacauuguuucggcgguaaacaugaccucuaggauguuacugaaucgauucacuauggcucaccggaaacccacguaugagcgugacguggauuugggggcaggaacaagacaugucgccguggagccugaaguugcuaaccucgacaucauuggccagcgcaucgagaauauuaagaacgaacacaaaaguaccuggcauuacgaugaggacaauccauauaagacuugggccuaccacggcuccuaugaagugaagcccagcgggucagcauccucuauggucaacggagugguaaggcugcuaaccaaaccuugggaugugaucccaaugguuacacaaauagccaugacggacaccacucccuuuggucagcagcgggucuucaaggagaaaguggacacaagaaccccgcgcgcuaagaggggcacuacacagauuauggaggugaccgcgaaauggcuuuggggguuucugagccgaaauaagaagccucggaucuguacaagagaagaguucacuaggaaaguccgcaguaacgccgcaaucggagcuguuuuuguggaugaaaaucaauggaacuccgccaaggaggcaguagaagacgagcguuucugggaucucgugcaccgggagagagaacugcauaaacagggcaagugcgccaccugcgucuacaauaugauggguaaaagggagaagaaguugggggaauuuggaaaagcuaagggcagccgcgccauuugguacauguggcugggcgcgcgauuccucgaguucgaagcacuuggguuuaugaacgaggaccacugguucucucgggagaauucacugaguggaguggaaggugagggcuuacauaaacugggguauauauugagagauaucuccaagauuccaggaggcaacauguacgccgacgauacggcugguugggacaccaggaucacagaagaugaccuccagaaugaggccaaaauuacugauaucauggagcccgaacacgcacugcuagcuaccagcauauuuaagcuuacauaucagaacaaaguugugcgcguccaaagaccugccaagaacgggacugugauggacguaaucucucggagggaucagcguggaucgggccagguuggcaccuacgggcugaauacguucacaaacauggaggugcagcucauucgacaaauggaaucagagggaaucuuucugccaagcgaauuggagacccccaauuuagcugagcgcguccuggacuggcucgaaaagcauggugccgagagacuuaaacggauggcaauuuccggcgacgauuguguggugaagccgaucgacgauagguucgcgacugcccugacagcucuaaacgacauggggaaaguccgcaaggauauaccucagugggaacccaguaaaggauggaaugacuggcagcagguuccauuuugcucucaccacuuccaucaacugauuaugaaggauggcagagagaucgugguaccuugucggaaccaggacgaacucguggguagggcccgagucagccagggggcaggaugguccuugcgugagaccgcuugccugggcaagucauaugcccaaauguggcagcuuauguacuuucacagacgcgaucugcggcucgcagccaaugcgaucuguagugcugugcccguugacugggugccaacuucuaggaccacauggagcauucaugcccaccaccaguggaugacgaccgaggauauguuauccgucuggaacagaguguggauagaagagaaucccuggauggaagacaaaacucauguaucaagcugggaggaaguuccuuaucugggcaagcgcgaggaccaguggugcgggucuuugaucggacugacagcacgggccaccugggcuacuaacauucaaguggccaucaaucaggucaggcgacucauugguaacgagaauuaccuugauuacaugacauccaugaaaagauucaagaacgaaagugacccagagggcgcacugugguga

SEQ ID NO: 13428 - RNA, 9879 nt, Artificial Sequence
  derived and/or modified CDS sequence (opt3) from DENV-1__KF973453__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuaucuccuuguucccgcuguguuuaucaacuacaagccagaaaaccacuuggcucccugugcugcuuggcaguuuugggugcaagccacugacaauguucuugauuaccgaaaauaagaucuggggaaggaaaucuuggccccucaacgaggguauaauggccaucggcauuguuuccauccugcuaagcucgcugcuuaagaaugacgugccucucgccgggccccugauugcuggaggcauguugaucgcauguuaugucauaucagguucuagugccgauuuaucccuggagaaagcggcugaaguaagcugggagcaagaagccgagcauucugggacgagccacaacauucucguggaaguucaggacgauggaacuaugaagaucaaagacgaggagcgagaugacacccugacaauccuucugaaggcaaccuugcuagccguguccggcgucuacccaaugucaauuccugcuacacuguuugugugguauuucuggcagaaaaagaagcagcgcaguggcguacucugggauacucccagcccaccggaaguggagcgggcaguccuggacgaugggauauacagaauccuucaaaggggauuacugggucguucucagguuggcguggggguguuccaggacggagucuuucauaccauguggcacgugacgcgcggcgccguucucauguaucaggguaaacgguuggaaccuuccugggcgucaguaaagaaagaccugauuaguuacgggggaggcuggagauuccaaggcagcuggaauacaggggaggaggugcaggucaucgcuguggaacccggaaagaacccaaaaaauguucagacuacccccgguacauuuaagaccccugagggcgaagugggggccauugcacucgauuucaagccaggaacuuccggcucucccaucgucaacagggaggguaaaauaguggggcuguacggaaauggcguagucaccacaucgggcacguaugugagcgccaucgcucaagccaaggcaucacaggaagggccucuuccggagauugaggacgaaguuuuuaaaaagcgaaaccugacuaucauggauuugcacccaggauccgguaaaacccggcgcuaccuacccgcuauugugagagaggccaucaagaggaagcugcggacacucauauuagcgccuacccgagucguggccagugaaauggcagaggcucugaaaggcaugccaauuagauaucagacuacagccguuaagucugaacauaccgggcgcgagaucguggaccuuaugugccacgcuacguucacuaugaggcugcucagccccguccgugugccuaauuacaacaugaucauuauggaugaggcacauuuuacagacccggccuccaucgccgcucggggauauauaucaaccagaguaggcaugggugaagcggcagccauuuucaugaccgcuacucccccagggucuguggaggccuuuccucagagcaaugcaguuauccaagaugaagagagggacauucccgaacgcaguuggaacuccggauacgauuggaucacagacuucccaggcaaaaccgucugguuugugccuagcauaaagucuggcaaugauauugccaacuguuugcgaaaaaacgggaagagagugauccagcugucacggaagacauucgacacugaguaucagaaaacgaagaauaacgacugggauuacgucguaaccacagacaucuccgagaugggagcuaauuucagggcggaucgcgugauugacccccguagaugccucaaaccaguuauccugaaggaugguccggaacgggugauucuugccggcccuaugcccgucacuguggcaagugcugcccagaggcgcgggcgaauaggaagaaaccaaaauaaagagggcgaccaguacguuuauaugggucagccacuaaacaaugaugaagaccacgcacauuggaccgaggccaagaugcuguuggauaacaucaauacacccgaggggauuaucccugcuuuauuugaaccagagcgggaaaagagcgccgcgaucgacggcgaguacaggcugcgcggagaagcaagaaaaaccuucguggagcucaugaggcggggcgaucugcccgucuggcuuucguauaagguggccucugagggguuucaguacuccgaccgucgcuggugcuucgauggagaacgaaacaaucaaguacuggaggaaaacauggacguggagauuuggacuaaagaaggugagagaaagaaacucaggccucggugguuggacgcucgcacguauagcgauccgcuggcccuaagagaguuuaaggaauucgcugcaggcaggcggucaguuaguggggaccugauacucgagaucggaaaacuuccacagcaccugaccuuacgagcccagaaugcuuuggauaaccuggucaugcuccacaauucugaacagggcgguaaggccuacagacaugcaauggaggaacugcccgacacaauugagacucuuaugcugcucgcguugaucgccgugcugaccgggggcgugacauuauuuuuccuauccggaaagggccuggggaaaaccagcauuggacuccuuugugucacugcuucaagugcccuguuguggauggcaagcguugagccucacuggaucgcugccuccauaauccuggaauuuuuccucauggugcugcuuauucccgagccagaucgccaaaggacaccucaggacaaccagcucgcauauguagugaucggucuguuguuuaugauucugacggucgccgcuaacgaaaugggcuuacuagagaccacuaagaaagaucuggggaucggacauguggcggccgagaaucaccaacacgcaacaaugcucgacguugaucuucggcccgcuucugccuggacccuguacgccguggcaaccacagucauaacuccaaugaugcgucauacgauugaaaacaccacagcuaauaucagcuugacugccauugcgaaccaggcugccauccugaugggccucgacaaggguuggccuauauccaaaauggauaucgggguaccgcugcuugcauuaggcugcuacucacaggugaauccccugacccucacagccgcuguuuugaugcugguggcacacuaugccauuaucggaccaggccuacaggcgaaggcuaccagagaggcccaaaagaggacugcagccgggauuaugaaaaacccuacggucgacggaaucguggcuauagaucuggaccccgucguguacgacacaaaguucgaaaaacagcucggccagauuaugcuucugaucuuguguaccucucagauccugcucaugcgcacuaccugggcccugugcgagaguauuacauuagcaacugguccacuuaccacacugugggaagggucgccuggaaaguuuuggaauacgaccaucgcuguuagcauggccaacauauuccggggcuccuaucucgcgggugccggccuagcauucucucugaugaaaucauuggggggaggccgaagagggacuggagcucaaggcgagacacugggugagaaguggaagaggcagcucaaucagcuuagcaaauccgaauuuaacauuuacaagcgcagugggaucauggagguggaucggucugaagccaaagagggacugaagagaggcgaaaccacuaaacaugcaguaagccgugguacagcuaaguugaggugguucguggagcggaaucuggucaagcccgagggcaaaguuauugaccucggguguggacgcggcggguggucauauuacugcgccggauuaaagaaagugaccgaagucaagggcuauacgaaaggugggccgggacacgaggaaccaaucccuauggccaccuacggcuggaaccuggugaagcuucauuccggcaaagauguauuuuucaugcccccagagaagugugacacacugcuaugcgauauaggggaaaguagccccaauccuacuaucgaggagggacgaacccucagagugcugaagaugguugaaccgugguugagggguaaccaguuuuguauuaaaauccugaaucccuacaugccaucuguggucgagacacucgaacaaaugcagcggaaguauggcgggaugcuugugcgcaacccucuguccagaaauucaacucacgagauguacugggucagcugcggaaccggcaacauugugucggcgguuaacaugacaucuaggauguuacugaaucgauucaccauggcucaccggaaacccacuuaugagcgugacguagauuugggugcagggacgagacauguggccgucgaaccugagguggcuaaccucgacaucauuggacagcgcaucgaaaauauaaagaacgagcacaaaaguacauggcauuacgaugaagacaauccauauaagaccugggccuaccacggcuccuaugagguuaagcccagcggcucagcauccucuauggugaacggggucgugaggcugcuaacuaaaccuugggauguaauuccaauggugacccaaaucgccaugacagacacgacccccuuuggacagcagcggguuuucaaggagaaagucgacacuagaacaccgcgcgcuaagagggguaccacucagaucauggaagugacagcgaaauggcuuuggggcuuucugagccgaaauaagaagccucggauuuguaccagagaggaauucacaaggaaagugcgcaguaacgccgcaauaggggcugucuuuguugaugagaaucaauggaacuccgccaaggaagcaguggaggacgagcguuucugggaucucguacaccgggaaagagagcugcauaaacagggaaagugcgccacuugcguguacaauaugaugggcaaaagggaaaagaaguugggugaguuugggaaagcuaagggaagccgcgccaucugguacauguggcugggcgcgcgauuccucgaauucgaggcacuuggcuuuaugaacgaggaccacugguucucucgggaaaauucacugaguggggucgagggagaagguuuacauaaacugggcuauauuuugagagauaucuccaagauuccagggggaaacauguacgccgacgauaccgcuggcugggacacgaggaucaccgaggaugaccuccagaaugaggccaaaauaacagauaucauggaacccgagcacgcacugcuagcuacuagcauuuuuaagcuuaccuaucagaacaaagugguucgcgugcaaagaccugccaagaacgguacagucauggacgugaucucucggagggaucagcgugggucgggacagguaggcacuuacggccugaauaccuucacgaacauggaaguucagcucauucgacaaauggagucagaagggaucuuucugccaagcgaguuggagacacccaauuuagcugaacgcgugcuggacuggcucgagaagcauggagccgaaagacuuaaacggauggcaauauccggugacgauugugucgugaagccgauugacgauagguucgcgaccgcccugacugcucuaaacgacaugggcaaagugcgcaaggauaucccucagugggagcccaguaaaggguggaaugacuggcagcaggucccauuuugcucucaccacuuccaucaacugaucaugaaggauggaagagaaauuguugugccuugucggaaccaggacgagcucguaggcagggcccgagugagccagggugcagggugguccuugcgugagacagcuugccugggaaagucauaugcccaaauguggcagcuuauguacuuucacagacgcgaucugcggcucgcagccaaugcgauauguagugcuguccccguggacuggguuccaaccucuaggacuaccuggagcauccaugcccaccaccaguggaugacaacggaagauauguuauccguguggaacagagucuggauugaggaaaaucccuggauggaggacaaaacccaugugucaagcugggaagagguaccuuaucugggcaagcgcgaggaccaguggugcggcucuuugaucgggcugacugcacgggccacaugggcuaccaacauucaaguugccaucaaucaggugaggcgacucauaggaaacgaaaauuaccuugauuacaugacuuccaugaaaagauucaagaacgagagugacccagaaggugcacugugguga

SEQ ID NO: 13429 - RNA, 9879 nt, Artificial Sequence
  derived and/or modified CDS sequence (opt3) from DENV-1__KF973454__SS-prME
agcgugaccaugcugcucaugcuucugcccacagccuuggcuuuccacuuaacuacgagaggcggggagccucauaugaucgucuccaagcacgaaaggggaaaaucucugcuauuuaagaccucaacagguguuaacaugugcacucucauugcaauggaccugggcgagcuuugugaagauaccaugacauacaaaugcccacggauaaccgaggccgaaccggacgauguggacuguuggugcaaugcgacugauacauggguaaccuaugggacguguagucagacuggagagcaucgccgagacaagcguagcguggcucuggccccccacgucggcuugggucucgagaccagaacagaaacuuggauguccucugagggggcauggaaacaaauccagaggguggaaaccugggcccugcggcauccuggauucacaguuauugcucuguuucucgcacacgccaucggcaccucgauuacgcagaagggcaucauauucaucuuacugaugcuugugacuccaucaauggcuaugcgcugcgucgggauuggaaacagagauuuuguggaggguuugagcggcgccacauggguagacguugugcuggagcacgggaguugugucaccacuauggcgaagaauaaacccacacuagauaucgaacuccugaagaccgaggugacgaacccugcagugcuuaggaaacugugcauugaagccaagaucuccaauaccacaacugacucucgguguccaacccagggagaggcuacauuggucgaagagcaagaugccaacuucguuugccgccgaacucucguggacagaggcugggguaauggguguggacuguuuggcaaaggcagcuuacugaccugcgcaaaguucaagugcguaacaaaacucgaggggaagauagugcaguacgaaaaccuuaaauauuccgucauugugaccguucauacuggagaucagcaccagguggguaaugagacgacagaacauggcaccaucgcuacuauuaccccccaagccccuacaucagagauccagcugaccgacuacggggcguuggcccuagacuguaguccaaggacuggacuggauuuuaacgaaaugguccuccugacaaugaaggagaaaagcuggcuugugcacaagcagugguuccuggacuugccgcuccccuggacgucuggcgcauccaccucacaggagacuuggaaucggcaagaucuguuaguaacauuuaaaaccgcucacgccaagaagcaggaaguugugguccuggguagccaggagggggcuaugcauacagcccuaacuggcgcaaccgaaauccaaacgaguggaaccacaacuauuuucgccggccaccucaaaugccgucugaagauggacaaacuuaccuugaaggggacaucuuaugugauguguacuggauccuuuaaacuggagaaggaagucgcugagacccagcaugguacggugcucguucaggugaaguacgagggcacagaugcgccuugcaaaauaccauucagcacccaggacgaaaaggggguaacucaaaacggacgccugaucacagcaaaucccauugucaccgauaaagagaagccugugaacaucgaaacugagccacccuucggcgagucguauauaguugugggugccggggaaaaagcucuuaagcugucuugguuuaagaaaggcuccucaauuggaaagauguucgaggccaccgcaagaggcgccaggcggauggcuaucuugggggacacagccugggauuuuggaaguaucgguggcgucuucacgagcguggggaaacucguacaccagguguuuggaaccgcauacggcguucuguucuccggugucucuuggacuaugaagauugggaucggcauuuuacugacauggcuaggacucaauagccgaucaaccagucuguccaugacauguauagcggugggcauggugacucuuuacuugggggucaugguucaggcugacagcggaugcgugaucaacuggaaaggccgcgaacugaagugugguucugggauuuuugugaccaacgagguacauacguggacagaacaguauaaguuccaagccgauucaccgaaaagacucagugcagccaucggaaaggcuugggaggagggcgucugcgguaucaggagcgccacccggcuggaaaauauuauguggaaacagauauccaacgaguuaaaucacauccugcuugaaaacgacaugaaguuuacugugguugugggcgacgcaaaugggauuuuggcucagggaaaaaagaugauccgcccucagcccauggagcacaaauacucuuggaagucguggggcaaggccaaaauuaucggggcggauauacaaaacaccacauucaucauugacggaccagauacuccugaaugucccgacgaucagagagccuggaauaucugggaggucgaggacuauggcuuugguauuuucaccacaaacaucuggcucaagcugagggauagcuacacgcagaugugcgaccaucgucuaauguccgcugcaauaaaagauucaaaggccgugcacgcugacaugggguauuggauugaaagugagaaaaaugaaaccuggaagcuggcccgggcaucuuuuaucgagguuaagacuuguacauggccaaaaagccauacccucugguccaacggagugcuggaaucagagaugauuauccccaagauauacggcgguccuaucagccagcacaauuaucgaccaggcuacuucacucaaacagcggggccguggcaccuuggaaaauuggagcuggauuucgacuuaugcgaaggcaccacgguagucguggaugagcauugcgggaacagaggacccucucucaggacuaccacagugaccggcaagauuauccacgaaugguguugccgcuccuguacucugccuccacuucgguuuagaggugaggacgggugcugguacggaauggagauuaggcccgucaaagaaaaggaggaaaaucugguucgcaguauggugagcgccggcucuggugagguagacuccuucucauugggcauccucugugugaguauaaugauugaagaggucaugcgaagccgguggucgcguaagaugcugaugacagggacccuagcuguguuucugcuccugaucaugggacagcuuacauggaacgauuugaucagacugugcauuaugguuggcgccaaugcauccgacaggauggggaugggaacuaccuauuuagcucucauggccacguucaaacugcgcccuauguuugcagugggcauccuuuuccggagacugacaucuagggagguccuacuccugaccauugguuugagccugguggccucaguugaauuaccaaacagucucgaggaacugggggauggacuugcuaugggcauaaugaugcugaaguugcucacugaguuucagccccaucaacuguggaccacacuacugucccuuacuuucaucaaaaccacgcucucucuggacuacgcguggaagacaaccgccauggcauugagcauugugucccuguuuccgaucuguuuaucaacuacaagccagaaaaccacuuggcucccuguccugcuuggcaguuucgggugcaagccacugacaauguauuugauuaccgaaaacaagaucuggggacgaaaaucuuggcccauaaaugaggguaucauggcuauuggcaucguauccauucuccugagcucgcuacugaagaacgaugugccucuugccgggccccucaucgccggaggcaugcugauagcuuguuacguuauuucagguucuagugcagacuuguccuuagagaaagccgcggaagugagcugggagcaggaagcugagcacucugggacgagccauaauauccuggucgaagugcaggaugacggaacuaugcgcaucaaggaugaggagaaagacgauacccucacaauucugcuuaaggccacccuguuggcaguauccggcguguauccaaugucaauaccugccacacuauuugucugguacuucuggcaaaaaaagaagcagcggaguggcguucugugggacacucccagcccaccggaaguggagagagcugugcucgaugacgggaucuauaggauucugcagcguggacuuuuaggucgcucucaggucggcguggggguuuuucaagacggaguauuccacaccauguggcacgugacgcggggcgcaguccugauguaccaggguaaaagacucgaaccuuccugggccucagugaagaaagauuugaucaguuacgggggaggcuggagguuccagggcagcuggaacacaggggaggagguucaggugauugcggucgaacccggaaagaauccaaaaaacgugcaaacuacccccgguacauuuaagaccccugagggcgaaguaggggcuaucgcccuggacuucaagccaggaacuuccggcucucccauagucaaucgagaggguaaaaucguggggcucuauggaaacggcguugugaccacaucgggcacguacgucagcgcaauugcccaggcuaaggccucacaggaagggccucugccggagaucgaggaugaaguguuuaaaaagcggaaucuuacuauuauggaccugcauccaggauccgguaaaacccgcagauauuugcccgcaaucguuagggaggcuauaaagcggaagcuacgaacacugauucucgccccuaccagaguggucgcgagugaaauggccgaggcauuaaaaggcaugccaauccgcuaccaaacuacagcugugaagucugaacacaccgggagggagaucguagaucugaugugccaugccacguucacuaugcgucuucugagccccgugcggguuccuaacuauaauaugauuaucauggacgaggcucacuuuacagauccggcauccauagccgccagaggauacauuucaaccagggucggcaugggugaagcugcggcaaucuucaugaccgccacucccccagggucuguggaggcuuuuccucagagcaacgccgugauucaggacgaagagcgcgauauccccgaacgaaguuggaauuccggauaugacuggauaacagauuucccaggcaaaaccgucugguuuguaccuagcauuaagucuggcaacgacaucgcaaauugucucagaaaaaacgggaagcgggugauccaguugucaaggaagacauucgacacugaguaccaaaaaacgaagaacaaugauugggacuacguugugaccacagauauuuccgagaugggagccaacuuucgcgcugaccgugucaucgaucccagacggugccugaaaccagugauucucaaggacgguccggaaaggguuauacuggcgggcccuaugcccgugacugucgccagugcagcucagcgccgagggagaaucggacggaaucagaacaaagagggcgaucaguauguguacaugggucaaccacuuaauaacgacgaagaucaugcccacuggaccgaggcaaagaugcuacuggacaauauuaacacacccgaggggaucaucccugccuuguucgaaccagagagggaaaagagcgcugccauugauggcgaguaucgcuuaagaggagaagcgaggaaaaccuucguagagcugaugcggcguggcgaccuccccguguggcugucguacaagguugcaucugagggguuucaguauuccgaucgccgauggugcuucgacggagaaagaaauaaccagguccuugaggaaaauauggacguggagauauggacuaaagaaggugagaggaagaaacugcggccucgcuggcucgaugccagaacguacagcgacccguuggcucugagggaguuuaaggaauucgccgcuggccggcgaucagugaguggggaucuaauccuggagauuggaaaacucccacagcaccuuacccugagagcacaaucugccuuagacaacuuggucaugcugcauaauuccgaacagggcgguaaggcuuaucgccacgccauggaggaacuccccgauacaaucgagacucugaugcuucuggcacucauugcgguuuugaccgggggcgugaugcuguuuuucuuaagcggaaagggccuagggaaaacaucaaucggacugcucuguguaaccgccaguagcgcucuucuguggauggccuccguggagccucauuggauagcagcuucuaucauuuuggaauuuuuccugaugguccuccugauccccgagccagacaggcagcggacuccucaggauaaccaacuugccuacgugguuauuggucuccuguuuaugaucuugacaguggcagccaaugaaaugggccuguuagagacgaccaagcgugaccuagggauaggacacgucgcugcggagaaccaccagcaugccacuaugcuggauguagaccucagacccgcaagcgcuuggacacuuuacgccguggccaccaccguuauuacaccaaugaugaggcacacuaucgaaaacacgaccgcaaauauuucccugacagcuaucgccaaccaggcggcuauauugaugggccuggauaaagguuggccuaucucaaagauggacauuggggugccgcuccuggcccuuggcugcuauucucaagucaaucccuuaacucugaccgcagccgugcucauguuggucgcucauuacgcaaucauuggaccaggccugcaggccaaagcgacacgcgaggcucagaagcggaccgccgcagggaucaugaagaacccuacuguggauggaauaguugccauugaccuagaccccgugguauaugaugcuaaauucgaaaagcagcugggccaaaucaugcuccuuauccuguguacgagucagauuuugcugaugcgaacaaccugggcccucugcgagucgaucacucuggcaaccgguccauuaacaacucuuugggaagggagcccuggaaaauuuuggaauaccacaauagcuguguccauggccaacauuuucagaggcucuuaccuggcgggugccggccucgcauuuucacuaaugaagagccuggggggaggcaggcgcgggacgggagcucagggcgagaccuugggugagaaauggaagcggcagcugaaucaacucuccaagcccgaauucaacacuuauaaaagaagugggaucauggaggucgaccguucugaagccaaggagggacuuaaaaggggcgaaacaaccaagcacgcaguuagccgggguacugcuaaacugcgcugguucguggagcgaaauuuggucaagccggagggcaaggugauugaucugggguguggaagaggcggguggucauacuauugcgccggacucaaaaagguaacagaagugaaaggcuacaccaagggugggccaggacaugaggaaccuauccccauggccacguacggcuggaacuuaguuaaacugcacuccggcaaggacguguuuuucaugccacccgagaaaugugauacccuucugugcgacauaggggaaaguagcccuaauccgacaaucgaggagggaaggacucuacggguccucaagaugguggaacccuggcugcgcgguaaccaguuuuguauuaagaucuugaauccauauaugccuucugucguggagacccuggaacagaugcagagaaaacacggcgggaugcucguuaggaacccccuuucccgaaauucaacacaugagauguacuggguaagcugcggaacuggcaacauugugucggcggucaauaugaccucucggaugcuguuaaaccguuucacaauggcucacagaaagccuaccuaugagcgcgauguggaccugggugcagggacuaggcauguuacgguggaaccagaggucgccaacuuggauaucauuggacaacggaucgaaaauauaaaaaacgagcacaagaguacauggcacuacgacgaagauaaucccuauaaaaccugggcuuaccauggcuccuaugaggugaagccuagcggcucagccuccucuaugguaaacggggugguuagacuccugacuaagccaugggacgucauucccauggugacccagaucgcaaugacagacacgaccccguuuggacagcaacgcguguucaaagagaaggucgauacuaggacaccucgagccaaacgggguaccacucagaucauggaaguuacagcuaaguggcuauggggcuuucuuagcagaaauaaaaagccaaggauuuguacccgcgaggaauucacacguaaggugcggaguaacgcggccauaggggcaguauuuguggacgagaaucaguggaacuccgcuaaagaagccgucgaggaugagagauucugggaccuggugcacagggaacgcgagcuccauaagcagggaaaaugcgcaacuugcguuuacaauaugaugggcaagcgagaaaaaaagcugggugaguuugggaaggccaaaggaagccgggcuaucugguacaugugguugggcgccagauuccuggaauuugaggcgcucggcuucaugaacgaggaucacugguucucuagggaaaauucacuuagugggguggagggagaaggucugcauaaguuaggcuauauucugcgcgacaucuccaaaauucccgggggaaacauguacgcagaugacaccgccggcugggauacgagaaucaccgaggacgauuugcaaaaugaggcuaagauaacagacaucauggaaccugagcacgcccuccuggcaacuagcauuuuuaaacuaaccuaucagaacaaggucgugcggguacagaggccagcuaaaaaugguacaguuauggaugugaucucucgucgagaccagcgcgggucgggacaagucggcacuuacggccuuaacaccuucacgaacauggaagugcagcugauuagacagauggagucagaagggaucuuucuccccagcgagcuggagacaccgaauuuggccgaacggguguuagacuggcuggagaagcacggagcugaaaggcucaagcgcauggccauauccggugaugacugugucguuaaaccuauugaugacagauucgcaaccgcgcuuacugcccugaacgauaugggcaaggugcggaaagacaucccccagugggagccaaguaagggguggaaugauuggcaacagguaccuuuuugcucucaucacuuccaucagcuaaucaugaaagacggaagggaaauugugguccccugucgaaaccaggaugagcuggugggccgugcuagaguuagccaaggugccggguggucccuccgcgagacagcaugcuugggaaagucauaugcucagauguggcagcugauguacuuucaccggagggaccuuagacuggccgcaaaugccauauguagugcggugccagucgauugggugcccaccucucgcacuaccuggagcauccacgcucaucaccaauggaugacaacggaagacaugcucuccguauggaaccggguuuggauugaggaaaauccuuggauggaggacaagacccaugugucaagcugggaagaggucccauauuuaggcaaaagggaggaucaguggugcggcucucugaucggguugacugcccgagcaacaugggccaccaacauucagguggcuaucaaucagguuagacggcugauaggaaacgaaaauuaccucgacuacaugacuuccaugaagagguucaaaaacgagagugauccggaaggugugcuuugguga

SEQ ID NO: 13430 - RNA, 9879 nt, Artificial Sequence
  derived and/or modified CDS sequence (opt3) from DENV-1__KF973455__SS-prME
agcgugaccaugcugcucaugcuucugcccacagccuuggcuuuccacuuaacuacgagaggcggggagccucauaugaucgucuccaagcacgaaaggggaaaaucucugcuauuuaagaccucaacagguguuaacaugugcacucucauugcaauggaccugggcgagcuuugugaagauaccaugacauacaaaugcccacggauaaccgaggccgaaccggacgauguggacuguuggugcaaugcgacugauacauggguaaccuaugggacguguagucagacuggagagcaucgccgagacaagcguagcguggcucuggccccccacgucggcuugggucucgagaccagaacagaaacuuggauguccucugagggggcauggaaacaaauccagaggguggaaaccugggcccugcggcauccuggauucacaguuauugcucuguuucucgcacacgccaucggcaccucgauuacgcagaagggcaucauauucaucuuacugaugcuugugacuccaucaauggcuaugcgcugcgucgggauuggaaacagagauuuuguggaggguuugagcggcgccacauggguagacguugugcuggagcacgggaguugugucaccacuauggcgaagaauaaacccacacuagauaucgaacuccugaagaccgaggugacgaacccugcagugcuuaggaaacugugcauugaagccaagaucuccaauaccacaacugacucucgguguccaacccagggagaggcuacauuggucgaagagcaagaugccaacuucguuugccgccgaacucucguggacagaggcugggguaauggguguggacuguuuggcaaaggcagcuuacugaccugcgcaaaguucaagugcguaacaaaacucgaggggaagauagugcaguacgaaaaccuuaaauauuccgucauugugaccguucauacuggagaucagcaccagguggguaaugagacgacagaacauggcaccaucgcuacuauuaccccccaagccccuacaucagagauccagcugaccgacuacggggcguuggcccuagacuguaguccaaggacuggacuggauuuuaacgaaaugguccuccugacaaugaaggagaaaagcuggcuugugcacaagcagugguuccuggacuugccgcuccccuggacgucuggcgcauccaccucacaggagacuuggaaucggcaagaucuguuaguaacauuuaaaaccgcucacgccaagaagcaggaaguugugguccuggguagccaggagggggcuaugcauacagcccuaacuggcgcaaccgaaauccaaacgaguggaaccacaacuauuuucgccggccaccucaaaugccgucugaagauggacaaacuuaccuugaaggggacaucuuaugugauguguacuggauccuuuaaacuggagaaggaagucgcugagacccagcaugguacggugcucguucaggugaaguacgagggcacagaugcgccuugcaaaauaccauucagcacccaggacgaaaaggggguaacucaaaacggacgccugaucacagcaaaucccauugucaccgauaaagagaagccugugaacaucgaaacugagccacccuucggcgagucguauauaguugugggugccggggaaaaagcucuuaagcugucuugguuuaagaaaggcuccucaauuggaaagauguucgaggccaccgcaagaggcgccaggcggauggcuaucuugggggacacagccugggauuuuggaaguaucgguggcgucuucacgagcguggggaaacucguacaccagguguuuggaaccgcauacggcguucuguucuccggugucucuuggacuaugaagauugggaucggcauuuuacugacauggcuaggacucaauagccgaucaaccagucuguccaugacauguauagcggugggcauggugacucuuuacuugggggucaugguucaggcugacagcggaugcgugaucaacuggaaaggccgcgaacugaagugugguucugggauuuuugugaccaacgagguacauacguggacagaacaguauaaguuccaagccgauucaccgaaaagacucagugcagccaucggaaaggcuugggaggagggcgucugcgguaucaggagcgccacccggcuggaaaauauuauguggaaacagauauccaacgaguuaaaucacauccugcuugaaaacgacaugaaguuuacugugguugugggcgacgcaaaugggauuuuggcucagggaaaaaagaugauccgcccucagcccauggagcacaaauacucuuggaagucguggggcaaggccaaaauuaucggggcggauauacaaaacaccacauucaucauugacggaccagauacuccugaaugucccgacgaucagagagccuggaauaucugggaggucgaggacuauggcuuugguauuuucaccacaaacaucuggcucaagcugagggauagcuacacgcagaugugcgaccaucgucuaauguccgcugcaauaaaagauucaaaggccgugcacgcugacaugggguauuggauugaaagugagaaaaaugaaaccuggaagcuggcccgggcaucuuuuaucgagguuaagacuuguacauggccaaaaagccauacccucugguccaacggagugcuggaaucagagaugauuauccccaagauauacggcgguccuaucagccagcacaauuaucgaccaggcuacuucacucaaacagcggggccguggcaccuuggaaaauuggagcuggauuucgacuuaugcgaaggcaccacgguagucguggaugagcauugcgggaacagaggacccucucucaggacuaccacagugaccggcaagauuauccacgaaugguguugccgcuccuguacucugccuccacuucgguuuagaggugaggacgggugcugguacggaauggagauuaggcccgucaaagaaaaggaggaaaaucugguucgcaguauggugagcgccggcucuggugagguagacuccuucucauugggcauccucugugugaguauaaugauugaagaggucaugcgaagccgguggucgcguaagaugcugaugacagggacccuagcuguguuucugcuccugaucaugggacagcuuacauggaacgauuugaucagacugugcauuaugguuggcgccaaugcauccgacaggauggggaugggaacuaccuauuuagcucucauggccacguucaaacugcgcccuauguuugcagugggcauccuuuuccggagacugacaucuagggagguccuacuccugaccauugguuugagccugguggccucaguugaauuaccaaacagucucgaggaacugggggauggacuugcuaugggcauaaugaugcugaaguugcucacugaguuucagccccaucaacuguggaccacacuacugucccuuacuuucaucaaaaccacgcucucucuggacuacgcguggaagacaaccgccauggcauugagcauugugucccuguuuccgaucuguuuaucaacuacaagccagaaaaccacuuggcucccuguccugcuuggcaguuucgggugcaagccacugacaauguauuugauuaccgaaaacaagaucuggggacgaaaaucuuggcccauaaaugaggguaucauggcuauuggcaucguauccauucuccugagcucgcuacugaagaacgaugugccucuugccgggccccucaucgccggaggcaugcugauagcuuguuacguuauuucagguucuagugcagacuuguccuuagagaaagccgcggaagugagcugggagcaggaagcugagcacucugggacgagccauaauauccuggucgaagugcaggaugacggaacuaugcgcaucaaggaugaggagaaagacgauacccucacaauucugcuuaaggccacccuguuggcaguauccggcguguauccaaugucaauaccugccacacuauuugucugguacuucuggcaaaaaaagaagcagcggaguggcguucugugggacacucccagcccaccggaaguggagagagcugugcucgaugacgggaucuauaggauucugcagcguggacuuuuaggucgcucucaggucggcguggggguuuuucaagacggaguauuccacaccauguggcacgugacgcggggcgcaguccugauguaccaggguaaaagacucgaaccuuccugggccucagugaagaaagauuugaucaguuacgggggaggcuggagguuccagggcagcuggaacacaggggaggagguucaggugauugcggucgaacccggaaagaauccaaaaaacgugcaaacuacccccgguacauuuaagaccccugagggcgaaguaggggcuaucgcccuggacuucaagccaggaacuuccggcucucccauagucaaucgagaggguaaaaucguggggcucuauggaaacggcguugugaccacaucgggcacguacgucagcgcaauugcccaggcuaaggccucacaggaagggccucugccggagaucgaggaugaaguguuuaaaaagcggaaucuuacuauuauggaccugcauccaggauccgguaaaacccgcagauauuugcccgcaaucguuagggaggcuauaaagcggaagcuacgaacacugauucucgccccuaccagaguggucgcgagugaaauggccgaggcauuaaaaggcaugccaauccgcuaccaaacuacagcugugaagucugaacacaccgggagggagaucguagaucugaugugccaugccacguucacuaugcgucuucugagccccgugcggguuccuaacuauaauaugauuaucauggacgaggcucacuuuacagauccggcauccauagccgccagaggauacauuucaaccagggucggcaugggugaagcugcggcaaucuucaugaccgccacucccccagggucuguggaggcuuuuccucagagcaacgccgugauucaggacgaagagcgcgauauccccgaacgaaguuggaauuccggauaugacuggauaacagauuucccaggcaaaaccgucugguuuguaccuagcauuaagucuggcaacgacaucgcaaauugucucagaaaaaacgggaagcgggugauccaguugucaaggaagacauucgacacugaguaccaaaaaacgaagaacaaugauugggacuacguugugaccacagauauuuccgagaugggagccaacuuucgcgcugaccgugucaucgaucccagacggugccugaaaccagugauucucaaggacgguccggaaaggguuauacuggcgggcccuaugcccgugacugucgccagugcagcucagcgccgagggagaaucggacggaaucagaacaaagagggcgaucaguauguguacaugggucaaccacuuaauaacgacgaagaucaugcccacuggaccgaggcaaagaugcuacuggacaauauuaacacacccgaggggaucaucccugccuuguucgaaccagagagggaaaagagcgcugccauugauggcgaguaucgcuuaagaggagaagcgaggaaaaccuucguagagcugaugcggcguggcgaccuccccguguggcugucguacaagguugcaucugagggguuucaguauuccgaucgccgauggugcuucgacggagaaagaaauaaccagguccuugaggaaaauauggacguggagauauggacuaaagaaggugagaggaagaaacugcggccucgcuggcucgaugccagaacguacagcgacccguuggcucugagggaguuuaaggaauucgccgcuggccggcgaucagugaguggggaucuaauccuggagauuggaaaacucccacagcaccuuacccugagagcacaaaacgccuuagacaauuuggucaugcugcauaacucugaacagggcgguaaggcuuaucgccacgccauggaggaacuccccgauacaaucgagacucugaugcuucuggcacucauugcgguuuugaccgggggcgugaugcuguuuuucuuauccggaaagggccuagggaaaacaagcaucggacugcucuguguaaccgccucaagugcucuucuguggauggccagcguggagccucauuggauagcagcuuccaucauuuuggaauuuuuccugaugguccuccugauccccgagccagacaggcagcggacuccucaggauaaucaacuugccuacgugguuauuggucuccuguuuaugaucuugacaguggcagccaacgaaaugggccuguuagagacgaccaagcgugaccuagggauaggacacgucgcugcggagaaccaccagcaugccacuaugcuggauguagaccuccaccccgcaucugcuuggacacuuuacgccguggccaccaccguuauuacaccaaugaugagacauacuaucgaaaauacgaccgcaaacauuagccugacagcuaucgccaaucaggcggcuauauugaugggccuggauaaagguuggccuaucuccaagauggacauuggggugccgcuccuggcccuuggcugcuauucacaagucaaccccuuaacucugaccgcagccgugcucauguuggucgcucacuacgcaaucauuggaccaggccugcaggccaaagcgacaagggaggcucagaagcgcaccgccgcagggaucaugaagaauccuacuguggauggaauaguugccauugaccuagaccccgugguauaugaugcuaaauucgaaaagcagcugggccaaaucaugcuccuuauccuguguacgucucagauuuugcugaugcggacaaccugggcccucugcgagaguaucacucuggcaaccgguccauuaacaacucuuugggaagggucgccuggaaaauuuuggaacaccacaauagcugugagcauggccaauauuuuccgaggcuccuaccuggcgggugccggccucgcauuuucucuaaugaagucacuggggggaggcagaagggggacgggagcucagggcgagaccuugggugagaaauggaagcgccagcugaaccaacucagcaagcccgaauucaauacuuauaaacgguccgggaucauggaggucgacagaagugaagccaaggagggacuuaaacguggcgaaacaaccaagcaugcaguuucuagggguacugcuaaacugcggugguucguggagcgcaacuuggucaagccggagggcaaggugauugaucugggguguggacgaggcggguggagcuacuauugcgccggacucaaaaagguaacagaagugaaaggcuacaccaagggugggccaggacacgaggaaccuauccccauggccacguacggcuggaauuuaguuaaacugcacucaggcaaggacguguuuuucaugccacccgagaaaugugauacccuucugugcgacauaggggaauccaguccuaacccgacaaucgaggagggaagaacucuaaggguccucaagaugguggaacccuggcugcgggguaaucaguuuuguauuaagaucuugaacccauauaugccuagcgucguggagacccuggaacagaugcagcgcaaacauggcgggaugcucguuagaaauccccuuucuaggaacuccacacacgagauguacuggguaucaugcggaacuggcaauauugugagcgcggucaacaugaccucgcgaaugcuguuaaaccgguucacaauggcucaucguaagccuaccuaugagagagauguggaccugggugcagggacucgccacguuacgguggaaccagaggucgccaauuuggauaucauuggacaaaggaucgaaaacauaaaaaaugagcacaagucuacauggcauuacgacgaagauaaccccuauaaaaccugggcuuaccacggcaguuaugaggugaagccuuccggcagcgccucauccaugguaaauggggugguucggcuccugacuaagccaugggacgucauucccauggugacccagaucgcaaugacagacacgaccccguuuggacagcaaagaguguucaaagagaaggucgauacucgcacaccuagggccaaacgagguaccacucagaucauggaaguuacagcuaaguggcuauggggcuuucuuucucggaacaaaaagccaagaauuuguaccagggaggaauucacacgcaaggugcguagcaaugcggccauaggggcaguauuuguggacgagaaccaguggaauagugcuaaagaagccgucgaggaugagcgguucugggaccuggugcauagagaaagggagcuccacaagcagggaaaaugcgcaacuugcguuuacaacaugaugggcaagcgcgaaaaaaagcugggugaguuugggaaggccaaaggaucccgagcuaucugguacaugugguugggcgcccgguuccuggaauuugaggcgcucggcuucaugaaugaggaucauugguucagcagagaaaacucucuuucagggguggagggagaaggucugcacaaguuaggcuauauucugagggacaucaguaaaauucccgggggaaauauguacgcagaugacaccgccggcugggauacgcgcaucaccgaggacgauuugcaaaacgaggcuaagauaacagacaucauggaaccugagcacgcccuccuggcaacuuccauuuuuaaacuaaccuaucagaauaaggucgugagaguacagcggccagcuaaaaacgguacaguuauggaugugaucagcaggcgugaccagcgagggucuggacaagucggcacuuacggccuuaacaccuucacgaauauggaagugcagcugauucgccagauggagucggaagggaucuuucuccccucagagcuggagacaccgaacuuggccgaaagaguguuagacuggcuggagaagcauggagcugaacggcucaagaggauggccauaagcggugaugacugugucguuaaaccuauugaugaccgcuucgcaaccgcgcuuacugcccugaaugauaugggcaaggugagaaaagacaucccccagugggagccauccaagggguggaacgauuggcaacagguaccuuuuugcagucaccauuuccaccagcuaaucaugaaagacggacgggaaauugugguccccuguaggaaucaggaugagcuggugggccgagcucguguuucucaaggugccggguggagccucagagagacagcaugcuugggaaaguccuaugcucagauguggcagcugauguacuuucaccgccgggaccuuaggcuggccgcaaacgccauauguucagcggugccagucgauugggugcccaccaguagaacuaccuggucuauccaugcucaccaucaauggaugacaacggaagacaugcucagcguauggaaucgcguuuggauugaggaaaacccuuggauggaggacaagacccacguguccucaugggaagaggucccauauuuaggcaaacgggaggaucaguggugcggcagccugaucggguugacugccagggcaacaugggccaccaauauucagguggcuaucaaccagguucgaagacugauaggaaaugaaaacuaccucgacuacaugacuucuaugaagcgguucaaaaaugaguccgauccggaaggugcccuuugguga

SEQ ID NO: 13431 - RNA, 9879 nt, Artificial Sequence
  derived and/or modified CDS sequence (opt3) from DENV-1__KF973456__SS-prME
agcgugaccaugcugcucaugcuucugcccacagccuuggcuuuccacuuaacuacgagaggcggggagccucauaugaucgucuccaagcacgaaaggggaaaaucucugcuauuuaagaccucaacagguguuaacaugugcacucucauugcaauggaccugggcgagcuuugugaagauaccaugacauacaaaugcccacggauaaccgaggccgaaccggacgauguggacuguuggugcaaugcgacugauacauggguaaccuaugggacguguagucagacuggagagcaucgccgagacaagcguagcguggcucuggccccccacgucggcuugggucucgagaccagaacagaaacuuggauguccucugagggggcauggaaacaaauccagaggguggaaaccugggcccugcggcauccuggauucacaguuauugcucuguuucucgcacacgccaucggcaccucgauuacgcagaagggcaucauauucaucuuacugaugcuugugacuccaucaauggcuaugcgcugcgucgggauuggaaacagagauuuuguggaggguuugagcggcgccacauggguagacguugugcuggagcacgggaguugugucaccacuauggcgaagaauaaacccacacuagauaucgaacuccugaagaccgaggugacgaacccugcagugcuuaggaaacugugcauugaagccaagaucuccaauaccacaacugacucucgguguccaacccagggagaggcuacauuggucgaagagcaagaugccaacuucguuugccgccgaacucucguggacagaggcugggguaauggguguggacuguuuggcaaaggcagcuuacugaccugcgcaaaguucaagugcguaacaaaacucgaggggaagauagugcaguacgaaaaccuuaaauauuccgucauugugaccguucauacuggagaucagcaccagguggguaaugagacgacagaacauggcaccaucgcuacuauuaccccccaagccccuacaucagagauccagcugaccgacuacggggcguuggcccuagacuguaguccaaggacuggacuggauuuuaacgaaaugguccuccugacaaugaaggagaaaagcuggcuugugcacaagcagugguuccuggacuugccgcuccccuggacgucuggcgcauccaccucacaggagacuuggaaucggcaagaucuguuaguaacauuuaaaaccgcucacgccaagaagcaggaaguugugguccuggguagccaggagggggcuaugcauacagcccuaacuggcgcaaccgaaauccaaacgaguggaaccacaacuauuuucgccggccaccucaaaugccgucugaagauggacaaacuuaccuugaaggggacaucuuaugugauguguacuggauccuuuaaacuggagaaggaagucgcugagacccagcaugguacggugcucguucaggugaaguacgagggcacagaugcgccuugcaaaauaccauucagcacccaggacgaaaaggggguaacucaaaacggacgccugaucacagcaaaucccauugucaccgauaaagagaagccugugaacaucgaaacugagccacccuucggcgagucguauauaguugugggugccggggaaaaagcucuuaagcugucuugguuuaagaaaggcuccucaauuggaaagauguucgaggccaccgcaagaggcgccaggcggauggcuaucuugggggacacagccugggauuuuggaaguaucgguggcgucuucacgagcguggggaaacucguacaccagguguuuggaaccgcauacggcguucuguucuccggugucucuuggacuaugaagauugggaucggcauuuuacugacauggcuaggacucaauagccgaucaaccagucuguccaugacauguauagcggugggcauggugacucuuuacuugggggucaugguucaggcugacagcggaugcgugaucaacuggaaaggccgcgaacugaagugugguucugggauuuuugugaccaacgagguacauacguggacagaacaguauaaguuccaagccgauucaccgaaaagacucagugcagccaucggaaaggcuugggaggagggcgucugcgguaucaggagcgccacccggcuggaaaauauuauguggaaacagauauccaacgaguuaaaucacauccugcuugaaaacgacaugaaguuuacugugguugugggcgacgcaaaugggauuuuggcucagggaaaaaagaugauccgcccucagcccauggagcacaaauacucuuggaagucguggggcaaggccaaaauuaucggggcggauauacaaaacaccacauucaucauugacggaccagauacuccugaaugucccgacgaucagagagccuggaauaucugggaggucgaggacuauggcuuugguauuuucaccacaaacaucuggcucaagcugagggauagcuacacgcagaugugcgaccaucgucuaauguccgcugcaauaaaagauucaaaggccgugcacgcugacaugggguauuggauugaaagugagaaaaaugaaaccuggaagcuggcccgggcaucuuuuaucgagguuaagacuuguacauggccaaaaagccauacccucugguccaacggagugcuggaaucagagaugauuauccccaagauauacggcgguccuaucagccagcacaauuaucgaccaggcuacuucacucaaacagcggggccguggcaccuuggaaaauuggagcuggauuucgacuuaugcgaaggcaccacgguagucguggaugagcauugcgggaacagaggacccucucucaggacuaccacagugaccggcaagauuauccacgaaugguguugccgcuccuguacucugccuccacuucgguuuagaggugaggacgggugcugguacggaauggagauuaggcccgucaaagaaaaggaggaaaaucugguucgcaguauggugagcgccggcucuggugagguagacuccuucucauugggcauccucugugugaguauaaugauugaagaggucaugcgaagccgguggucgcguaagaugcugaugacagggacccuagcuguguuucugcuccugaucaugggacagcuuacauggaacgauuugaucagacugugcauuaugguuggcgccaaugcauccgacaggauggggaugggaacuaccuauuuagcucucauggccacguucaaacugcgcccuauguuugcagugggcauccuuuuccggagacugacaucuagggagguccuacuccugaccauugguuugagccugguggccucaguugaauuaccaaacagucucgaggaacugggggauggacuugcuaugggcauaaugaugcugaaguugcucacugaguuucagccccaucaacuguggaccacacuacugucccuuacuuucaucaaaaccacgcucucucuggacuacgcguggaagacaaccgccauggcauugagcauugugucccuguuuccgaucuguuuaucaacuacaagccagaaaaccacuuggcucccuguccugcuuggcaguuucgggugcaagccacugacaauguauuugauuaccgaaaacaagaucuggggacgaaaaucuuggcccauaaaugaggguaucauggcuauuggcaucguauccauucuccugagcucgcuacugaagaacgaugugccucuugccgggccccucaucgccggaggcaugcugauagcuuguuacguuauuucagguucuagugcagacuuguccuuagagaaagccgcggaagugagcugggagcaggaagcugagcacucugggacgagccauaauauccuggucgaagugcaggaugacggaacuaugcgcaucaaggaugaggagaaagacgauacccucacaauucugcuuaaggccacccuguuggcaguauccggcguguauccaaugucaauaccugccacacuauuugucugguacuucuggcaaaaaaagaagcagcggaguggcguucugugggacacucccagcccaccggaaguggagagagcugugcucgaugacgggaucuauaggauucugcagcguggacuuuuaggucgcucucaggucggcguggggguuuuucaagacggaguauuccacaccauguggcacgugacgcggggcgcaguccugauguaccaggguaaaagacucgaaccuuccugggccucagugaagaaagauuugaucaguuacgggggaggcuggagguuccagggcagcuggaacacaggggaggagguucaggugauugcggucgaacccggaaagaauccaaaaaacgugcaaacuacccccgguacauuuaagaccccugagggcgaaguaggggcuaucgcccuggacuucaagccaggaacuuccggcucucccauagucaaucgagaggguaaaaucguggggcucuauggaaacggcguugugaccacaucgggcacguacgucagcgcaauugcccaggcuaaggccucacaggaagggccucugccggagaucgaggaugaaguguuuaaaaagcggaaucuuacuauuauggaccugcauccaggauccgguaaaacccgcagauauuugcccgcaaucguuagggaggcuauaaagcggaagcuacgaacacugauucucgccccuaccagaguggucgcgagugaaauggccgaggcauuaaaaggcaugccaauccgcuaccaaacuacagcugugaagucugaacacaccgggagggagaucguagaucugaugugccaugccacguucacuaugcgucuucugagccccgugcggguuccuaacuauaauaugauuaucauggacgaggcucacuuuacagauccggcauccauagccgccagaggauacauuucaaccagggucggcaugggugaagcugcggcaaucuucaugaccgccacucccccagggucuguggaggcuuuuccucagagcaacgccgugauucaggacgaagagcgcgauauccccgaacgaaguuggaauuccggauaugacuggauaacagauuucccaggcaaaaccgucugguuuguaccuagcauuaagucuggcaacgacaucgcaaauugucucagaaaaaacgggaagcgggugauccaguugucaaggaagacauucgacacugaguaccaaaaaacgaagaacaaugauugggacuacguugugaccacagauauuuccgagaugggagccaacuuucgcgcugaccgugucaucgaucccagacggugccugaaaccagugauucucaaggacgguccggaaaggguuauacuggcgggcccuaugcccgugacugucgccagugcagcucagcgccgagggagaaucggacggaaucagaacaaagagggcgaucaguauguguacaugggucaaccacuuaauaacgacgaagaucaugcccacuggaccgaggcaaagaugcuacuggacaauauuaacacacccgaggggaucaucccugccuuguucgaaccagagagggaaaagagcgcugccauugauggcgaguaucgcuuaagaggagaagcgaggaaaaccuucguagagcugaugcggcguggcgaccuccccguguggcugucguacaagguugcaucugagggguuucaguauuccgaucgccgauggugcuucgacggagaaagaaauaaccagguccuugaggaaaauauggacguggagauauggacuaaagaaggugagaggaagaaacugcggccucgcuggcucgaugccagaacguacagcgacccguuggcucugagggaguuuaaggaauucgccgcuggccggcgaucagugaguggggaucuaauccuggagauuggaaaacucccacagcaccuuacccugagagcacaaaacgccuuagacaauuuggucaugcugcauaacucugaacagggcgguaaggcuuaucgccacgccauggaggaacuccccgauacaaucgagacucugaugcuucuggcacucauugcgguuuugaccgggggcgugaugcuguuuuucuuauccggaaagggccuagggaaaacaagcaucggacugcucuguguaaccgccucaagugcucuucuguggauggccagcguggagccucauuggauagcagcuuccaucauuuuggaauuuuuccugaugguccuccugauccccgagccagacaggcagcggacuccucaggauaaucaacuugccuacgugguuauuggucuccuguuuaugaucuugacaguggcagccaacgaaaugggccuguuagagacgaccaagcgugaccuagggauaggacacgucgcugcggagaaccaccagcaugccacuaugcuggauguagaccucagacccgcaucugcuuggacacuuuacgccguggccaccaccguuauuacaccaaugaugaggcacacuaucgaaaauacgaccgcaaacauuagccugacagcuaucgccaaucaggcggcuauauugaugggccuggauaaagguuggccuaucuccaagauggacauuggggugccgcuccuggcccuuggcugcuauucacaagucaaccccuuaacucugaccgcagccgugcucauguuggucgcucauuacgcaaucauuggaccaggccugcaggccaaagcgacacgcgaggcucagaagcggaccgccgcagggaucaugaagaauccuacuguggauggaauaguugccauugaccuagaccccgugguauaugaugcuaaauucgaaaagcagcugggccaaaucaugcuccuuauccuguguacgucucagauuuugcugaugcgaacaaccugggcccucugcgagaguaucacucuggcaaccgguccauuaacaacucuuugggaagggucgccuggaaaauuuuggaacaccacaauagcugugagcauggccaauauuuucagaggcuccuaccuggcgggugccggccucgcauuuucucuaaugaagucacuggggggaggcaggcgcgggacgggagcucagggcgagaccuugggugagaaauggaagcggcagcugaaccaacucagcaagcccgaauucaauacuuauaaaagauccgggaucauggaggucgaccguagugaagccaaggagggacuuaaaaggggcgaaacaaccaagcacgcaguuucucgggguacugcuaaacugcgcugguucguggagcgaaacuuggucaagccggagggcaaggugauugaucugggguguggaagaggcggguggagcuacuauugcgccggacucaaaaagguaacagaagugaaaggcuacaccaagggugggccaggacaugaggaaccuauccccauggccacguacggcuggaauuuaguuaaacugcacucaggcaaggacguguuuuucaugccacccgagaaaugugauacccuucugugcgacauaggggaauccaguccuaacccgacaaucgaggagggaaggacucuacggguccucaagaugguggaacccuggcugcgcgguaaucaguuuuguauuaagaucuugaacccauauaugccuagcgucguggagacccuggaacagaugcagagaaaacacggcgggaugcucguuaggaauccccuuucucgaaacuccacacaugagauguacuggguaucaugcggaacuggcaauauugugagcgcggucaacaugaccucgcggaugcuguuaaaccguuucacaauggcucacagaaagccuaccuaugagcgcgauguggaccugggugcagggacuaggcauguuacgguggaaccagaggucgccaauuuggauaucauuggacaacggaucgaaaacauaaaaaaugagcacaagucuacauggcacuacgacgaagauaaccccuauaaaaccugggcuuaccauggcaguuaugaggugaagccuuccggcagcgccucauccaugguaaauggggugguuagacuccugacuaagccaugggacgucauucccauggugacccagaucgcaaugacagacacgaccccguuuggacagcaacgcguguucaaagagaaggucgauacuaggacaccucgagccaaacgggguaccacucagaucauggaaguuacagcuaaguggcuauggggcuuucuuucuagaaacaaaaagccaaggauuuguacccgcgaggaauucacacguaaggugcggagcaaugcggccauaggggcaguauuuguggacgagaaccaguggaauagugcuaaagaagccgucgaggaugagagauucugggaccuggugcacagggaacgcgagcuccauaagcagggaaaaugcgcaacuugcguuuacaacaugaugggcaagcgagaaaaaaagcugggugaguuugggaaggccaaaggaucccgggcuaucugguacaugugguugggcgccagauuccuggaauuugaggcgcucggcuucaugaaugaggaucacugguucagcagggaaaacucucuuucagggguggagggagaaggucugcauaaguuaggcuauauucugcgcgacaucaguaaaauucccgggggaaauauguacgcagaugacaccgccggcugggauacgagaaucaccgaggacgauuugcaaaacgaggcuaagauaacagacaucauggaaccugagcacgcccuccuggcaacuuccauuuuuaaacuaaccuaucagaauaaggucgugcggguacagaggccagcuaaaaacgguacaguuauggaugugaucagccgucgagaccagcgcgggucuggacaagucggcacuuacggccuuaacaccuucacgaauauggaagugcagcugauuagacagauggagucggaagggaucuuucuccccucagagcuggagacaccgaacuuggccgaacggguguuagacuggcuggagaagcacggagcugaaaggcucaagcgcauggccauaagcggugaugacugugucguuaaaccuauugaugacagauucgcaaccgcgcuuacugcccugaaugauaugggcaaggugcggaaagacaucccccagugggagccauccaagggguggaacgauuggcaacagguaccuuuuugcagucaucacuuccaucagcuaaucaugaaagacggaagggaaauugugguccccugucgaaaucaggaugagcuggugggccgugcuagaguuucucaaggugccggguggagccuccgcgagacagcaugcuugggaaaguccuaugcucagauguggcagcugauguacuuucaccggagggaccuuagacuggccgcaaacgccauauguucagcggugccagucgauugggugcccaccagucgcacuaccuggucuauccacgcucaucaccaauggaugacaacggaagacaugcucagcguauggaaucggguuuggauugaggaaaacccuuggauggaggacaagacccauguguccucaugggaagaggucccauauuuaggcaaaagggaggaucaguggugcggcagccugaucggguugacugcccgagcaacaugggccaccaauauucagguggcuaucaaccagguuagacggcugauaggaaaugaaaacuaccucgacuacaugacuucuaugaagagguucaaaaaugaguccgauccggaaggugcccuuugguga

SEQ ID NO: 13432 - RNA, 9879 nt, Artificial Sequence
  derived and/or modified CDS sequence (opt3) from DENV-1__KF973459__SS-prME
agcgugaccaugcugcucaugcuucugccaacagcauuggcuuuccacuuaacuacgcgaggaggggaaccucauaugaucgucuccaagcaggaaaggggaaaaucucugcuauuuaagaccucagccgguguuaacaugugcacacucauugccauggaccugggcgaacuuugugaagauacucugaccuacaaaugcccacagauaacagaggcggaaccggacgauguggacuguuggugcaaugcuaccgauacuuggguaacauaugggaccuguagucagacgggagagcaccggcgcgacaagcgaagcguggccuuggcaccccaugucggccucggucuggagacucguaccgaaacauggauguccucugagggggccuggaaacagauccagagaguggaaacuugggcucugaggcacccuggauucaccguuauugcacucuuuuuagcccaugcuaucggcacaucgauuacccaaaagggcaucauauucauccugcuuauguuggugacgccaucaauggccaugcggugcgucgggauuggaaaccgcgauuuuguggagggucugagcggcgcgacuuggguagacguugugcuagagcacgggaguugugucacaaccauggcaaagaauaaacccacucucgauaucgaacugcuuaagacagaggugaccaacccugccauucugagaaaauugugcaucgaagcuaagauauccaauacgaccacagacucuagguguccaacucagggagaggccacccucguggaagaacaggaugcaaacuucgucugccggcgcacauuuguugaccgaggcugggguaauggguguggacuguucggcaaaggcagcuuacugacuugcgcuaaguuuaagugcgugaccaaacucgaggggaagauuguacaguacgaaaaccuuaaauauuccgugaucgucacagugcacaccggagaucaacaucagguugguaaugagacuacggaacacggcacaauugccaccaucacuccccaggcgccuaccucagagauccagcugacagacuacggggccuugacccuagacuguaguccaagaacuggacuggauuucaacgaaauggugcuccugacaaugaaggagaaaagcuggcuuguccauaagcaaugguuucuggacuugccgcuccccuggacgucuggcgcauccaccucacaggagacuuggaauaggcaggaucuguuagugacauucaaaaccgcucacgccaagaagcaagaaguaguugugcuggguagccaggagggggcuaugcacacagcccuaacuggcgcaaccgaaauucagacgaguggaaccacaacuauauuugccggccaucucaaaugccggcugaagauggacaaacuuaccuugaaggggacaucuuaugucauguguacuggauccuucaaacuggagaaggaaguggcugagacccagcacgguacgguccucgugcaaguuaaguacgagggcacagaugcgccuugcaaaaucccauucagcacccaggacgaaaagggggugacucagaacggacgucugauuacagcaaaucccaucguaaccgauaaagagaagccugucaacauagaaacugagccacccuuuggcgagucguauauugugguuggugccggggaaaaagcucuuaagcugucuugguucaagaaaggcuccucaaucggaaagauguuugaggccaccgcacgcggcgccagaaggauggcuaucuugggggacacagccugggauuucggaaguauugguggcguguuuacgagcgucgggaaacucgugcaucagguauucggaaccgcauacggcgugcuguuuuccgguguuucuuggacuaugaagaucgggauuggcauauuacugacauggcuaggacucaauagccggucaaccagucuguccaugacauguaucgcggucggcauggugacucuuuacuugggggugaugguccaagcugacagcggaugcguuauuaacuggaaaggccgagaacugaagugugguucugggaucuucgugaccaacgaggugcacacguggacagaacaguauaaguuucaggccgauucaccgaaacgccucagugcagccaucggaaaggcuugggaggagggcguaugcgguauuagaagcgccaccaggcuggaaaauauaauguggaaacagaucuccaacgaguuaaaucauauucugcuugaaaacgacaugaaguucacugucgugguuggcgacgcaaaugggaucuuggcucaaggcaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauauggcucaagcugagagacagcuacacgcaagucugcgaucacaggcuaauguccgcugcaauuaaagacucaaaggccgugcaugcugauaugggguauuggaucgaaagugagaaaaacgaaaccuggaagcuggcccgugcaucuuucauugagguuaagacuuguacauggccaaaaagccacacccucugguccaauggagugcuggaaucagagaugaucauacccaagaucuacggcgguccuauuagccagcauaacuaucggccaggcuacuucacucagacagcggggccguggcaccuuggaaaauuggagcuggacuuugauuuaugcgaaggcaccacgguagucguggacgagcacugcgggaaucgaggacccucucucagaacuaccacagugaccggcaagaucauucaugaaugguguugcagguccuguacucugccuccacuucgcuuccggggugaggaugggugcugguacggaauggagaucagacccgucaaagaaaaggaggaaaaccugguuaggaguauggugagcgccggcucuggugagguagacuccuugucacucggcauacugugugcuaguauuaugaucgaagaggugaugcgcagccgauggucgcggaagaugcuaaugacagggacccuggccgucuuucuccugcuuaucaugggacaauugacauggaaugaccugauucguuuaugcaucauggugggcgcaaacgcuuccgauagaauggggaugggaacuaccuaucucgcccugauggcaacguucaaaaugaggccuauguuugccguuggccuucuguuccgccggcuaacaucuagagaggugcuccuguugaccauuggucugagcuuagucgcuucaguggaacucccaaacagucuggaggaacuuggggacggacuggcgaugggcauaaugauguugaagcuccugacugaguuucagccccaccagcuauggaccacacugcuuucccucacuuucaucaaaaccacgcugucuuuggauuacgccuggaagacaaccgcaauggcucugagcauuaucuccuuauuuccgcucugucugucaacuacaagccagaaaaccacuuggcuuccuguucuguugggcaguuucgggugcaagccacucacaauguuucugauuaccgaaaauaagaucuggggaaggaaaucuuggccccuaaacgaggguauaauggccaucggcauuguguccauccugcuuagcucgcuccugaagaaugacgucccuuuggccgggcccuuaauugcuggaggcaugcugaucgcauguuauguaauaucagguucuagugccgaucucucccuggagaaagcggcugaagugagcugggagcaagaagccgagcauucugggacgagccacaacauucuuguugaagugcaggacgauggaacuaugaagaucaaagacgaggagcgagaugacacccugacaaucuugcuaaaggcaacccugcucgccgucuccggcguguacccaaugucaauuccugcuacacuguucguaugguauuuuuggcagaaaaagaagcagcgcaguggcgugcuuugggauacucccagcccaccggaagucgagcgggcaguuuuagacgaugggauauacagaauccugcaaaggggacucuugggucguucucaggugggcgugggggucuuccaggacggaguguuccauaccauguggcacguuacgcgcggcgccguacugauguaucaggguaaacggcucgaaccuuccugggcgucagugaagaaagaccugauuaguuacgggggaggcuggagauuucaaggcagcuggaauacaggggaggagguccaggugaucgcuguugaacccggaaagaaccccaaaaaugugcagacuacccccgguacauucaagaccccugagggcgaagucggggccauugcacuugauuuuaagccaggaacuuccggcucucccaucgugaacagggaggguaaaauaguagggcuguacggaaauggcgucgugaccacaucgggcacguauguuagcgccaucgcucaagccaaggugucacaggaagggccuuugccggagauugaggacgaagucuucaaaaagcgaaaccuaacuaucauggaucugcacccaggauccgguaaaacccggcgcuaccuccccgcaauugugagagaggcuaucaagaggaaguuacggacacugauacuugccccuacccgaguuguggcgagugaaauggccgaggcacugaaaggcaugccaauuagauaucagacuacagcugucaagucugaacauaccgggcgcgagaucguggaccucaugugccacgccacguuuacuaugagguugcugagccccguacgugugccuaauuacaacaugaucauuauggaugaggcucauuucacagacccggcauccaucgccgcccggggauauauaucaaccagaguuggcaugggugaagcugcggcaauuuuuaugaccgccacucccccagggucugucgaggcuuucccucagagcaaugccgugauccaagaugaagagagggacauucccgaacgcaguuggaacuccggauacgauuggaucacagacuuuccaggcaaaaccgugugguucgucccuagcauaaagucuggcaaugauauugcaaacugucuccggaaaaacgggaagagaguaauccagcugucaagaaagacauuugacacugaguaucagaaaacgaagaauaacgacugggauuacgugguuaccacagacaucuccgagaugggagccaauuucagggcugaucgcgugauugacccccguagaugccuuaaaccagucauccuaaaggaugguccggaacgggugauucuggcgggcccuaugcccguuacuguggccagugcagcucagaggcgcgggcgaauaggaagaaaccaaaauaaagagggcgaccaguacgucuauaugggucagccauugaacaaugaugaagaccacgcccauuggaccgaggcaaagauguuacuggauaacaucaauacacccgaggggauuaucccugcccucuucgaaccagagcgggaaaagagcgcugccaucgacggcgaguacaggcugcgcggagaagcgagaaaaaccuuuguggagcuuaugaggcggggcgaucugcccguauggcucucguauaagguggcaucugagggguuccaguacuccgaccgucgcuggugcuuugauggagaacgaaacaaucaaguuuuggaggaaaacauggacgucgagauuuggacuaaagaaggugagagaaagaaacugaggccucgguggcuagacgcccgcacguauagcgauccgcuggcucucagagaguucaaggaauuugccgcuggcaggcggucagugaguggggaccuuauacuggagaucggaaaauuaccacagcacuugacccugcgagcacagaaugcccucgauaaccuggugaugcuucacaauucugaacagggcgguaaggcuuacagacaugccauggaggaacugcccgacacaauugagacucucauguugcuggcauuaaucgcgguccuaaccgggggcguuacacuguucuuucucuccggaaagggccuugggaaaaccagcauuggacuguugugugugacugccucaagugcucugcucuggauggccagcguagagccucacuggaucgcagcuuccauaauccuggaguucuuucuuauggugcuccugauucccgagccagaucgccaaaggacaccucaggacaaccaguuggccuaugucgugaucggucuguuauucaugauucuaacgguugcagccaacgaaaugggccugcucgagaccacuaagaaagaucuugggaucggacauguggcugcggagaaucaccaacacgccacaaugcuggacgucgauuugcggcccgcaucugcuuggacccuguacgccguagccaccacagugauaacuccaaugaugcgucauacgauugaaaacaccacagcaaauaucagccucacugcuauugccaaccaggcggcuauccugaugggccuugacaaggguuggccuauauccaaaauggauaucgggguuccguuacuggcccucggcugcuacucacaggugaaucccuugacccugacagcagccguccuaaugcugguggcucacuaugcaauuaucggaccaggccuccaggccaaggcgaccagagaggcucaaaagaggacugccgcagggauuaugaaaaacccuacggucgacggaaucguggccauagaucuugaccccguuguguacgacacaaaguuugaaaaacagcugggccagauuauguugcugauccucuguaccucucagauccuguuaaugcgcacuaccugggcucuuugcgagaguauuacacuggccacugguccacucaccacacuaugggaagggucgccuggaaaguucuggaauacgaccaucgcaguaagcauggcuaacauauuucggggcuccuaucuggccggugcgggcuuggccuucucucugaugaaaucacucgggggaggccgaagagggacuggagcacaaggcgagacacuuggugagaaguggaagaggcagcugaaucaguugagcaaauccgaguucaacauuuacaagcgcagugggaucauggagguggaucggucugaagcuaaagagggacugaagagaggcgaaaccacuaaacaugccgucagccgugguacagcaaagcucaggugguuuguugagcggaauuuagugaagcccgagggcaaagucauugaccugggguguggacgcggcggguggucauauuacugcgcuggacuuaagaaagugaccgaaguaaagggcuauacgaaaggugggccgggacacgaggaaccaaucccuauggccaccuacggcuggaaccuggugaagcuacauuccggcaaagauguuuucuuuaugcccccagagaagugugacacacuccugugcgauauaggggaaaguagccccaauccuacuaucgaggagggacgaaccuugagagugcugaagauggucgaaccguggcucagggguaaccaguucuguauuaaaauccuuaaucccuacaugccaucuguggucgagacacuggaacaaaugcagcggaaguauggcgggauguuagugcgcaacccucuguccagaaauucaacucacgagauguacuggguuagcugcggaaccggcaacauuguaucggccgugaacaugacaucuaggauguugcucaaucgauuuaccauggcgcaccggaaacccacuuaugagcgugacgucgaucugggugcugggacgagacauguggcaguugaaccugagguggccaaccuagacaucauuggacagcgcaucgaaaauauaaagaacgagcacaaaaguacauggcauuacgaugaagacaauccauauaagaccugggcuuaccacggcuccuaugaggucaagcccagcggcucagccuccucuauggugaacgggguagugaggcuucugacuaaaccuugggauguuauuccaauggucacccaaaucgcaaugacagacacgacccccuucggacagcagcggguguuuaaggagaaaguggacacuagaacaccgcgcgccaagagggguaccacucagaucauggaagucacagcuaaauggcucuggggcuuccugagccgaaauaagaagccucggauuuguaccagagaggaauuuacaaggaaaguucgcaguaacgcggccauaggggcaguguucguagaugagaaucaauggaacuccgcuaaggaagccguggaggacgagcguuuuugggauuugguccaccgggaaagagagcugcauaaacagggaaagugcgcaacuugcguguacaauaugaugggcaaaagggaaaagaagcucggugaguucgggaaagccaagggaagccgcgcuaucugguacauguggcuuggcgcccgauuucuggaguucgaggcguuaggcuucaugaacgaggaccacugguuuucucgggaaaauucacugagugggguugagggagaagguuugcauaaacucggcuauauucugagagauaucuccaagauuccagggggaaacauguacgcagacgauaccgccggcugggacacgaggaucaccgaggaugaccuacagaaugaggcuaaaauaacagauaucauggaacccgagcacgcccuucuggcaacuagcauuuucaagcucaccuaucagaacaaagugguccgcgugcaaagaccugcuaagaacgguacaguaauggacguuaucucucggagggaucagcgugggucgggacaggugggcacuuacggccugaauaccuuuacgaacauggaaguccaguugauucgacaaauggagucagaagggaucuucuuaccaagcgagcuggagacacccaaucucgccaagcgcgugcuugacuggcuggaaaaacauggagcugagagacuaaagcggauggccauauccggugacgauuguguggucaaaccgauugacgauagguuugcaaccgcgcugacugcccucaacgacaugggcaagguucgcaaagauaucccucagugggaacccaguaagggguggaaugacuggcaacaggugccauucugcucucaccacuuucaucaauugaucaugaaggauggaagagagauuguagugccuugucggaaccaggacgaacuggucggcagggcucgagugagccagggugccggguggucccuucgugagacagcaugccugggaaaaucauaugcucaaauguggcagcucauguacuuccacagacgcgauuuacggcuggccgcaaaugccauauguagugcgguucccguggacugggucccaaccucuaggacuaccuggagcauccaugcucaccaccaguggaugacaacggaggauauguuguccguguggaacagaguauggauugaagagaaucccuggauggaagacaagacccauguuucaagcugggaggaagugccuuaucugggcaaacgcgaggaccaguggugcggcucucucaucgggcuuacugcccgggcaacaugggccaccaacauucaagucgcuaucaaucaggugaggcgacugauaggaaacgagaauuaccuagauuacaugacuuccaugaagagauuuaaaaacgaaagugacccagagggugcccugugguga

SEQ ID NO: 13433 - RNA, 9879 nt, Artificial Sequence
  derived and/or modified CDS sequence (opt3) from DENV-1__KF973460__SS-prME
agcgugaccaugcugcucaugcuucugcccaccgccuuggcuuuccacuuaacuacgagaggaggggaaccucauaugauagucuccaagcacgaaagaggaaaaucucuguuauuuaagaccucaacagguguuaacaugugcacucucauugcaauggaccugggcgaacuuugugaagauaccaugacauacaaaugcccacggauaaccgaggccgaaccggacgauguggacuguuggugcaaugcgacugauacauggguaaccuaugggacguguagucaaacuggagagcaucgccgagacaagcguagcguggcucuggccccacacgucggcuugggucucgagaccagaacagaaacuuggauguccucugagggggcauggaaacaaauccaaaggguggaaaccugggcccugcggcauccuggauucacaguuauugcucuguuucucgcacacgccaucggcaccucgauuacgcagaagggcaucauauucaucuuacugaugcuugugacuccaucaauggcuaugcgcugcgucgggauuggaaacagagauuuuguggaggguuugagcggcgccacauggguagacguugugcuggagcacgggaguugugucaccacuauggcgaagaauaaacccacauuggauaucgaacuccugaagaccgaggugacgaacccugcagugcuuaggaaacugugcauugaagccaagaucuccaauaccacaacugacucucgguguccaacccagggagaggcuacauuggucgaagaacaagaugccaacuucguuugccgccgaacucucguggacagaggcugggguaauggguguggacuguuuggcaaaggcagcuuacugaccugcgcaaaguucaagugcguaacaaaacucgaggggaagauagugcaguacgaaaaccuuaaauauuccgucauugugaccguucauacuggagaucagcaccagguggguaaugagacgacagaacauggcaccaucgcuacuauuacaccccaagccccuacaucagagauccagcugaccgacuacggggcguuggcccuagacuguaguccaaggacuggacuggauuuuaacgaaaugguccuccugacaaugaaggagaaaagcuggcuugugcacaagcagugguuccuggacuugccgcuccccuggacgucuggcgcauccaccucacaggagacuuggaaucggcaagaucuguuaguaacauuuaaaaccgcucacgccaagaagcaggaaguugugguccuggguagccaggagggggcuaugcauacagcccuaacuggcgcaaccgaaauccaaacgaguggaaccacaacuauuuucgccggccaccucaaaugccgucugaagauggacaaacuuaccuugaaggggacaucuuaugugauguguacuggauccuuuaaacuggagaaggaagucgcugagacccagcaugguacggugcucguucaggugaaguacgagggcacagaugcgccuugcaaaauaccauucagcacccaggacgaaaaggggguaacucaaaacggacgccugaucacagcaaaucccauugucaccgauaaagagaagccugugaacaucgaaacugagccacccuucggcgagucguauauaguugugggugccggggaaaaagcucuuaagcugucuugguuuaagaaaggcuccucaauuggaaagauguucgaggccaccgcaagaggcgccaggcggauggcuaucuugggggacacagccugggauuuuggaaguaucgguggcgucuucacgagcguggggaaacucguacaccagguguuuggaaccgcauacggcguucuguucuccggugucucuuggacuaugaagauugggaucggcauuuuacugacauggcuaggacucaauagccgaucaaccagucuguccaugacauguauagcggugggcauggugacucuuuacuugggggucaugguucaggcugacagcggaugcgugaucaacuggaaaggccgcgaacugaagugugguucugggauuuuugugaccaacgagguacauacguggacagaacaguauaaguuccaagccgauucaccgaaaagacucagugcagccaucggaaaggcuugggaggagggcgucugcgguaucaggagcgccacccggcuggaaaauauuauguggaaacagauauccaacgaguuaaaucacauccugcuugaaaacgacaugaaguuuacugugguugugggcgacgcaaaugggauuuuggcucagggcaaaaagaugauccgcccucagcccauggagcacaaauacucuuggaagucguggggcaaggccaaaauuaucggggcggauauacaaaacaccacauucaucauugacggaccagauacuccugaaugucccgacgaucagagagccuggaauaucugggaggucgaggacuauggcuuugguauuuucaccacaaacaucuggcucaagcugagggauagcuacacgcagaugugcgaccaucgucuaauguccgcugcaauaaaagauucaaaggccgugcacgcugacaugggguauuggauugaaagugagaaaaaugaaaccuggaagcuggcccgggcaucuuuuaucgagguuaagacuuguacauggccaaaaagccauacccucugguccaacggagugcuggaaucagagaugauuauccccaagauauacggcgguccuaucagccagcacaauuaucgaccaggcuacuucacucaaacagcggggccguggcaccuuggaaaauuggagcuggauuucgacuuaugcgaaggcaccacgguagucguggaugagcauugcgggaacagaggacccucucucaggacuaccacagugaccggcaagauuauccacgaaugguguugccgcuccuguacucugccuccacuucgguuuagaggugaggacgggugcugguacggaauggagauuaggcccgucaaagaaaaggaggaaaaucugguucgcaguauggugagcgccggcucuggugagguagacuccuugucacucggcauccugugugugaguauaaugauugaagaggucaugcgaagccgguggucgcguaagaugcuaaugacagggacccuggcuguguuccuccugcuuaucaugggacaguugacauggaacgaucugaucagauuaugcauuaugguuggcgccaaugcauccgacaggauggggaugggaacuaccuaucucgcucugauggccacguuuaaacuucgcccuauguucgcagugggcauccuguuucggagacuaacaucuagggagguccuccuguugaccauuggucugagcuuaguggccucaguugaacucccaaacagucuggaggaacuuggggauggacuggcuaugggcauaaugauguugaagcuccugacugaguuccagccccaucaacuauggaccacacugcuuucccucacuuuuaucaaaaccacgcugucuuuggacuacgcguggaagacaaccgccauggcacugagcauuguguccuuauucccgcucugucugucaacuacaagccagaaaaccacuuggcuuccuguccuguugggcaguuuugggugcaagccacucacaauguauuucaucaccgaaaacaagauuuggggacgaaaaucuuggcccaucaaugaggguauaauggcuaucggcauuguauccauccugcuaagcucgcugcuuaagaacgaugugccucucgccgggccccugauugccggaggcauguugaucgcuuguuacguuauaucagguucuagugcagacuuaucccuggagaaagccgcggaagugagcugggagcaggaagcugagcacucugggacgagccauaauauucucgucgaagugcaggaugacggaacuaugcgcaucaaggaugaggagaaagacgauacccugacaauccuucugaaggccaccuugcuagcaguauccggcguguauccaaugucaauuccugccacacuguuugucugguacuucuggcagaaaaagaagcagcggaguggcguucucugggacacucccagcccaccggaaguggagagagcugugcuggaugacgggauauauaggauccuucagcguggauuacugggucgcucucaggucggcguggggguuuuucaagacggaguauuccacaccauguggcacgugacgcggggcgcaguccucauguaccaggguaaaagauuggaaccuuccugggccucagugaagaaagaucugauuaguuacgggggaggcuggagguuccagggcagcuggaacacaggggaggagguucaggugaucgcggucgaacccggaaagaaucccaaaaaugugcaaacuacccccgguacauuuaagaccccugagggcgaaguaggggcuauugcccucgacuucaagccaggaacuuccggcucucccaucgucaaucgagaggguaaaauaguggggcuguauggaaacggcguugugaccacaucgggcacguacgucagcgcaaucgcccaggcuaaggccucacaggaagggccucuuccggagauugaggaugaaguguuuaaaaagcggaaucugacuaucauggacuugcauccaggauccgguaaaacccgcagauaucuacccgcaauuguuagggaggcuaucaagcggaagcugcgaacacucauauuagccccuaccagaguggucgcgagugaaauggccgaggcacugaaaggcaugccaauucgcuaccaaacuacagcugugaagucugaacacaccgggagggagaucguagaucuuaugugccaugccacguucacuaugcgucugcucagccccgugcggguuccuaacuauaauaugaucauuauggacgaggcucacuuuacagauccggcauccaucgccgccagaggauacauaucaaccagggucggcaugggugaagcugcggcaauuuucaugaccgccacucccccagggucuguggaggcuuuuccucagagcaacgccgugauccaggacgaagaacgcgauauucccgaacgaaguuggaacuccggauaugacuggaucacagauuucccaggcaaaaccgucugguuuguaccuagcauaaagucuggcaacgacauugcaaauuguuugaggaaaaacgggaagcgggugauccagcugucaaggaagacauucgacacugaguaccagaaaacgaagaacaaugauugggacuacguugugaccacagauaucuccgagaugggagccaacuuucgcgcugaccgugucauugaucccagacggugccucaaaccagugauccugaaggacgguccggaaaggguuauucuugcgggcccuaugcccgugacugucgccagugcagcucagcgccgagggagaauaggacggaaucagaacaaagagggcgaucaguauguguacaugggucaaccacuaaauaacgacgaagaucaugcccacuggaccgaggcaaagaugcuguuggacaauaucaacacacccgaggggauuaucccugccuuauucgaaccagagagggaaaagagcgcugccaucgauggcgaguaucgccugagaggagaagcgaggaaaaccuucguagagcucaugcggcguggcgaccugcccguguggcuuucguacaagguugcaucugagggguuucaguauuccgaucgccgauggugcuucgacggagaaagaaauaaccagguccuggaggaaaauauggacguggagauuuggacuaaagaaggugagaggaagaaacuccggccucgcugguuggaugccagaacguacagcgacccgcuggcucuaagggaguuuaaggaguucgccgcuggccggcgaucagugaguggggaucugauacucgagaucggaaaacuuccacagcaccugaccuuaagagcacaaaacgccuuggacaaucuggucaugcuccauaacucugaacagggcgguaaggcuuaucgccacgccauggaggaacugcccgauacaauugagacucuuaugcugcucgcauugaucgcgguucugaccgggggcgugacauuauuuuuccuauccggaaagggccuggggaaaaccagcauuggacuccuuuguguaacugccucaagugcucuguuguggauggccagcguggagccucauuggaucgcagcuuccauaauccuggaauuuuuccucaugguccugcuuauucccgagccagacaggcagcggacaccucaggauaaucaacucgccuacgugguuaucggucuguuguuuaugauucugacgguggcagccaacgaaaugggcuuacuagagaccacuaagcgugaccuggggaucggacacgucgcugcggagaaccaccagcaugccacaaugcucgauguagaccuuagacccgcaucugcuuggacccuguacgccguggccaccacaguuauaacuccaaugaugaggcacacgauugaaaauaccacagcaaacaucagcuugacugcuauugccaaucaggcggcuauccugaugggccucgauaaagguuggccuauauccaagauggacaucggggugccgcugcuugccuuaggcugcuauucacaagucaacccccugacccucacagcagccguguugaugcuggucgcucauuacgcaauuaucggaccaggccuacaggccaaagcgacccgcgaggcucagaagcggacugccgcagggauuaugaagaauccuacgguggauggaaucguugccauagaccuggaccccgugguauaugaugcuaaauucgaaaagcagcucggccaaauuaugcuucugaucuuguguaucucucagauucugcucaugcgaacaaccugggcccugugcgagaguaucacuuuagcaaccgguccacuuacaacucugugggaagggucgccuggaaaauuuuggaacaccacaauagcugugagcauggccaauauuuucagaggcuccuaccucgcgggugccggccuagcauuuucucugaugaagucacuagggggaggcaggcgcgggacgggagcucagggcgagacccugggugagaaauggaagcggcagcucaaccaacuuagcaagcccgaguucaauacuuauaaaagauccgggaucauggaggucgaccguagugaagccaaggagggacugaaaaggggcgaaacaaccaagcacgcaguuucucgggguacugcuaaauugcgcugguucguggagcgaaaccuggucaagccggagggcaaggugauugaucucggguguggaagaggcggguggagcuacuauugcgccggacugaaaaagguaacagaagugaaaggcuacaccaagggugggccaggacaugaggaaccuauccccauggccacguacggcuggaaucuaguuaaacuucacucaggcaaggacguguuuuucaugccacccgagaaaugugauacccugcuaugcgacauaggggaauccaguccuaacccgacaaucgaggagggaaggacucuccggguccugaagaugguggaacccugguugcgcgguaaucaguuuuguauuaagauccugaacccauauaugccuagcgucguggagacccucgaacagaugcagagaaaacacggcgggaugcuuguuaggaauccccugucucgaaacuccacacaugagauguacuggguaucaugcggaacuggcaauauugugagcgcggucaacaugaccucgcggauguuacugaaccguuucacaauggcucacagaaagccuaccuaugagcgcgauguggacuugggugcagggacuaggcauguugccguggaaccagaggucgcuaaucucgauaucauuggacaacggaucgaaaacaucaaaaaugagcacaagucuacguggcacuacgacgaagauaaccccuauaaaacaugggccuaccauggcaguuaugaggugaagccuuccggcagcgcaucauccaugguaaauggggugguuagacugcuaaccaagccaugggacgucauucccauggugacucagaucgccaugaccgacacaacgccguuuggacagcaacgcguguucaaagagaaggucgauaccaggacuccucgagcuaaacgggguacaacccagaucauggaaguuacugcgaaguggcuuuggggcuuucugucuagaaacaaaaagccaaggauuuguacacgcgaggaguucacccguaaggugcggagcaaugccgcaauaggggcuguauuuguggacgagaaccaguggaauagugccaaagaagcagucgaggaugagagauucugggaccucgugcacagggaacgcgagcugcauaagcagggaaaaugcgccacaugcguuuacaacaugaugggcaagcgagagaaaaaguugggugaguuugggaaggcuaaaggaucccgggccaucugguacauguggcugggcgcgagauuccucgaauuugaggcacuuggcuucaugaaugaggaucacugguucagcagggaaaacucucugucagggguggagggagaagguuuacauaagcugggcuauauuuugcgcgacaucaguaaaauucccgggggaaauauguacgccgaugacacugcuggcugggauaccagaaucacggaggacgaucuccaaaacgaggccaagauaaccgacaucauggaaccugagcacgcacugcuagcuacauccauuuuuaaacuuacuuaucagaauaaggucgugcggguacagaggccagccaaaaacgguaccguuauggaugugaucagccgucgagaccagcgcgggucuggacaagucggcacauacggccugaacacuuucaccaauauggaagugcagcucauuagacagauggagucggaagggaucuuucugcccucagaguuggagacgccgaacuuagcugaacgggugcuggacuggcucgagaagcacggagccgaaaggcuuaagcgcauggcaauaagcggugaugacugugucguuaaaccuauugaugacagauucgcgacagcccugaccgcucuaaaugauaugggcaaggugcggaaagacaucccccagugggagccauccaagggguggaacgauuggcaacagguaccuuuuugcagucaucacuuccaucagcugaucaugaaagacggaagggaaauugugguccccugucgaaaucaggaugagcucgugggccgugccagaguuucucaaggugcaggguggagcuugcgcgagacugcuugccugggaaaguccuaugcccagauguggcagcuuauguacuuucaccggagggaccugagacucgcagccaacgcgauauguucagcugugccagucgauugggugcccacaagucgcaccacuuggucuauccacgcccaucaccaauggaugaccacagaagacauguuaagcguauggaaucggguuuggauugaggaaaacccuuggauggaggacaagacgcauguguccucaugggaagaggucccauaucugggcaaaagggaggaucaguggugcggcagcuugaucgggcugaccgcacgagccacuugggcuacaaauauucagguggccaucaaccagguuagacggcucauaggaaaugaaucuuaccuugacuacaugaccuccaugaagagguucaaaaacgagagugauccggaaggugcacugugguga

SEQ ID NO: 13434 - RNA, 9879 nt, Artificial Sequence
  derived and/or modified CDS sequence (opt3) from DENV-1__KF973461__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauggguggcguguuuacgagcgucgggaaauuggugcaucagguauucggaaccgcauacggcgugcucuuuuccgguguuucuuggacuaugaagauugggaucggcauucuguuaacauggcugggacuaaauagccggucaaccagucucuccaugacauguauagcggucggcauggugacucuguaccuuggggugaugguccaagcugacagcggaugcguuaucaacuggaaaggccgagaauugaagugugguucugggauuuucgugaccaacgaggugcacacguggacagaacaguauaaguuucaggccgauucaccgaaacgccugagugcagccaucggaaaggcuugggaggagggcguaugcgguaucagaagcgccaccaggcucgaaaauauuauguggaaacagauauccaacgagcugaaucauaucuuacuggaaaacgacaugaaguucacugucgugguuggcgacgcaaaugggauucuugcucaaggaaaaaagaugauccggccucagcccauggagcacaaauacucuuggaagucguggggcaaggccaaaauuaucggggcggauauacagaacaccacauuuaucauugacggaccagauacuccugaaugucccgacaaucagcgcgccuggaacaucugggagguggaggauuauggcuucgguauuuuuaccacaaauaucugguugaagcucagagacagcuacacgcaaaugugcgaucacaggcugauguccgcugcaauaaaagacucaaaggccguccaugcugauaugggguauuggauugaaagugagaaaaacgaaaccuggaagcuagcccgugcaucuuucaucgaggugaagacuuguacauggccaaaaagccacacccugugguccaauggaguucucgaaucagagaugauuauccccaagauauacggcgguccuaucagccagcauaacuaucggccaggcuacuucacucagacagcggggccguggcaccugggaaaacuugaguuggacuuugaacugugcgagggcaccacggugguagucgaugaacacugcgggaaucgaggacccucuuuaagaacuaccacagugaccggcaagauuauccaugagugguguugcagguccuguacucucccuccacugcgcuuccggggugaggacgggugcugguacggaauggaaauuagacccgugaaagagaaggaagagaaccuugucaggaguaugguuagcgccggcucuggugaaguggauuccuuuucacugggcaucuugugugcuaguauaaugauugaggagguaaugcgcagccgauggucgcggaagaugcucaugacagggacccuggccguguuccuacugcucaucaugggacaacugacauggaaugaccuuauccguuugugcauuauggucggcgcaaacgcuuccgacagaauggggaugggaacuaccuaucuggccuuaauggcaacguuuaaaaugaggccuauguucgccgugggccuccuguuucgccggcuuacaucuagagaaguucugcuacucaccaucggucugagcuugguggcuucagucgagcugccaaacaguuuagaagagcucggggauggacuggcgaugggcauuaugaugcuuaagcuguugacugaauuccagccccaccagcucuggaccacacugcuaucccugacuuuuauaaaaaccacgcuuucucucgacuacgccuggaagaucacagcaauggcucugagcauuaucuccuuguucccgcuguguuuaucaaccacuagccagaaaacaaccuggcucccugugcugcuuggcaguuuugggugcaagccacugacuauguucuugauuacagagaauaagaucuggggaaggaaaucuuggccccucaacgaggguauaauggccaucggcauuguuuccauccugcuaagcucgcugcuuaagaaugaugugccucucgccgggccccugauugcuggaggcauguugaucgcauguuaugucauaucagguucuagugccgacuuaucccuggaaaaagcggcugagguaagcugggaacaagaggccgaacauucugggaccagccacaacauucucguggagguucaggaugacggaacgaugaagaucaaagaugaggaacgagacgauacucugaccauccuucugaaggcaacauugcuagccguguccggcgucuacccaaugucaauuccugcuacccuguuugugugguauuucuggcagaaaaagaagcagcgcaguggcguacucugggacacacccagcccaccggagguggaacgggcaguccuggaugacgggauauacagaauccuucaaaggggauuacugggucguucucagguuggcguggggguguuccaggauggagucuuucauacuauguggcacgugacccgcggcgccguucucauguaucaggguaaacgguuggagccuuccugggcgucaguaaagaaagaccugauuaguuacgggggaggcuggagauuccaaggcagcuggaauacgggggaggaagugcaggucaucgcuguggagcccggaaagaacccaaaaaauguucagacaacucccgguaccuuuaagacaccugaaggcgaggugggggccauugcacucgacuucaagccaggaaccuccggcucucccaucgucaacagggaagguaaaauaguggggcuguacggaaauggcguagucacuaccucgggcacauaugugagcgccaucgcucaagccaaggcaucacaggaggggccucuuccggagauugaagaugagguuuuuaaaaagcgaaaccugacgaucauggacuugcacccaggauccgguaaaacucggcgcuaccuacccgcuauugugagagaagccaucaagaggaagcugcggacccucauauuagcgccuacacgagucguggccagugagauggcagaagcucugaaaggcaugccaauuagauaucagaccacugccguuaagucugagcauacagggcgcgagaucguggaucuuaugugccacgcuaccuucacgaugaggcugcucagccccguccgugugccuaauuacaacaugaucauuauggacgaagcacauuuuacugauccggccuccaucgccgcucggggauauauaucaacaagaguaggcaugggugaggcggcagccauuuucaugaccgcuacccccccagggucuguggaagccuuuccucagagcaaugcaguuauccaagacgaggaaagggauauucccgagcgcaguuggaacuccggauacgacuggaucacugauuucccaggcaaaacagucugguuugugccuagcauaaagucuggcaaugacauugccaacuguuugcgaaaaaacgggaagagagugauccagcugucacggaagaccuucgauacagaguaucagaaaacuaagaauaacgacugggacuacgucguaacgaccgauaucuccgaaaugggagcuaauuucagggcggaccgcgugauugauccccguagaugccucaaaccaguuauccugaaggacgguccggagcgggugauucuugccggcccuaugcccgucacaguggcaagugcugcccagaggcgcgggcgaauaggaagaaaccaaaauaaagaaggcgaucaguacguuuauaugggucagccacuaaacaaugacgaggaucacgcacauuggacugaggccaagaugcuguuggacaacaucaauacccccgaagggauuaucccugcuuuauuugagccagaacgggagaagagcgccgcgaucgauggcgaauacaggcugcgcggagaggcaagaaaaacauucguggagcucaugaggcggggcgaccugcccgucuggcuuucguauaagguggccucugaaggguuucaguacuccgaucgucgcuggugcuucgacggagagcgaaacaaucaaguacuggaagagaacauggauguggaaauuuggaccaaagagggugagagaaagaaacucaggccucggugguuggacgcucgcacuuauagcgacccgcuggcccuaagagaauuuaaggaguucgcugcaggcaggcggucaguuaguggggaucugauacucgaaaucggaaaacuuccacagcaccugacguuacgagcccagaaugcuuuggacaaccuggucaugcuccacaauucugagcagggcgguaaggccuacagacaugcaauggaagagcugcccgauaccauugagacacuuaugcugcucgcguugaucgccgugcugacugggggcgugaccuuauuuuuccuauccggaaagggccuggggaaaacaagcauuggacuccuuugugucaccgcuucaagugcccuguuguggauggcaagcguugaaccucacuggaucgcugccuccauaauccuggaguuuuuccucauggugcugcuuauucccgaaccagaccgccaaaggacuccucaggauaaccagcucgcauauguagugaucggucuguuguuuaugauucugacagucgccgcuaacgagaugggcuuacuagagacgaccaagaaagaccuggggaucggacauguggcggccgaaaaucaccaacacgcaacuaugcucgauguugaccuucggcccgcuucugccuggacacuguacgccguggcaaccaccgucauaacaccaaugaugcgucauacuauugagaacacgaccgcuaauaucagcuugacagccauugcgaaccaggcugccauccugaugggccucgauaaggguuggccuauauccaaaauggacaucgggguaccgcugcuugcauuaggcugcuacucacaggugaauccccugacucucaccgccgcuguuuugaugcugguggcacacuaugccauuaucggaccaggccuacaggcgaaggcuacaagagaagcccaaaagaggaccgcagccgggauuaugaaaaacccuacugucgauggaaucguggcuauagaccuggaucccgucguguacgacacgaaguucgagaaacagcucggccagauuaugcuucugaucuuguguacaucucagauccugcucaugcgcaccacuugggcccugugcgaaaguauuaccuuagcaacagguccacuuacuacccugugggaggggucgccuggaaaguuuuggaauacaacgaucgcuguuagcauggccaacauauuccggggcuccuaucucgcgggugccggccuagcauucucucugaugaaaucauuggggggaggccgaagagggaccggagcucaaggcgagacucugggugaaaaguggaagaggcagcucaaucagcuuagcaaauccgaguuuaacauuuacaagcgcagugggaucauggaaguggaccggucugaggccaaagaaggacugaagagaggcgagacaaccaaacaugcaguaagccgugguacugcuaaguugaggugguucguggagcggaaucuggucaagcccgaaggcaaaguuauugaucucggguguggacgcggcggguggucauauuacugcgccggauuaaagaaagugacagaggucaagggcuauaccaaaggugggccgggacacgaagagccaaucccuauggccacguacggcuggaaccuggugaagcuucauuccggcaaagacguauuuuucaugcccccagaaaagugugauacccugcuaugcgacauaggggagaguagccccaauccuacaaucgaggaaggacgaacucucagagugcugaagaugguugagccgugguugagggguaaccaguuuuguauuaaaauccugaaucccuacaugccaucuguggucgaaacccucgagcaaaugcagcggaaguauggcgggaugcuugugcgcaacccucuguccagaaauucaacacacgagauguacugggucagcugcggaacuggcaacauugugucggcgguuaacaugaccucuaggauguuacugaaucgauucacaauggcucaccggaaacccaccuaugaacgugauguagacuugggugcagggacuagacauguggccgucgagccugaaguggcuaaccucgauaucauuggacagcgcaucgagaauauaaagaacgaacacaaaaguacguggcauuacgacgaggauaauccauauaagacaugggccuaccacggcuccuaugagguuaagcccagcggcucagcauccucuauggugaacggggucgugaggcugcuaaccaaaccuugggacguaauuccaauggugacucaaaucgccaugaccgauacaacgcccuuuggacagcagcggguuuucaaggaaaaagucgacaccagaacuccgcgcgcuaagagggguacaacccagaucauggaggugacugcgaaauggcuuuggggcuuucugagccgaaauaagaagccucggauuuguacaagagaagaguucaccaggaaagugcgcaguaacgccgcaauaggggcugucuuuguugacgaaaaucaauggaacuccgccaaggaggcaguggaggaugaacguuucugggaccucguacggagagagagggaacugcacaaacagggaaagugcgccacaugcguguacaauaugaugggcaaacgcgagaagaaguugggugaauuugggaaagcuaagggaagccgagccaucugguacauguggcugggcgcgcgguuccucgaguucgaggcacuuggcuuuaugaacgaagaucauugguucucuagagagaauucacugaguggggucgaaggagaggguuuacacaaacugggcuauauuuugagggacaucuccaagauuccagggggaaacauguacgccgaugacacugcuggcugggauacccgcaucacggaggacgaucuccagaaugaagccaaaauaaccgacaucauggagcccgaacaugcacugcuagcuacaagcauuuuuaagcuuacuuaucagaacaaagugguuagagugcaacggccugccaagaacgguaccgucauggaugugaucucuaggcgugaccagcgagggucgggacagguaggcacauacggccugaauacuuucaccaacauggagguucagcucauucgccaaauggaaucagaggggaucuuucugccaagcgaguuggaaacgcccaauuuagcugagagagugcuggauuggcucgaaaagcacggagccgagcggcuuaaaaggauggcaauauccggugacgacugugucgugaagccgauugaugaccgcuucgcgacagcccugaccgcucuaaacgauaugggcaaagugagaaaggacaucccucagugggaacccaguaaaggguggaaugauuggcagcaggucccauuuugcucucaucacuuccaccaacugaucaugaaggacggacgggagauuguugugccuuguaggaaccaggaugagcucguaggccgagcccgugugagccagggugcagggugguccuugagagaaacugcuugccugggaaagucauaugcccaaauguggcagcuuauguacuuucaucgccgggaccugaggcucgcagccaaugcgauauguagugcuguccccguggauuggguuccaacaucuagaaccacuuggagcauccacgcccaucaccaguggaugaccacagaggacauguuauccguguggaaccgcgucuggauugaagagaaucccuggauggaagauaaaacgcacgugucaagcugggaggagguaccuuaucugggcaagcgggaagaccaguggugcggcucuuugaucgggcugaccgcaagggccacuugggcuacaaacauucaaguugccaucaaucaggugcgaagacucauaggaaacgagaauuaccuugacuacaugaccuccaugaaacgguucaagaacgaaagugauccagagggugcacugugguga

SEQ ID NO: 13435 - RNA, 9879 nt, Artificial Sequence
  derived and/or modified CDS sequence (opt3) from DENV-1__KF973462__SS-prME
agcgugaccaugcugcucaugcuucugcccacagcauuggcuuuccacuuaacuacgcgaggaggggaaccucauaugaucgucuccaagcaggaaaggggaaaaucucugcuguuuaagaccucagccgguguuaacaugugcacccucauugccauggaccugggcgaacuuugugaagauacucugaccuacaaaugcccacaaauaaucgaagcggaaccggacgauguggacuguuggugcaaugcuacagauaccuggguaacuuaugggacauguagucagaccggagagcaccggcgcgacaagcgaagcguggccuuggcaccccaugucggccucggucuggagacgcguacugaaaccuggauguccucugagggggccuggaaacagauucagaggguggaaacaugggcucugaggcacccuggauucacuguuaucgcacucuuuuuagcccaugcuauuggcaccucgaucacacaaaagggcauaaucuucauucugcuuauguuggugaccccaucaauggccaugcggugcgucgggaucggaaaccgcgauuuuguggagggucugagcggcgcgacguggguagacguugugcuagagcacgggaguugugucacuacaauggcaaagaauaaacccacccucgauauugaacugcuuaagacugaggugacaaacccugccauccugagaaaauugugcauagaagcuaagauuuccaauaccacgaccgacucuagguguccaacacagggagaggccacucucguggaagaacaggaugcaaacuucgucugccggcgcaccuuuguugaccgaggcugggguaauggguguggacuguucggcaaaggcagcuuacugacaugcgcuaaguuuaagugcgugacuaaacucgaggggaagaucguacaguacgaaaaccuuaaauauuccgugauugucaccgugcacacaggagaucaacaucagguugguaaugagaccacugaacacggcacgaucgccacaaucaccccacaggcgccuacuucagagauucagcugaccgacuacggggccuugacacuagacuguaguccaagaaccggacuggauuucaacgaaauggugcuccugacuaugaaggagaaaagcuggcuuguccauaagcaaugguuucuggacuugccgcuccccuggacaucuggcgcauccacgucacaggagaccuggaauaggcaggaucuguuagugacuuucaaaacagcucacgccaagaagcaagaaguaguugugcuggguagccaggagggggcuaugcacaccgcccuaacaggcgcaacugaaauacagaccaguggaacgaccacaaucuuugccggccaucucaaaugccggcugaagauggacaaacuuacuuugaaggggaccucuuaugucauguguacaggauccuucaaacuggagaaggaaauggcugagacucagcacgguaccgugcucguccaagugaaguacgagggcacggaugcgccuugcaaaauuccauucagcacacaggacgaaaaggggguuacccagaacggacgucugaucacugcaaaucccauagugacagauaaagagaagccuguaaacauugaaaccgagccacccuuuggcgagucguauaucgucgugggugccggggaaaaagcucuuaagcugucuugguucaagaaaggcuccucaaucggaaagauguuugaggccacugcacgcggcgccagaaggauggcuauuuugggggacaccgccugggauuucggaaguaucgguggcguuuuuacaagcguggggaaacucguccaucagguguucggaacggcauacggcguacuguuuuccggugugucuuggaccaugaagauugggauaggcaucuuacugacuuggcuaggacucaauagccggucaacaagucuguccaugaccuguauugcgguuggcauggucacacuuuacuugggggugauggugcaagcugacagcggaugcgucaucaacuggaaaggccgagaacugaagugugguucugggaucuucguuacuaacgaggugcacaccuggacggaacaguauaaguuucaggccgauucaccgaaacgccucagugcagccauuggaaaggcuugggaggagggcgugugcgguauaagaagcgccacaaggcuggaaaauaucauguggaaacagauuuccaacgaguuaaaucauauccugcuugaaaacgacaugaaguucaccguagucgugggcgacgcaaaugggauuuuggcucaaggcaaaaagaugauccggccucagcccauggagcacaaauacucuuggaagucguggggcaaggccaaaauaaucggggcggauauucagaacacuaccuuuaucauugacggaccagauacaccugaaugucccgacaaucagcgcgccuggaacaucugggagguugaggauuauggcuucgguauauuuacuaccaauauuuggcucaagcugagagacagcuacacacaagugugcgaucacaggcuaauguccgcugcaaucaaagacucaaaggccguccaugcugauaugggguauuggauugaaagugagaaaaacgaaacguggaagcuggcccgugcaucuuucaucgaggugaagaccuguacuuggccaaaaagccacacacucugguccaauggaguucuggaaucagagaugauaauccccaagauuuacggcgguccuaucagccagcauaacuaucggccaggcuacuucacccagacugcggggccguggcaccuuggaaaauuggagcuggacuuugauuuaugcgaaggcacaaccgugguagucgacgagcacugcgggaaucgaggacccucucucagaacgacuaccgugacaggcaagauuauccaugaaugguguugcagguccuguacccugccuccacuucgcuuccggggugaggaugggugcugguacggaauggagauaagacccgugaaagaaaaggaggaaaaccuggucaggaguaugguuagcgccggcucuggugagguggacuccuuuucauugggcauucucugugcuaguaucaugaucgaagagguaaugcgcagccgauggucgcggaagaugcugaugacugggacacuagccguguuccugcuccugauuaugggacaacuuaccuggaaugacuugauccgucugugcauuauggucggcgcaaacgcuuccgauagaauggggaugggaacaacuuauuuagcccucauggcaaccuuuaaaaugaggccuauguucgccgugggccugcuuuuucgccggcugacgucuagagagguucuacuccugacaauagguuugagccugguggcuucagucgaauuaccaaacagucucgaggaacugggggacggacuugcgaugggcaucaugaugcugaaguugcucaccgaguuccagccccaccagcuguggacuacccuacugucccuuacauuuauuaaaacuacccucucucuggauuacgccuggaagacgacagcaauggcuuugagcaucauuucccuguucccguuaugucucucaaccacuagccagaaaacaaccuggcugccugugcuucugggcaguuuugggugcaagccauugacuauguuccucaucacagaaaauaagauauggggaaggaaaucuuggccccugaacgaggguaucauggccauuggcaucguuuccauucuacugagcucgcuucucaagaaugacgugccucuggccgggcccuugaucgcuggaggcauguuaauagcauguuaugucauuucagguucuagugccgaucugucccucgagaaagcggcugaaguaagcugggagcaagaagccgagcauucugggaccagccacaacauccugguggaaguucaggacgauggaacgaugaagaucaaagacgaggagcgagaugacacucuuaccauucuguugaaggcaacacuacuggccguguccggcgucuacccaaugucaauaccugcuacccucuuugugugguauuucuggcagaaaaagaagcagcgcaguggcguacugugggauacacccagcccaccggaaguggagcgggcaguccuugacgaugggaucuacagaauuuuacaaaggggacugcucggucguucucagguuggcguggggguguuccaggacggagucuuucauacuauguggcacgugacccgcggcgccguuuugauguaucaggguaaacggcuggaaccuuccugggcgucaguaaagaaagaccucaucaguuacgggggaggcuggagauuccaaggcagcuggaauacgggggaggaggugcaggucauugcuguggaacccggaaagaaccccaaaaauguucagacaacucccgguaccuuuaagacaccugagggcgaagugggggccaucgcacuggauuucaagccaggaaccuccggcucucccauagucaacagggaggguaaaaucguggggcuuuacggaaauggcguagucacuaccucgggcacauaugugagcgccauugcucaagccaagguuucacaggaagggccucugccggagaucgaggacgaaguguuuaaaaagcgaaacuugacgauuauggaucuacacccaggauccgguaaaacucggcgcuaccugcccgcaaucgucagagaggcuauaaagaggaagcuccggaccuuaauucuggccccuacacgagugguugcgagugaaauggccgaggcacuuaaaggcaugccaaucagauaucagaccacugcugugaagucugaacauacagggcgcgagaucgucgaccugaugugccacgccaccuucacgaugaggcucuugagccccgugcguguaccuaauuacaacaugauuaucauggaugaggcucauuuuacugacccggcauccauagccgcccggggauauauuucaacaagagugggcaugggugaagcugcggcaaucuucaugaccgccacacccccagggucuguugaggcuuuuccucagagcaaugccgucauucaagaugaagagagggacauccccgaacgcaguuggaacuccggauacgauuggauaacugacuucccaggcaaaacagugugguuugugccuagcauuaagucuggcaaugauaucgcaaacugucugcggaaaaacgggaagagagucauccagcucucaagaaagaccuucgacacagaguaucagaaaacuaagaauaacgacugggauuacguagugacgaccgacauuuccgagaugggagccaauuucagggcugaucgcguuaucgacccccguagaugccugaaaccagugauucuuaaggaugguccggaacgggucauacuagcgggcccuaugcccgugacaguugccagugcagcucagaggcgcgggcgaaucggaagaaaccaaaauaaagagggcgaccaguacguguauaugggucagccacugaacaaugaugaagaccacgcccauuggacugaggcaaagauguuguuagauaacauuaauacccccgaggggaucaucccugcccuguuugaaccagagcgggaaaagagcgcugccauugacggcgaguacaggcuccgcggagaagcgagaaaaacauucgucgagcugaugaggcggggcgaucuucccguguggcugucguauaagguagcaucugagggguuucaguacuccgaccgucgcuggugcuucgauggagaacgaaacaaucaagugcucgaggaaaacauggacguugagauauggaccaaagaaggugagagaaagaaauugaggccucgguggcuggacgcccgcacuuauagcgauccgcuagcucugagagaguuuaaggaguucgccgcuggcaggcggucagucaguggggaccucauccuugagauuggaaaacugccacagcacuuaacguugcgagcacagaaugcccuggauaaccucgugaugcugcacaauucugaacagggcgguaaggcuuacagacaugccauggaggaacuucccgacaccaucgagacacugaugcucuuggcacugauugcgguguuaacugggggcgucacccuauuuuuccuguccggaaagggccucgggaaaacaagcaucggacuucuguguguuaccgccucaagugcuuugcuguggauggccagcguggagccucacuggauagcagcuuccaucauucucgaauuuuuccugaugguacuucucauccccgagccagaucgccaaaggacuccucaggacaaccagcuggccuauguggucauugguuugcuguuuaugaucuuaacaguggcagccaacgaaaugggccuacuggagacgaccaagaaagaucucgggauaggacauguugcugcggagaaucaccaacacgccacuaugcuugacguggaucugcggcccgcaucugcuuggacauuguacgccgucgccaccaccguaauuacaccaaugaugcgucauacuaucgaaaacacgaccgcaaauauuagccugacagcuaucgccaaccaggcggcuauacucaugggccuggacaaggguuggccuaucuccaaaauggauauuggggugccgcuuuuagcccugggcugcuacucacagguuaauccccucacuuugaccgcagccgugcugaugcuagucgcucacuaugcaaucauuggaccaggccugcaggccaaggcgacaagagaggcucaaaagaggaccgccgcagggaucaugaaaaacccuacuguggacggaauagucgccauugaucucgaccccgugguuuacgacacgaaguucgaaaaacagcuuggccagaucaugcuguugauccuguguacaucucagauucuccugaugcgcaccacuugggcuuuaugcgagaguaucacccuugccacagguccacugacuacccucugggaagggucgccuggaaaguuuuggaauacaacgauagcagugagcauggcuaacauuuuccggggcuccuaucuagccggugcgggccuggccuucucuuugaugaaaucacuagggggaggccgaagagggaccggagcacaaggcgagacucucggugagaaguggaagaggcagcuuaaucagcugagcaaauccgaauuuaacaucuacaagcgcagugggauuauggagguagaucggucugaagcuaaagagggauugaagagaggcgaaacaaccaaacaugccgugagccgugguacugcaaagcugaggugguucgucgagcggaaucucguuaagcccgagggcaaagugaucgacuuaggguguggacgcggcggguggucauauuacugcgcuggacugaagaaagucacagaagugaagggcuauaccaaaggugggccgggacacgaggaaccaauaccuauggccacguacggcuggaaccuuguacgacugcauuccggcaaggauguguuuuucaugcccccagagaaaugugacacccuacucugcgauaucggggaaaguagccccaauccuacaauugaggagggaagaacucugaggguuuugaagaugguggaaccguggcugcgggguaaccaguuuuguaucaagauucucaaucccuacaugccaucugucguggagacccuugaacaaaugcagcgcaaauauggcgggaugcuggucagaaacccuuuauccagaaauucaacacacgagauguacugggugagcugcggaacuggcaacaucguuucggccguaaacaugaccucucgaaugcuguugaaucgguucacaauggcgcaccguaagcccaccuaugagagagacguggaucucggugcugggacucgccaugucgcaguggaaccugagguugccaaccuggacauuaucggacagaggauagaaaauauuaaaaacgagcacaagaguacguggcauuacgaugaagacaauccauauaaaacaugggcuuaccacggcuccuaugaggugaagcccagcggcucagccuccucuauggucaacggggugguacggcuacuuaccaagccuugggaugugaucccaaugguuacucaaaucgcaaugaccgacacaacgcccuuuggacagcagagagucuucaaagagaagguggacacccgcacuccgagggccaaacgagguacaacccagauuauggaagugacugcuaaguggcuguggggcuuucucagccggaauaaaaagccuagaauauguacaagggaggaguucacccgcaagguccguaguaacgcggccaucggggcaguuuuuguggaugagaaucaauggaacuccgcuaaagaagccguagaggacgagcgguucugggaucuggugcacagagaaagggaguugcauaagcagggaaaaugcgcaacaugcgucuacaauaugaugggcaagcgcgagaaaaagcugggugaguuugggaaggccaaaggaagccgagcuauuugguacauguggcucggcgcccgguuccuugaguucgaggcgcugggcuuuaugaacgaggaccacugguucucuagagaaaauucauuaagugggguggagggagaaggucugcauaaguugggcuauauccucagggauauuuccaaaaucccagggggaaacauguacgcagacgauacugccggcugggacacccgcauaacggaggaugaccugcagaaugaggcuaagaucaccgauauuauggaacccgagcacgcccuacuugcaacaagcaucuuuaaacugacuuaucagaacaagguugugagaguccaacggccugcuaaaaacgguaccgugauggacguaauuucuaggcgugaucagcgagggucgggacagguuggcacauacggccucaauacuuucaccaacauggaagugcagcugauccgccaaauggagucagaagggauauuuuugccaagcgaguuagagacgcccaaucuggccaagagaguccucgacuggcuugaaaagcauggagcugagcggcugaaaaggauggccauuuccggugacgauuguguggugaagccgaucgacgaucgcuucgcaacagcgcuaaccgcccugaacgacaugggcaaaaucagaaaggauauuccucagugggaacccaguaaaggguggaaugacuggcagcaggucccauuuugcucucaccacuuccaucaacucauaaugaaggauggacgggagaucguugugccuuguaggaaccaggacgaauugguaggccgagcucgugugagccagggugccggguggucccugagagagacugcaugccuuggaaagucauaugcucaaauguggcagcugauguacuuucaccgccgggaucucagguuagccgcaaaugccauuuguagugcgguccccguggacuggguuccaacaucuagaaccacuuggagcauccaugcucaccaccaguggaugaccacagaggauaugcuguccguguggaaccgcgucuggauugaagagaaucccuggauggaagacaaaacgcaugugucaagcugggaggaaguaccuuauuugggcaagcgggaggaccaguggugcggcucucugaucgggcucaccgccagggcaacuugggccacaaacauacaaguugcuaucaaucaggugcgaagacuuauuggaaacgagaauuaccuggauuacaugaccuccaugaaacgguucaagaacgaaagugacccagagggugcccuaugguga

SEQ ID NO: 13436 - RNA, 9879 nt, Artificial Sequence
  derived and/or modified CDS sequence (opt3) from DENV-1__KF973463__SS-prME
agcgugaccaugcugcucaugcuuaugcccaccgcccuggcuuuccacuugacuacgagaggaggggaaccucauaugaucgucuccaagcacgaaaggggaaaagcauuacuguuuaagaccucuacagguguuaacaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacagacuggagagcaucgccgagacaagcguaguguggcccuugcaccccacgucggccuggguuuggagaccagaacagaaacuuggaugagcuccgagggggccuggaaacaaauccagaggguggaaaccugggcucuccggcauccuggauucacaguuauugcacuguuucuggcccacgcuaucggcaccucuauuacgcagaagggcaucauauucauccucuuaaugcuggugacuccaucgauggccaugcgcugcgucgggauuggaaacagagauuuuguggagggucuuucaggcgcgacauggguagacguuguguuggagcacgggagcugugucaccacuauggcaaagaauaaacccacacuggauaucgaacuacucaagaccgaggugacgaacccugccgugcugaggaaacuuugcauugaagcuaagaucaguaauaccacaacugacucccgguguccaacccagggagaggccacacuggucgaagaacaagaugcaaacuucguuugccgccgaacuuuuguggacagaggcugggguaauggguguggauuguucggcaaaggcucucuccugaccugcgcuaaguuuaagugcguaacaaaauuagaggggaagauagugcaguacgaaaaccugaaauauagcgucauugugaccguucauacuggagaucagcaccagguggguaaugagacgacagaacauggcaccaucgccacuauuacaccccaagcgccuacauccgagauccagcucaccgacuacggggcccuuacucuggacuguucaccaaggacaggauuggauuucaacgaaaugguccuacugacgaugaaggagaaaaguuggcucgugcacaagcagugguuucuggaccuuccgcugcccuggaccagcggcgcaucuacuucccaggagacauggaaucggcaagauuugcucguaaccuucaaaacagcucacgccaagaagcaggaaguugugguccuggguucacaggagggggcuaugcauacugccuuaaccggcgcaacggaaauccaaaccagcggaacaacuaccauuuuugccggccaccugaaaugccgucuaaagauggacaaacucacacugaaggggacaaguuaugugauguguaccggaucuuucaaacuugagaaggaagucgcugagacgcagcaugguacaguguugguucaggugaaguacgagggcaccgaugcgccuugcaaaauaccauucuccacucaggacgaaaaggggguaacacaaaacggacgccugaucaccgcaaaucccauugucacugauaaagagaagccugugaacaucgaaaccgagccacccuuuggcgagagcuauauaguugugggugccggggaaaaagcucucaagcugucgugguucaagaaaggaucuuccauuggaaagauguuugaggccacagcaagaggcgccaggcggauggcuauccuuggggacacggccugggauuucggaucaaucgguggcgucuuuaccaguguggggaaacugguacaccagguguucggaacugcauacggcguuuuguuuagcggugucuccuggacaaugaagauugggaucggcauucuccugaccugguuaggacuaaauucucgaagcacaucacuaaguaugacuuguauagcggugggcauggugacccucuaccugggggucaugguucaggcugacuccggaugcgugaucaacuggaaaggccgcgaacuuaagugugguagcgggauuuucgugacgaacgagguacauacauggaccgaacaguauaaguuucaagccgauucuccgaaaagauugucagcagccaucggaaaggcuugggaggagggcgucugcgguaucaggagugccacucggcuggaaaauauuauguggaaacagauaagcaacgagcucaaucacauccuguuagaaaacgacaugaaguucaccgugguugugggcgacgcaaaugggauucuggcucagggcaagaagaugauccgcccucagcccauggagcacaaauacuccuggaagucuuggggcaaggccaaaauuaucggggcggauauacaaaacacaacuuuuaucauugacggaccagauaccccugaaugucccgacgaucagagagccuggaauaucugggaggucgaggacuauggcuucgguauuuuuacaacgaacaucuggcuuaaguugagggauucguacacccagaugugcgaccaucgucucaugagcgcugcaauaaaagauuccaaggccgugcacgcugacaugggguauuggauugaaucagagaaaaaugaaacuuggaagcuggcccgggcaaguuucaucgagguuaagacauguaccuggccaaaaucucauacucuauggagcaacggagugcuggaauccgagaugauuauccccaagauauacggcgguccuaucucacagcacaauuaucgaccaggcuacuucacacaaaccgcggggccguggcaccucggaaaacuggagcuugauuuugacuugugcgaaggcacgacuguagucguggaugagcauugcgggaacagaggacccagccugaggaccacaaccgugacuggcaagauuauccacgaaugguguugccgcucuuguacauuaccuccacuccgguucagaggugaggacgggugcugguacggaauggagauuaggcccgucaaagaaaaggaggaaaaucugguucgcuccauggugagugccggcagcggugagguagacucuuuuucccuuggcauccugugugugucaauaaugauugaagaggucaugcgaagucgguggagccguaagauguugaugaccgggacacucgcuguguuccugcuacugaucaugggacagcucacuuggaacgaucugaucagacuuugcauuaugguuggcgccaaugcaucggacaaaauggggaugggaaccacguauuuggcucugauggccacauuuaagaugaggccuauguucgcagugggcaucuuauuucgccggcucaccuccagagagguccugcuucugacuauuggucuaucucucguggccagcguugaacugccaaacucauuggaggaacugggggauggauuagcuaugggcauaaugaugcucaaacugcuuaccgaguuccagccccaucaacuguggacaacuuugcucagucugaccuuuaucaagacgacacuaucccuggacuacgcguggaaaaccacugccauggcacuuucuauugugagccucuucccgcuguguuuguccacaaccucacagaagacuacauggcugccugucuuacucggcagcuuugggugcaagccacugaccauguuccuuaucacggaaaacaaaauuuggggaaggaagaguuggcccaucaaugaggguauaauggcuaucggcauuguaucuauccuguuguccagccuccugaaaaacgaugugccucuagccgggccccugauugccggaggcaugcuuaucgcuuguuauguuauaucggguucaucugcagaccucagucuggagaaggccgcggaaguguccugggagcaggaagcugagcacagcgggacuucucauaauauuuuggucgaagugcaggaugacggaaccaugcgaaucaaagaugaggagaaggacgauacauuaaccauccugcucaaagccacacugcuugcaguaagcggcguguacccaauguccauuccugccacucuguuugucugguauuucuggcaaaagaagaaacagcgcucaggcguuuugugggacacccccaguccaccggaaguggagcgggcugugcuagaugacgggauauacagaauccugcagaggggacuccugggucguagccaggucggcguggggguuuuccaagacggaguauuucacacgauguggcacgugacacgcggcgcaguccuuauguaucaggguaagcgguuagaaccuucuugggccuccgugaaaaaggaucugauuucauacgggggaggcuggagauuccagggcaguuggaacacuggggaggagguucaggugaucgcggucgaacccggcaaaaauccaaagaacgugcaaaccacacccgguaccuuuaagacuagcgagggcgaaguaggggcuauugcccucgacuucaaaccuggaaccuccggcucuccaaucgucaauagggaggguaagauagugggguuguacggaaacggcguugugacaacgucgggcacuuaugucagcgcaaucgcccaggcuaaaaccucacaggaagggccccugccugagauugaggaugaaguguuuaagaaacgaaaucucacaaucauggaccugcauccgggauccgguaagacccggcgcuaccuuccagccauuguuagagaggcaaucaagaaaaagcugaggacuuugauacuagcucccacacggguggucgccagugaaauggcggaggcccugaaaggcaugccuauucgauaucaaaccacggcagugaagucugaacacacugggagagagaucguagaucucaugugccaugcuacauucaccaugcgcuuacugagcccagugaggguucccaacuacaauaugaucauuauggacgaggcccacuuuaccgauccugcuuccaucgcagcccguggauauauaucaacucgggucggcaugggugaagccgcugcgauuuucaugacagcaaccccgcccgggucuguggaggccuuuccacagagcaacgcugugauccaggacgaagagagagauauuccugaaaggaguuggaacuccggauacgacuggaucacagauuuccccggcaaaacugucugguuuguaccaagcauaaagucuggcaaugacauugccaauugucuucgcaagaacgggaaacgagugauccagcugucaagaaagacguucgacaccgaguaucagaaaacuaagaacaaugauugggacuacguugugacuaccgauaucuccgagaugggagcaaacuuccgggccgacagggucauugauccucgccguugccucaaacccgugaucuugaaggacgguccagaaagaguuauucuggcuggcccgaugccugugacagucgcgagugccgcacaacggagggggcgcauaggacgaaaucagaacaaggagggcgaucaguacguguauaugggucaaccccucaauaacgacgaagaucaugcucacuggaccgaggccaaaaugcugcuugacaauaucaacacuccagaggggauuauccccgcacuauuugaaccugagagagaaaagagcgccgcuaucgauggcgaguaccggcugaggggagaagcccgcaaaacguucguagaguugaugagaaggggcgacuuaccaguguggcugucguauaagguugcgucugagggguuucaguacuccgaucggcguuggugcuucgacggagaacgcaauaaccagguccucgaggaaaauauggacguggagauuuggaccaaagaaggugagcgaaagaaacugagacccagguggcuugaugcacggacauauagcgacccucuggcccuccgcgaguuuaaggaguucgcugccggcagaaggucagugaguggggauuugauacuggagaucggaaagcuaccgcagcaccugacucuccgggcucaaaacgcacuugacaaucuggucauguuacauaacucugaacagggcgguaaagccuaccgacacgcuauggaggaauugccagauaccauugagacacugaugcuccuggcccuuaucgcaguucugaccgggggcgugacucucuuuuucuuguccggaaagggccuggggaaaacaagcauuggauuacuauguguaacggcgucaagugcccugcucuggauggcuagcguggagccccauuggaucgccgcauccauaauccuugaauuuuuccugauggucuugcugauuccugagcccgacagacagcgcaccccacaggauaaucaacucgcuuaugugguuaucggucugcuuuuuaugauucucacuguggccgcaaacgaaaugggccuguuggagacaaccaagagggaccuggggaucggacacgucgccgcugagaaccaccagcaugcgaccauguuagauguagaccuacggccugccucugcauggacacuguacgcuguggccacuacgguuauaacccccaugaugcgucacacaauugaaaauacuaccgccaacaucagccucacagcaauugcuaaucaggccgcgauccuuaugggccuggauaaagguuggccaauauccaagauggacaucggggugccuuugcuggcucucggcugcuacucacaagucaacccgcugacccuuacugccgcaguguuaaugcuggucgcccauuaugcuauuaucggacccggccuccaggcaaaggccacgagagaggcgcagaaaaggacagcugccgggauuaugaagaauccaaccguggauggaaucguugcaauagacuuggacccugugguauacgaugccaaauucgaaaagcagcugggccaaauuaugcuacugauccucuguacuucucagauccuucugaugcgcaccacaugggcuuugugcgagaguauuacucuggccaccgguccccucacaacgcugugggaagggucgccaggaaaauuuuggaacaccacuaucgcagugagcauggcuaauauauuccggggcuccuauuuagccggugcgggccuugccuucucucugaugaagucacucgggggaggccgaagagggacaggagcacagggcgagacccuaggugagaaguggaaaaggcagcugaaccaauugagcaagccugaauuuaauacuuacaaacgcuccgggauuauggaggucgaccggagugaagcuaaggagggacugaaaagaggcgaaacaaccaagcacgccguuucucgugguacggcaaagcucaggugguucguggagcggaaccuugucaaacccgagggcaaggugaucgaucugggguguggacgcggcggguggagcuauuacugcgcuggauugaaaaagguaaccgaagugaaaggcuauacaaagggugggccgggacaugaggaaccaauuccuauggccacuuacggcuggaaucugguuaaacuccacucaggcaaggacguguuuuucaugcccccagagaagugugauaccuuacugugcgacaucggggaauccagucccaacccuacaauagaggagggacgaacucuuagaguccugaaaaugguggaaccguggcuaagggguaaucaguuuuguaucaagauucucaaccccuacaugccaagcgucguggagacccuggaacagaugcagcggaaacacggcgggauguugguucgcaauccucugucuagaaacuccacacaugagauguauuggguaucaugcggaaccggcaauaucgugagcgccgucaacaugacuucgaggaugcuccuuaaccgauucacgauggcgcaccggaagcccacauacgagcgugauguggaccugggugcugggaccagacauguugcaguggaaccugaggucgccaauuuagauauuaucggacaacgcauugaaaacaucaaaaaugagcacaagucuacuuggcacuaugacgaagauaacccauacaagaccugggcuuaucauggcaguuacgaggugaaacccuccggcagcgccucauccaugguaaauggggugguuaggcuguugacaaagccuugggacgucauaccaauggugacgcagauugcaaugaccgacacuacacccuuuggacagcaacggguguucaaagagaaggucgauaccagaacuccgcgcgccaaaagggguacaacccagaucauggaaguuacagcuaaguggcucuggggcuuucugucucgaaacaagaaaccucggaucuguacuagagaggaguucaccaggaaggugcgcagcaaugcggccauuggggcaguauuuguggacgagaaccaguggaauagugcuaaagaagccgucgaggaugagcguuucugggaccuagugcaccgggaaagagagcuucauaagcagggaaaaugcgcaacgugcguuuauaacaugaugggcaagagggaaaagaaacugggugaguuugggaaggccaaaggaucccgcgcuauaugguacauguggcucggcgcccgauuccuggaguucgaggcguugggcuuuaugaaugaggaucacugguucagccgggaaaacucucugucagggguggagggagaaggucuccauaaacuuggcuacauccugagagacauuaguaaaaucccagggggaaauauguaugcagaugacaccgccggcugggauacaaggauuacugaggacgauuuacaaaacgaggcuaagaucaccgacauaauggaacccgagcacgcccuguuggcaacauccaucuuuaaacucacuuaccagaauaaggucgugcgcguacagagaccugcuaagaacgguaccguuauggaugugauuagccggagggaccagcgugggucuggacaagucggcacguauggccugaacacauucaccaauauggaagugcagcuaauccgacagauggagucggaagggauuuuucuuccaucagagcuggagacucccaaccucgccgaacgcgugcuggacugguuggagaaacacggagcugaaagauuaaagcggauggccaucagcggugaugacugugucguuaaaccgauagaugacagguucgcaacagcgcugaccgcccucaaugauaugggcaaggugcgcaaagacauuccucagugggagcccuccaagggguggaacgauuggcaacagguaccauuuugcagucaucacuuccaucagcuuaucaugaaggacggaagagaaaucguggucccuugucggaaucaggaugagcuggugggcagggcucgaguuucucaaggugccggguggagccuacgugagacugcaugccugggaaaauccuacgcucagauguggcagcucauguauuuucacagacgcgacuugcggcuggccgcaaacgccauuuguucagcggugcccgucgauugggugccaaccaguaggacaacguggucuauacacgcucaucaccaauggaugaccacugaagacaugcuuagcguauggaauagaguuuggaucgaggaaaaccccuggauggaggacaagacacauguguccucaugggaagaggucccuuaccugggcaaacgcgaggaucaguggugcggcagccucauuggguuaaccgcccgggcaacuugggccacaaauauccagguggcuauuaaccagguuaggcgacugaucggaaaugaaaacuauuuggacuacaugaccucuaugaagagauucaaaaaugaguccgauccagaaggugcccugugguga

SEQ ID NO: 13437 - RNA, 9879 nt, Artificial Sequence
  derived and/or modified CDS sequence (opt3) from DENV-1__KF973464__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggacccuggccguguuccuacugcucaucaugggacaacugacauggaaugaccuuauucguuugugcaucauggucggcgcaaacgcuuccgauagaauggggaugggaacuaccuaucuggccuuaauggcaacguuuaaaaugaggccuauguucgccgugggccuccuguuucgccggcuuacaucuagagagguucugcuacucaccauuggucugagcuugguggcuucagucgaacugccaaacaguuuagaggaacucggggacggacuggcgaugggcauaaugaugcuuaagcuguugacugaguuccagccccaccagcucuggaccacacugcuaucccugacuuuuaucaaaaccacgcuuucucucgauuacgccuggaagacaaccgcaauggcucugagcauuaucuccuuguucccgcuguguuuaucaacuacaagccagaaaaccacuuggcucccugugcugcuuggcaguuuugggugcaagccacugacaauguucuugauuaccgaaaauaagaucuggggaaggaaaucuuggccccucaacgaggguauaauggccaucggcauuguuuccauccugcuaagcucgcugcuuaagaaugacgugccucucgccgggccccugauugcuggaggcauguugaucgcauguuaugucauaucagguucuagugccgauuuaucccuggagaaagcggcugaaguaagcugggagcaagaagccgagcauucugggacgagccacaacauucucguggaaguucaggacgauggaacuaugaagaucaaagacgaggagcgagaugacacccugacaauccuucugaaggcaaccuugcuagccguguccggcgucuacccaaugucaauuccugcuacacuguuugugugguauuucuggcagaaaaagaagcagcgcaguggcguacucugggauacucccagcccaccggaaguggagcgggcaguccuggacgaugggauauacagaauccuucaaaggggauuacugggucguucucagguuggcguggggguguuccaggacggagucuuucauaccauguggcacgugacgcgcggcgccguucucauguaucaggguaaacgguuggaaccuuccugggcgucaguaaagaaagaccugauuaguuacgggggaggcuggagauuccaaggcagcuggaauacaggggaggaggugcaggucaucgcuguggaacccggaaagaacccaaaaaauguucagacuacccccgguauuuuuaagacaccugagggcgaagugggggccaucgcacucgauuucaagccaggaaccuccggcucucccauagucaacagggaggguaaaaucguggggcuguacggaaauggcguagucacuaccucgggcacauaugugagcgccauugcucaagccaaggcaucacaggaagggccucuuccggagaucgaggacgaaguuuuuaaaaagcgaaaccugacgauuauggauuugcacccaggauccgguaaaacucggcgcuaccuacccgcuauggugagagaggccaucaagaggaagcugcggacccucauauuagcgccuacacgagucguggccagugaaauggcagaggcucugaaaggcaugccaauuagauaucagaccacugccguuaagucugaacauacagggcgcgagaucguggaccuuaugugccacgcuaccuucacgaugaggcugcucagccccguccgugugccuaauuacaacaugaucauuauggaugaggcacauuuuacugacccggccuccaucgccgcucggggauauauaucaacaagaguaggcaugggugaagcggcagccauuuucaugaccgcuacccccccagggucuguggaggccuuuccucagagcaaugcaguuauccaagaugaagagagggacauucccgaacgcaguuggaacuccggauacgauuggaucacugacuucccaggcaaaacagucugguuugugccuagcauaaagucuggcaaugauauugccaacuguuugcgaaaaaacgggaagagagugauccagcugucacggaagaccuucgacacagaguaucagaaaacuaagaauaacgacugggauuacgucguaacgaccgacaucuccgagaugggagcuaauuucagggcggaucgcgugauugacccccguagaugccucaaaccaguuauccugaaggaugguccggaacgggugauucuugccggcccuaugcccgucacaguggcaagugcugcccagaggcgcgggcgaauaggaagaaaccaaaauaaagagggcgaccaguacguuuauaugggucagccacuaaacaaugaugaagaccacgcacauuggacugaggccaagaugcuguuggauaacaucaauacccccgaggggauuaucccugcuuuauuugaaccagagcgggaaaagagcgccgcgaucgacggcgaguacaggcugcgcggagaagcaagaaaaacauucguggagcucaugaggcggggcgaucugcccgucuggcuuucguauaagguggccucugagggguuucaguacuccgaccgucgcuggugcuucgauggagaacgaaacaaucaaguacuggaggaaaacauggacguggagauuuggaccaaagaaggugagagaaagaaacucaggccucggugguuggacgcucgcacuuauagcgauccgcuggcccuaagagaguuuaaggaauucgcugcaggcaggcggucaguuaguggggaccugauacucgagaucggaaaacuuccacagcaccugacguuacgagcccagaaugcuuuggauaaccuggucaugcuccacaauucugaacagggcgguaaggccuacagacaugcaauggaggaacugcccgacaccauugagacacuuaugcugcucgcguugaucgccgugcugacugggggcgugaccuuauuuuuccuauccggaaagggccuggggaaaacaagcauuggacuccuuugugucaccgcuucaagugcccuguuguggauggcaagcguugagccucacuggaucgcugccuccauaauccuggaauuuuuccucauggugcugcuuauucccgagccagaucgccaaaggacuccucaggacaaccagcucgcauauguagugaucggucuguuguuuaugauucugacagucgccgcuaacgaaaugggcuuacuagagacgaccaagaaagaucuggggaucggacauguggcggccgagaaucaccaacacgcaacuaugcucgacguugaucuucggcccgcuucugccuggacacuguacgccguggcaaccaccgucauaacaccaaugaugcgucauacuauugaaaacacgaccgcuaauaucagcuugacagccauugcgaaccaggcugccauccugaugggccucgacaaggguuggccuauauccaaaauggauaucgggguaccgcugcuugcauuaggcugcuacucacaggugaauccccugacucucaccgccgcuguuuugaugcugguggcacacuaugccauuaucggaccaggccuacaggcgaaggcuacaagagaggcccaaaagaggaccgcagccgggauuaugaaaaacccuacugucgacggaaucguggcuauagaucuggaccccgucguguacgacacgaaguucgaaaaacagcucggccagauuaugcuucugaucuuguguacaucucagauccugcucaugcgcaccacuugggcccugugcgagaguauuaccuuagcaacagguccacuuacuacccugugggaagggucgccuggaaaguuuuggaauacaacgaucgcuguuagcauggccaacauauuccggggcuccuaucucgcgggugccggccuagcauucucucugaugaaaucauuggggggaggccgaagagggaccggagcucaaggcgagacucugggugagaaguggaagaggcagcucaaucagcuuagcaaauccgaauuuaacauuuacaagcgcagugggaucauggagguggaucggucugaagccaaagagggacugaagagaggcgaaacaaccaaacaugcaguaagccgugguacugcuaaguugaggugguucguggagcggaaucuggucaagcccgagggcaaaguuauugaccucggguguggacgcggcggguggucauauuacugcgccggauuaaagaaagugacagaagucaagggcuauaccaaaggugggccgggacacgaggaaccaaucccuauggccacguacggcuggaaccuggugaagcuucauuccggcaaagauguauuuuucaugcccccagagaagugugacacccugcuaugcgauauaggggaaaguagccccaauccuacaaucgaggagggacgaacucucagagugcugaagaugguugaaccgugguugagggguaaccaguuuuguauuaaaauccugaaucccuacaugccaucuguggucgagacccucgaacaaaugcagcggaaguauggcgggaugcuugugcgcaacccucuguccagaaauucaacacacgagauguacugggucagcugcggaacuggcaacauugugucggcgguuaacaugaccucuaggauguuacugaaucgauucacaauggcucaccggaaacccaccuaugagcgugacguagauuugggugcagggacuagacauguggccgucgaaccugagguggcuaaccucgacaucauuggacagcgcaucgaaaauauaaagaacgagcacaaaaguacguggcauuacgaugaagacaauccauauaagacaugggccuaccacggcuccuaugagguuaagcccagcggcucagcauccucuauggugaacggggucgugaggcugcuaaccaaaccuugggauguaauuccaauggugacucaaaucgccaugaccgacacaacgcccuuuggacagcagcggguuuucaaggagaaagucgacaccagaacuccgcgcgcuaagagggguacaacccagaucauggaagugacugcgaaauggcuuuggggcuuucugagccgaaauaagaagccucggauuuguacaagagaggaauucaccaggaaagugcgcaguaacgccgcaauaggggcugucuuuguugaugagaaucaauggaacuccgccaaggaagcaguggaggacgagcguuucugggaucucguacaccgggaaagagagcugcauaaacagggaaagugcgccacaugcguguacaauaugaugggcaaaagggaaaagaaguugggugaguuugggaaagcuaagggaagccgcgccaucugguacauguggcugggcgcgcgauuccucgaauucgaggcacuuggcuuuaugaacgaggaccacugguucucucgggaaaauucacugaguggggucgagggagaagguuuacauaaacugggcuauauuuugagagauaucuccaagauuccagggggaaacauguacgccgacgauacugcuggcugggacaccaggaucacggaggaugaccuccagaaugaggccaaaauaaccgauaucauggaacccgagcacgcacugcuagcuacaagcauuuuuaagcuuacuuaucagaacaaagugguucgcgugcaaagaccugccaagaacgguaccgucauggacgugaucucucggagggaucagcgugggucgggacagguaggcacauacggccugaauacuuucaccaacauggaaguucagcucauucgacaaauggagucagaagggaucuuucugccaagcgaguuggagacgcccaauuuagcugaacgcgugcuggacuggcucgagaagcauggagccgaaagacuuaaacggauggcaauauccggugacgauugugucgugaagccgauugacgauagguucgcgacagcccugaccgcucuaaacgacaugggcaaagugcgcaaggauaucccucagugggagcccaguaaaggguggaaugacuggcagcaggucccauuuugcucucaccacuuccaucaacugaucaugaaggauggaagagaaauuguugugccuugucggaaccaggacgagcucguaggcagggcccgagugagccagggugcagggugguccuugcgugagacugcuugccugggaaagucauaugcccaaauguggcagcuuauguacuuucacagacgcgaucugcggcucgcagccaaugcgauauguagugcuguccccguggacuggguuccaacaucuaggaccacuuggagcauccaugcccaccaccaguggaugaccacagaagauauguuauccguguggaacagagucuggauugaggaaaaucccuggauggaggacaaaacgcaugugucaagcugggaagagguaccuuaucugggcaagcgcgaggaccaguggugcggcucuuugaucgggcugaccgcacgggccacuugggcuacaaacauucaaguugccaucaaucaggugaggcgacucauaggaaacgaaaauuaccuugauuacaugaccuccaugaaaagauucaagaacgagagugacccagaaggugcacugugguga

SEQ ID NO: 13438 - RNA, 9879 nt, Artificial Sequence
  derived and/or modified CDS sequence (opt3) from DENV-1__KF973465__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauggguggcguguuuacgagcgucgggaaauuggugcaucagguauucggaaccgcauacggcgugcucuuuuccgguguuucuuggacuaugaagauugggaucggcauucuguuaacauggcugggacuaaauagccggucaaccagucucuccaugacauguauagcggucggcauggugacucuguaccuuggggugaugguccaagcugacagcggaugcguuaucaacuggaaaggccgagaauugaagugugguucugggauuuucgugaccaacgaggugcacacguggacagaacaguauaaguuucaggccgauucaccgaaacgccugagugcagccaucggaaaggcuugggaggagggcguaugcgguaucagaagcgccaccaggcucgaaaauauuauguggaaacagauauccaacgagcugaaucauaucuuacuggaaaacgacaugaaguucacugucgugguuggcgacgcaaaugggauucuugcucaaggaaaaaagaugauccggccucagcccauggagcacaaauacucuuggaagucguggggcaaggccaaaauuaucggggcggauauacagaacaccacauuuaucauugacggaccagauacuccugaaugucccgacaaucagcgcgccuggaacaucugggagguggaggauuauggcuucgguauuuuuaccacaaauaucugguugaagcucagagacagcuacacgcaaaugugcgaucacaggcugauguccgcugcaauaaaagacucaaaggccguccaugcugauaugggguauuggauugaaagugagaaaaacgaaaccuggaagcuagcccgugcaucuuucaucgaggugaagacuuguacauggccaaaaagccacacccugugguccaauggaguucucgaaucagagaugauuauccccaagauauacggcgguccuaucagccagcauaacuaucggccaggcuacuucacucagacagcggggccguggcaccugggaaaacuugaguuggacuuugaacugugcgagggcaccacggugguagucgaugaacacugcgggaaucgaggacccucuuuaagaacuaccacagugaccggcaagauuauccaugagugguguugcagguccuguacucucccuccacugcgcuuccggggugaggacgggugcugguacggaauggaaauuagacccgugaaagagaaggaagagaaccuugucaggaguaugguuagcgccggcucuggugaaguggauuccuuuucacugggcaucuugugugcuaguauaaugauugaggagguaaugcgcagccgauggucgcggaagaugcucaugacagggacccuggccguguuccuacugcucaucaugggacaacugacauggaaugaccuuauccguuugugcauuauggucggcgcaaacgcuuccgacagaauggggaugggaacuaccuaucuggccuuaauggcaacguuuaaaaugaggccuauguucgccgugggccuccuguuucgccggcuuacaucuagagaaguucugcuacucaccaucggucugagcuugguggcuucagucgagcugccaaacaguuuagaagagcucggggauggacuggcgaugggcauuaugaugcuuaagcuguugacugaauuccagccccaccagcucuggaccacacugcuaucccugacuuuuauaaaaaccacgcuuucucucgacuacgccuggaagacaaccgcaauggcucugagcaucauuuccuuguucccgcuguguuuaucaacuacaagccagaaaaccacuuggcucccugugcugcuuggcaguuuugggugcaagccacugacaauguucuugaucaccgagaauaagauuuggggaaggaaaucuuggccccucaacgaggguaucauggccauaggcaucguuuccauucugcuaagcucgcugcuuaagaaugaugugccucucgccgggccccugaucgcuggaggcauguugauugcauguuaugucaucucagguucuagugccgacuuaucccuggaaaaagcggcugagguaagcugggaacaagaggccgaacauucugggacgagccacaacauacucguggagguucaggaugacggaacuaugaagauuaaagaugaggaacgagacgauacccugacaauccuucugaaggcaaccuugcuagccguguccggcgucuacccaaugucaaucccugcuacacuguuugugugguauuucuggcagaaaaagaagcagcgcaguggcguacucugggacacucccagcccaccggagguggaacgggcaguccuggaugacgggauuuacagaauacuucaaaggggauuacugggucguucucagguuggcguggggguguuccaggauggagucuuucauaccauguggcacgugacgcgcggcgccguucucauguaucaggguaaacgguuggagccuuccugggcgucaguaaagaaagaccugaucaguuacgggggaggcuggagauuccaaggcagcuggaauacaggggaggaagugcaggucauugcuguggagcccggaaagaacccaaaaaauguucagacuacccccgguacauuuaagaccccugaaggcgaggugggggccaucgcacucgacuucaagccaggaacuuccggcucucccauugucaacagggaagguaaaaucguggggcuguacggaaauggcguagucaccacaucgggcacguaugugagcgccauagcucaagccaaggcaucacaggaggggccucuuccggagaucgaagaugagguuuuuaaaaagcgaaaccugacuauuauggacuugcacccaggauccgguaaaacccggcgcuaccuacccgcuaucgugagagaagccauuaagaggaagcugcggacacucaucuuagcgccuacccgagucguggccagugagauggcagaagcucugaaaggcaugccaauaagauaucagacuacagccguuaagucugagcauaccgggcgcgagauuguggaucuuaugugccacgcuacguucacuaugaggcugcucagccccguccgugugccuaauuacaacaugaucaucauggacgaagcacauuuuacagauccggccuccauugccgcucggggauauaucucaaccagaguaggcaugggugaggcggcagccauauucaugaccgcuacucccccagggucuguggaagccuuuccucagagcaaugcaguuauucaagacgaggaaagggauauccccgagcgcaguuggaacuccggauacgacuggauuacagauuucccaggcaaaaccgucugguuugugccuagcaucaagucuggcaaugacauagccaacuguuugcgaaaaaacgggaagagagugauucagcugucacggaagacauucgauacugaguaucagaaaacgaagaauaacgacugggacuacgucguaaccacagauaucuccgaaaugggagcuaauuucagggcggaccgcgugaucgauccccguagaugccucaaaccaguuauucugaaggacgguccggagcgggugauccuugccggcccuaugcccgucacuguggcaagugcugcccagaggcgcgggcgaauuggaagaaaccaaaauaaagaaggcgaucaguacguuuauaugggucagccacuaaacaaugacgaggaucacgcacauuggaccgaggccaagaugcuguuggacaacauaaauacacccgaagggaucauuccugcuuuauuugagccagaacgggagaagagcgccgcgaucgauggcgaauacaggcugcgcggagaggcaagaaaaaccuucguggagcucaugaggcggggcgaccugcccgucuggcuuucguauaagguggccucugaaggguuucaguacuccgaucgucgcuggugcuucgacggagagcgaaacaaucaaguacuggaagagaacauggauguggaaaucuggacuaaagagggugagagaaagaaacucaggccucggugguuggacgcucgcacguauagcgacccgcuggcccuaagagaauuuaaggaguucgcugcaggcaggcggucaguuaguggggaucugauucucgaaauaggaaaacuuccacagcaccugaccuuacgagcccagaaugcuuuggacaaccuggucaugcuccacaauucugagcagggcgguaaggccuacagacaugcaauggaagagcugcccgauacaaucgagacucuuaugcugcucgcguugauugccgugcugaccgggggcgugacauuauuuuuccuauccggaaagggccuggggaaaaccagcaucggacuccuuugugucacugcuucaagugcccuguuguggauggcaagcguugaaccucacuggauugcugccuccaucauacuggaguuuuuccucauggugcugcuuauccccgaaccagaccgccaaaggacaccucaggauaaccagcucgcauauguagugauuggucuguuguuuaugauccugacggucgccgcuaacgagaugggcuuacuagagaccacuaagaaagaccuggggauuggacauguggcggccgaaaaucaccaacacgcaacaaugcucgauguugaccuucggcccgcuucugccuggacccuguacgccguggcaaccacagucaucacuccaaugaugcgucauacgauagagaacaccacagcuaauauuagcuugacugccaucgcgaaccaggcugccauucugaugggccucgauaaggguuggccuaucuccaaaauggacauagggguaccgcugcuugcauuaggcugcuacucacaggugaauccccugacccucacagccgcuguuuugaugcugguggcacacuaugccaucauuggaccaggccuacaggcgaaggcuaccagagaagcccaaaagaggacugcagccgggaucaugaaaaacccuacggucgauggaauuguggcuaucgaccuggaucccgucguguacgacacaaaguucgagaaacagcucggccagauaaugcuucugauuuuguguaccucucagauccugcucaugcgcacuaccugggcccugugcgaaaguaucacauuagcaacugguccacuuaccacacugugggaggggucgccuggaaaguuuuggaauacgaccauugcuguuagcauggccaacaucuuccggggcuccuaucucgcgggugccggccuagcauucucucugaugaaaucauuggggggaggccgaagagggacuggagcucaaggcgagacacugggugaaaaguggaagaggcagcucaaucagcuuagcaaauccgaguuuaacauauacaagcgcagugggauuauggaaguggaccggucugaggccaaagaaggacugaagagaggcgagaccacuaaacaugcaguaagccgugguacagcuaaguugaggugguucguggagcggaaucuggucaagcccgaaggcaaaguuaucgaucucggguguggacgcggcggguggucauauuacugcgccggauuaaagaaagugaccgaggucaagggcuauacgaaaggugggccgggacacgaagagccaauuccuauggccaccuacggcuggaaccuggugaagcuucauuccggcaaagacguauuuuucaugcccccagaaaagugugauacacugcuaugcgacaucggggagaguagccccaauccuacuauagaggaaggacgaacccucagagugcugaagaugguugagccgugguugagggguaaccaguuuuguaucaaaauucugaaucccuacaugccaucuguggucgaaacacucgagcaaaugcagcggaaguauggcgggaugcuugugcgcaacccucuguccagaaauucaacucacgagauguacugggucagcugcggaaccggcaacaucgugucggcgguuaacaugacaucuaggauguuacugaaucgauucaccauggcucaccggaaacccacuuaugaacgugauguagacuugggugcagggacgagacauguggccgucgagccugaaguggcuaaccucgauauuaucggacagcgcauugagaauaucaagaacgaacacaaaaguacauggcauuacgacgaggauaauccauauaagaccugggccuaccacggcuccuaugagguuaagcccagcggcucagcauccucuauggugaacggggucgugaggcugcuaacuaaaccuugggacguaauaccaauggugacccaaauugccaugacagauacgacccccuuuggacagcagcggguuuucaaggaaaaagucgacacuagaacaccgcgcgcuaagagggguaccacucagaucauggaggugacagcgaaauggcuuuggggcuuucugagccgaaauaagaagccucggaucuguaccagagaagaguucacaaggaaagugcgcaguaacgccgcaauuggggcugucuuuguugacgaaaaucaauggaacuccgccaaggaggcaguggaggaugaacguuucugggaccucguacggagagagagggaacugcacaaacagggaaagugcgccacuugcguguacaauaugaugggcaaacgcgagaagaaguugggugaauuugggaaagcuaagggaagccgagccauaugguacauguggcugggcgcgcgguuccucgaguucgaggcacuuggcuuuaugaacgaagaucauugguucucuagagagaauucacugaguggggucgaaggagaggguuuacacaaacugggcuauaucuugagggacauuuccaagaucccagggggaaacauguacgccgaugacaccgcuggcugggauacgcgcauuaccgaggacgaucuccagaaugaagccaaaaucacagacauaauggagcccgaacaugcacugcuagcuacuagcaucuuuaagcuuaccuaucagaacaaagugguuagagugcaacggccugccaagaacgguacagucauggaugugauuucuaggcgugaccagcgagggucgggacagguaggcacuuacggccugaauaccuucacgaacauggagguucagcucauccgccaaauggaaucagaggggauuuuucugccaagcgaguuggaaacacccaauuuagcugagagagugcuggauuggcucgaaaagcacggagccgagcggcuuaaaaggauggcaaucuccggugacgacugugucgugaagccgauagaugaccgcuucgcgaccgcccugacugcucuaaacgauaugggcaaagugagaaaggacauuccucagugggaacccaguaaaggguggaaugauuggcagcaggucccauuuugcucucaucacuuccaccaacugaucaugaaggacggacgggagaucguugugccuuguaggaaccaggaugagcucguaggccgagcccgugugagccagggugcagggugguccuugagagaaacagcuugccugggaaagucauaugcccaaauguggcagcuuauguacuuucaucgccgggaccugaggcucgcagccaaugcgauuuguagugcuguccccguggauuggguuccaaccucuagaacuaccuggagcauacacgcccaucaccaguggaugacaacggaggacauguuauccguguggaaccgcgucuggaucgaagagaaucccuggauggaagauaaaacccacgugucaagcugggaggagguaccuuaucugggcaagcgggaagaccaguggugcggcucuuugauugggcugacugcaagggccacaugggcuaccaacauccaaguugccauuaaucaggugcgaagacucaucggaaacgagaauuaccuugacuacaugacuuccaugaaacgguucaagaacgaaagugauccagagggugcacugugguga

SEQ ID NO: 13439 - RNA, 9879 nt, Artificial Sequence
  derived and/or modified CDS sequence (opt3) from DENV-1__KF973466__SS-prME
agcgugaccaugcugcucaugcuuaugcccacagcccuggcuuuccacuugacuacgagaggcggggaaccucauaugaucgucuccaagcacgaaagaggaaaagcauuacuguuuaagaccucuacagguguuaacaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacagacuggagagcaucgccgagacaagcguaguguggcccuugcaccccacgucggccuggguuuggagaccagaacagaaacuuggaugagcuccgagggggccuggaaacaaauccaaaggguggaaaccugggcucuccggcauccuggauucacaguuauugcacuguuucuggcccacgcuaucggcaccucuauuacgcagaagggcaucauauucauccucuuaaugcuggugacuccaucgauggccaugcgcugcgucgggauuggaaacagagauuuuguggagggucuuucaggcgcgacauggguagacguuguguuggagcacgggagcugugucaccacuauggcaaagaauaaacccacacuggauaucgaacuacucaagaccgaggugacgaacccugccgugcugaggaaacuuugcauugaagcuaagaucaguaauaccacaacugacucccgguguccaacccagggagaggccacacuggucgaagaacaagaugcaaacuucguuugccgccgaacuuuuguggacagaggcugggguaauggguguggauuguucggcaaaggcucucuccugaccugcgcuaaguuuaagugcguaacaaaauuagaggggaagauagugcaguacgaaaaccugaaauauagcgucauugugaccguucauacuggagaucagcaccagguggguaaugagacgacagaacauggcaccaucgccacuauuaccccacaagcgccuacauccgagauccagcucaccgacuacggggcccuuacucuggacuguucaccaaggacaggauuggauuucaacgaaaugguccuacugacgaugaaggagaaaaguuggcucgugcacaagcagugguuucuggaccuuccgcugcccuggaccagcggcgcaucuacuucccaggagacauggaaucggcaagauuugcucguaaccuucaaaacagcucacgccaagaagcaggaaguugugguccuggguucacaggagggggcuaugcauacugccuuaaccggcgcaacggaaauccaaaccagcggaacaacuaccauuuuugccggccaccugaaaugccgucuaaagauggacaaacucacacugaaggggacaaguuaugugauguguaccggaucuuucaaacuugagaaggaagucgcugagacgcagcaugguacaguguugguucaggugaaguacgagggcaccgaugcgccuugcaaaauaccauucuccacucaggacgaaaaggggguaacacaaaacggacgccugaucaccgcaaaucccauugucacugauaaagagaagccugugaacaucgaaaccgagccacccuuuggcgagagcuauauaguugugggugccggggaaaaagcucucaagcugucgugguucaagaaaggaucuuccauuggaaagauguuugaggccacagcaagaggcgccaggcggauggcuauccuuggggacacggccugggauuucggaucaaucgguggcgucuuuaccaguguggggaaacugguacaccagguguucggaacugcauacggcguuuuguuuagcggugucuccuggacaaugaagauugggaucggcauucuccugaccugguuaggacuaaauucucgaagcacaucacuaaguaugacuuguauagcggugggcauggugacccucuaccugggggucaugguucaggcugacuccggaugcgugaucaacuggaaaggccgcgaacuuaagugugguagcgggauuuucgugacgaacgagguacauacauggaccgaacaguauaaguuucaagccgauucuccgaaaagauugucagcagccaucggaaaggcuugggaggagggcgucugcgguaucaggagugccacucggcuggaaaauauuauguggaaacagauaagcaacgagcucaaucacauccuguuagaaaacgacaugaaguucaccgugguugugggcgacgcaaaugggauucuggcucagggcaagaagaugauccgcccucagcccauggagcacaaauacuccuggaagucuuggggcaaggccaaaauuaucggggcggauauacaaaacacaacuuuuaucauugacggaccagauaccccugaaugucccgacgaucagagagccuggaauaucugggaggucgaggacuauggcuucgguauuuuuacaacgaacaucuggcuuaaguugagggauucguacacccagaugugcgaccaucgucucaugagcgcugcaauaaaagauuccaaggccgugcacgcugacaugggguauuggauugaaucagagaaaaaugaaacuuggaagcuggcccgggcaaguuucaucgagguuaagacauguaccuggccaaaaucucauacucuauggagcaacggagugcuggaauccgagaugauuauccccaagauauacggcgguccuaucucacagcacaauuaucgaccaggcuacuucacacaaaccgcggggccguggcaccucggaaaacuggagcuugauuuugacuugugcgaaggcacgacuguagucguggaugagcauugcgggaacagaggacccagccugaggaccacaaccgugacuggcaagauuauccacgaaugguguugccgcucuuguacauuaccuccacuccgguucagaggugaggacgggugcugguacggaauggagauuaggcccgucaaagaaaaggaggaaaaucugguucgcuccauggugagugccggcagcggugagguagacucuuuuucccuuggcauccugugugugucaauaaugauugaagaggucaugcgaagucgguggagccguaagauguugaugaccgggacacucgcuguguuccugcuacugaucaugggacagcucacuuggaacgaucugaucagacuuugcauuaugguuggcgccaaugcaucggacaggauggggaugggaaccacguauuuggcucugauggccacauuuaaaaugcgcccuauguucgcagugggcaucuuauuucggagacucaccuccagggagguccugcuucugacuauuggucuaucucucguggccagcguugaacugccaaacucauuggaggaacugggggauggauuagcuaugggcauaaugaugcucaagcugcuuaccgaguuccagccccaucaacuguggacaacuuugcucagucugaccuuuaucaaaacgacacuaucccuggacuacgcguggaagaccacugccauggcacuuucuauugugagccucuucccgcuguguuuguccacaaccucacagaaaacuacauggcugccugucuuacucggcagcuuugggugcaagccacugaccauguuccuuaucacggaaaacaagauuuggggacgaaaaaguuggcccaucaaugaggguauaauggcuaucggcauuguaucuauccuguuguccagccuccugaagaacgaugugccucuagccgggccccugauugccggaggcaugcuuaucgcuuguuauguuauaucggguucaucugcagaccucagucuggagaaagccgcggaaguguccugggagcaggaagcugagcacagcgggacuucucauaauauuuuggucgaagugcaggaugacggaaccaugcgcaucaaggaugaggagaaagacgauacauuaaccauccugcucaaggccacacugcuugcaguaagcggcguguacccaauguccauuccugccacucuguuugucugguauuucuggcagaaaaagaagcagcggucaggcguuuugugggacacccccaguccaccggaaguggagagagcugugcuagaugacgggauauacaggauccugcagcguggacuccugggucgcagccaggucggcguggggguuuuccaagacggaguauuucacacgauguggcacgugacacggggcgcaguccuuauguaucaggguaaaagauuagaaccuucuugggccuccgugaagaaagaucugauuucauacgggggaggcuggagguuccagggcaguuggaacacuggggaggagguucaggugaucgcggucgaacccggaaagaaucccaaaaacgugcaaaccacacccgguaccuuuaagacuagcgagggcgaaguaggggcuauugcccucgacuucaagccuggaaccuccggcucuccaaucgucaaucgagaggguaaaauagugggguuguacggaaacggcguugugacaacgucgggcacuuaugucagcgcaaucgcccaggcuaagaccucacaggaagggccccugccugagauugaggaugaaguguuuaaaaagcggaaucucacaaucauggaccugcauccgggauccgguaaaacccgcagauaccuuccagccauuguuagggaggcaaucaagcggaagcugcgaacuuugauacuagcucccacaagaguggucgccagugaaauggcggaggcccugaaaggcaugccuauucgcuaucaaaccacggcagugaagucugaacacacugggagggagaucguagaucucaugugccaugcuacauucaccaugcguuuacugagcccagugcggguucccaacuacaauaugaucauuauggacgaggcccacuuuaccgauccugcuuccaucgcagccagaggauauauaucaacuagggucggcaugggugaagccgcugcgauuuucaugacagcaaccccgcccgggucuguggaggccuuuccacagagcaacgcugugauccaggacgaagaacgcgauauuccugaacgaaguuggaacuccggauacgacuggaucacagauuuccccggcaaaacugucugguuuguaccaagcauaaagucuggcaaugacauugccaauugucuuaggaaaaacgggaagcgggugauccagcugucaaggaagacguucgacaccgaguaucagaaaacuaagaacaaugauugggacuacguugugacuaccgauaucuccgagaugggagcaaacuuccgcgccgaccgugucauugauccuagacggugccucaaacccgugaucuugaaggacgguccagaaaggguuauucuggcuggcccgaugccugugacagucgcgagugccgcacaacgccgagggagaauaggacggaaucagaacaaagagggcgaucaguacguguauaugggucaaccccucaauaacgacgaagaucaugcucacuggaccgaggccaagaugcugcuugacaauaucaacacuccagaggggauuauccccgcacuauuugaaccugagagggaaaagagcgccgcuaucgauggcgaguaccgccugagaggagaagccaggaaaacguucguagaguugaugcggcguggcgacuuaccaguguggcugucguauaagguugcgucugagggguuucaguacuccgaucgccgauggugcuucgacggagaaagaaauaaccagguccucgaggaaaauauggacguggagauuuggaccaaagaaggugagaggaagaaacugcggccccgcuggcuugaugcaagaacauauagcgacccucuggcccucagggaguuuaaggaguucgcugccggccggcgaucagugaguggggauuugauacuggagaucggaaaacuaccgcagcaccugacucucagagcucaaaacgcacuugacaaucuggucauguuacauaacucugaacagggcgguaaggccuaccgccacgcuauggaggaauugccagauaccauugagacacugaugcuccuggcccuuaucgcaguucugaccgggggcgugacucucuuuuucuuguccggaaagggccuggggaaaacaagcauuggauuacuauguguaacggcgucaagugcccugcucuggauggcuagcguggagccccauuggaucgccgcauccauaauccuugaauuuuuccugauggucuugcugauuccugagcccgacaggcagcggaccccacaggauaaucaacucgcuuaugugguuaucggucugcuuuuuaugauucucacuguggccgcaaacgaaaugggccuguuggagacaaccaagcgugaccuggggaucggacacgucgccgcugagaaccaccagcaugcgaccauguuagauguagaccuaagaccugccucugcauggacacuguacgcuguggccacuacgguuauaacccccaugaugaggcacacaauugaaaauacuaccgccaacaucagccucacagcaauugcuaaucaggccgcgauccuuaugggccuggauaaagguuggccaauauccaagauggacaucggggugccuuugcuggcucucggcugcuacucacaagucaacccgcugacccuuacugccgcaguguuaaugcuggucgcccauuaugcuauuaucggacccggccuccaggcaaaagccacgcgcgaggcgcagaagcggacagcugccgggauuaugaagaauccaaccguggauggaaucguugcaauagacuuggacccugugguauacgaugccaaauucgaaaagcagcugggccaaauuaugcuacugauccucuguacuucucagauccuucugaugcgaaccacaugggcuuugugcgagaguauuacucuggccaccgguccccucacaacgcugugggaagggucgccaggaaaauuuuggaacaccacuaucgcagugagcauggcuaauauauucagaggcuccuauuuagccggugcgggccuugccuucucucugaugaagucacucgggggaggcaggcgcgggacaggagcacagggcgagacccuaggugagaaauggaagcggcagcugaaccaauugagcaagccugaauuuaauacuuacaaaagauccgggauuauggaggucgaccguagugaagcuaaggagggacugaaaaggggcgaaacaaccaagcacgccguuucucgggguacggcaaaacuccgcugguucguggagcgaaaccuugucaagcccgagggcaaggugaucgaucugggguguggaagaggcggguggagcuauuacugcgcuggauugaaaaagguaaccgaagugaaaggcuauacaaagggugggccgggacaugaggaaccaauuccuauggccacuuacggcuggaaucugguuaaacuccacucaggcaaggacguguuuuucaugcccccagagaaaugugauaccuuacugugcgacaucggggaauccagucccaacccuacaauagaggagggaaggacucuucggguccugaagaugguggaaccguggcuacgcgguaaucaguuuuguaucaagauucucaaccccuacaugccaagcgucguggagacccuggaacagaugcagagaaaacacggcgggauguugguuaggaauccucugucucgaaacuccacacaugagauguauuggguaucaugcggaaccggcaauaucgugagcgccgucaacaugacuucgcggaugcuccuuaaccguuucacgauggcgcacagaaagcccacauacgagcgcgauguggaccugggugcugggaccaggcauguugcaguggaaccugaggucgccaauuuagauauuaucggacaacggauugaaaacaucaaaaaugagcacaagucuacuuggcacuaugacgaagauaacccauacaaaaccugggcuuaucauggcaguuacgaggugaagcccuccggcagcgccucauccaugguaaauggggugguuagacuguugacaaagccuugggacgucauaccaauggugacgcagauugcaaugaccgacacuacacccuuuggacagcaacgcguguucaaagagaaggucgauaccaggacuccgcgagccaaacgggguacaacccagaucauggaaguuacagcuaaguggcucuggggcuuucugucuagaaacaaaaagccuaggaucuguacucgcgaggaguucacccguaaggugcggagcaaugcggccauuggggcaguauuuguggacgagaaccaguggaauagugcuaaagaagccgucgaggaugagagauucugggaccuagugcacagggaacgcgagcuucauaagcagggaaaaugcgcaacgugcguuuauaacaugaugggcaagcgagagaaaaagcugggugaguuugggaaggccaaaggaucccgggcuauaugguacauguggcucggcgccagauuccuggaguucgaggcguugggcuuuaugaaugaggaucacugguucagcagggaaaacucucugucagggguggagggagaaggucuccauaaacuuggcuacauccugcgcgacauuaguaaaaucccagggggaaauauguaugcagaugacaccgccggcugggauacaagaauuacugaggacgauuuacaaaacgaggcuaagaucaccgacauaauggaacccgagcacgcccuguuggcaacauccaucuuuaaacucacuuaccagaauaaggucgugcggguacagaggccugcuaaaaacgguaccguuauggaugugauuagccgucgagaccagcgcgggucuggacaagucggcacguauggccugaacacauucaccaauauggaagugcagcuaaucagacagauggagucggaagggauuuuucuuccaucagagcuggagacucccaaccucgccgaacgggugcuggacugguuggagaagcacggagcugaaagguuaaagcgcauggccaucagcggugaugacugugucguuaaaccgauagaugacagauucgcaacagcgcugaccgcccucaaugauaugggcaaggugcggaaagacauuccucagugggagcccuccaagggguggaacgauuggcaacagguaccauuuugcagucaucacuuccaucagcuuaucaugaaagacggaagggaaaucguggucccuugucgaaaucaggaugagcuggugggccgugcuagaguuucucaaggugccggguggagccuacgcgagacugcaugccugggaaaguccuacgcucagauguggcagcucauguauuuucaccggagggacuugagacuggccgcaaacgccauuuguucagcggugcccgucgauugggugccaaccagucgcacaacguggucuauacacgcucaucaccaauggaugaccacugaagacaugcuuagcguauggaaucggguuuggaucgaggaaaaccccuggauggaggacaagacacauguguccucaugggaagaggucccuuaccugggcaaaagggaggaucaguggugcggcagccucauuggguuaaccgcccgagcaacuugggccacaaauauccagguggcuauuaaccagguuagacggcugaucggaaaugaaaacuauuuggacuacaugaccucuaugaagagguucaaaaaugaguccgauccagaaggugcccugugguga

SEQ ID NO: 13440 - RNA, 9879 nt, Artificial Sequence
  derived and/or modified CDS sequence (opt3) from DENV-1__KF973471__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacaaauaacagaggcggaaccggacgauguggacuguuggugcaaugcuaccgauacuuggguaacauaugggaccuguagucagacgggagagcaccggcgcgacaagcgaagcguggcccuggcaccccaugucggcuugggucucgagacucguaccgaaacauggauguccucugagggggccuggaaacagauccagagaguggaaacuugggcucugaggcacccuggauucaccguuauugcacuguuucucgcccaugcuaucggcacaucgauuacccaaaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggcaaagaauaaacccacucuagauaucgaacuccugaagacagaggugaccaacccugccauucuuagaaaacugugcaucgaagcuaagauauccaauacgaccacagacucuagguguccaacucagggagaggccaccuugguggaagagcaggaugcaaacuucgucugccggcgcacauuuguugaccgaggcugggguaauggguguggacucuucggcaaaggcagccuguuaacuugcgcuaaguuuaagugcgugaccaaacuggaggggaagauuguacaguacgaaaaccucaaauauuccgugaucgucacagugcacaccggagaucaacaucagguugguaaugagacuacggaacacggcacaauugccaccaucacuccccaggcgccuaccucagagauccagcuuacagacuacggggcccugaccuuggacuguaguccaagaacuggacuagauuucaacgaaauggugcugcucacaaugaaggagaaaagcuggcugguccauaagcaaugguuucuugaccugccguugcccuggacgucuggcgcauccaccucacaggagacuuggaauaggcaggaucuccuggugacauucaaaaccgcucacgccaagaagcaagaaguaguuguguuagguagccaggagggggcuaugcacacagcccugacuggcgcaaccgaaauucagacgaguggaaccacaacuauauuugccggccaucuaaaaugccggcucaagauggacaaacugacccuuaaggggacaucuuaugucauguguacuggauccuucaaauuggagaaggaaguggcugagacccagcacgguacgguccuggugcaaguuaaguacgagggcacagaugcgccuugcaaaaucccauucagcacccaggacgaaaagggggugacucagaacggacgucucauuacagcaaaucccaucguaaccgauaaagagaagccugucaacauagaaacugagccacccuuuggcgagucguauauugugguuggugccggggaaaaagcucugaagcuuucuugguucaagaaaggcuccucaaucggaaagauguuugaggccaccgcacgcggcgccagaaggauggcuauccugggggacacagccugggauuucggaaguauugguggcguguuuacgagcgucgggaaauuggugcaucagguauucggaaccgcauacggcgugcucuuuuccgguguuucuuggacuaugaagaucgggauuggcauacuguuaacauggcugggacuaaauagccggucaaccagucucuccaugacauguaucgcggucggcauggugacucuguaccuuggggugaugguccaagcugacagcggaugcguuauuaacuggaaaggccgagaauugaagugugguucugggaucuucgugaccaacgaggugcacacguggacagaacaguauaaguuucaggccgauucaccgaaacgccugagugcagccaucggaaaggcuugggaggagggcguaugcgguauuagaagcgccaccaggcucgaaaauauaauguggaaacagaucuccaacgagcugaaucauauuuuacuggaaaacgacaugaaguucacugucgugguuggcgacgcaaaugggauccuugcucaaggaaaaaagaugauucggccucagcccauggagcacaaauacucuuggaagucguggggcaaggccaaaaucauaggggcggauauccagaacaccacauuuauuaucgacggaccagauacuccugaaugucccgacaaucagcgcgccuggaacauuugggagguggaggauuauggcuucgguaucuuuaccacaaauauaugguugaagcucagagacagcuacacgcaaaugugcgaucacaggcugauguccgcugcaauuaaagacucaaaggccguccaugcugauaugggguauuggaucgaaagugagaaaaacgaaaccuggaagcuagcccgugcaucuuucauugaggugaagacuuguacauggccaaaaagccacacccugugguccaauggaguucucgaaucagagaugaucauacccaagaucuacggcgguccuauuagccagcauaacuaucggccaggcuacuucacucagacagcggggccguggcaccugggaaaacuugaguuggacuuugaucugugcgaaggcaccacggugguagucgacgagcacugcgggaaucgaggacccucuuuaagaacuaccacagugaccggcaagaucauucaugaaugguguugcagguccuguacucucccuccacugcgcuuccggggugaggaugggugcugguacggaauggagaucagacccgugaaagaaaaggaggaaaaccuugucaggaguaugguuagcgccggcucuggugagguggacuccuuuucacugggcauauugugugcuaguauuaugaucgaagagguaaugcgcagccgauggucgcggaagaugcucaugacagggaccccugccguguuccugcuacugaucaugggacaacucacauggaaugaccugauucgucuuugcaucauggucggcgcaaacgcuuccgauagaauggggaugggaacuaccuauuuggcccugauggcaacguuuaaaaugaggccaauguucgccgugggcuuacucuuucgccggcugacaucuagagagguucuucugcuaaccauuggucucagccugguggcuucagucgaauugcccaacagucuggaggaauuaggggacggacucgcgaugggcauaaugaugcugaagcuucugacugaguuccagccgcaccaguuguggaccacacuccugucccuaacuuuuaucaaaaccacgcugucucuugauuacgccuggaagacaaccgcaauggcucucagcauuaucucccuguucccuuugugucugucaacuacaagccagaaaaccacuugguuaccagugcuccugggcaguuuugggugcaagccccuuacaauguuccugauuaccgaaaauaagaucuggggaaggaaaucuuggccuuugaacgaggguauaauggccaucggcauuguuuccauccuccugagcucgcuacugaagaaugacgugccccuugccgggccacucacggcuggaggcaugcugauugcauguuaugucaucucagguucuagugccgauuuguccuuagagaaagcggcugaaguaagcugggagcaagaagccgagcauucugggacuagccacaacauacugguggaaguucaggacgauggaaccaugaagauuaaagacgaggagcgagaugacacacucaccauccugcuuaaggcaacacuguuggccguguccggcgucuacccuaugucaauccccgcuacucuauuugugugguauuucuggcagaaaaagaagcagcgcaguggcguacugugggauaccccaagcccgccugaaguggagcgggcaguccucgacgaugggauuuacagaauacugcaaaggggacuuuuaggucguucucagguuggcguggggguguuccaggacggagucuuucauacgauguggcacgugacacgcggcgccguucugauguaucaggguaaacggcucgaacccuccugggcgucaguaaagaaagacuugaucaguuacgggggaggcuggagauuccaaggcagcuggaauacuggggaggaggugcaggucauugcuguggaaccaggaaagaaccccaaaaauguucagaccacaccugguaccuuuaagacuccagagggcgaagugggggccaucgcacuggauuucaagcccggaaccuccggcucuccuauugucaacagggaggguaaaaucguggggcucuacggaaauggcguagucacaacgucgggcacuuaugugagcgccauagcucaagccaaggcaucacaggaagggccgcugccagagaucgaggacgaaguuuuuaaaaagcgaaaccuuaccauuauggaucugcaccccggauccgguaaaacacggcgcuacuugccugcuaucgugagagaggccauuaagaggaagcuacggacccugauccucgcgccaacucgagucguggccagugaaauggcagaggcuuuaaaaggcaugcccauaagauaucagacaaccgccguuaagucugaacauacggggcgcgagauuguggaccugaugugccacgcuacuuucacaaugaggcuucugagcccuguccgugugccgaauuacaacaugaucaucauggaugaggcacauuuuaccgaccccgccuccauugccgcucggggauauaucucaaccagaguaggcaugggugaagcggcagccauauucaugacugcuacaccaccugggucuguggaggccuuuccccagagcaaugcaguuauucaagaugaagagagggacaucccagaacgcaguuggaacuccggauacgauuggauuaccgacuucccuggcaaaacagucugguuugugcccagcaucaagucuggcaaugauauagccaacugucuccgaaaaaacgggaagagagugauucaguugucacggaagacuuucgacacggaguaucagaaaaccaagaauaacgacugggauuacgucguaacaacugacaucuccgagaugggagcuaauuucagggcggaucgcgugaucgacccacguagaugccugaaaccgguuauucucaaggaugguccugaacgggugauccuggccggccccaugccagucaccguggcaagugcugcccagaggcgcgggcgaauuggaagaaaccaaaauaaagagggcgaccaguacguuuauaugggucagccccuuaacaaugaugaagaccacgcacauuggacagaggccaagaugcuacuggauaacauaaauaccccugaggggaucauuccagcuuuguuugaacccgagcgggaaaagagcgccgcgaucgacggcgaguacagguuacgcggagaagcaagaaaaacuuucguggagcugaugaggcggggcgaucucccugucuggcugucguauaagguggccucugagggguuucaguacuccgaccgucgcuggugcuucgauggagaacgaaacaaucaaguacuugaggaaaacauggacguggagaucuggacgaaagaaggugagagaaagaaacugaggccgcgguggcucgacgcucgcaccuauagcgauccauuggcccugagagaguuuaaggaauucgcugcaggcaggcggucaguuaguggggaccuaauucuggagauaggaaaacucccccagcaccuuacacugcgagcccagaaugcuuuagauaacuuggucaugcugcacaauucugaacagggcgguaaggccuacagacaugcaauggaggaacucccugacacuaucgagacccugaugcuucuggcgcucauugccguguugacagggggcgugacccuguuuuucuuauccggaaagggccuagggaaaacuagcaucggacugcucugugucacagcuucaagugcccuucuguggauggcaagcguugagccccacuggauugcugccuccaucauauuggaauuuuuccugauggugcuccugaucccagagccugaucgccaaaggacgccccaggacaaccagcuugcauauguagugauuggucuccuguuuaugaucuugaccgucgccgcuaacgaaaugggccuguuagagacuacaaagaaagaucuagggauuggacauguggcggccgagaaucaccaacacgcaaccaugcuggacguugaucuccggccagcuucugccuggacccuuuacgccguggcaacaacugucaucacgccuaugaugcgucauaccauagaaaacacaacugcuaauauuagccugaccgccaucgcgaaccaggcugccauuuugaugggccuggacaaggguuggccgaucuccaaaauggauauagggguaccccuccuggcacuuggcugcuacucacaggugaauccauuaacacugaccgccgcuguucucauguugguggcacacuaugccaucauuggaccuggccugcaggcgaaggcuacuagagaggcccaaaagaggacggcagccgggaucaugaaaaaccccacagucgacggaauuguggcuaucgaucuagacccagucguguacgacaccaaguucgaaaaacagcugggccagauaaugcuccuuauucuguguacuucucagaucuugcugaugcgcaccacaugggcccucugcgagaguaucacucuggcaaccgguccuuuaacaacgcuuugggaagggucgcccggaaaguuuuggaauaccacuauugcuguuagcauggccaacaucuuccggggcuccuaucuggcgggugccggccucgcauucucucuaaugaaaucacuggggggaggccgaagagggacaggagcucaaggcgagaccuugggugagaaguggaagaggcagcugaaucagcucagcaaauccgaauuuaacauauacaagcgcagugggauuauggagguggaucggucugaagccaaagagggacuuaagagaggcgaaacuacaaaacaugcaguaagccgugguaccgcuaagcugaggugguucguggagcggaauuuggucaagccggagggcaaaguuaucgaccugggguguggacgcggcggguggucauauuacugcgccggacucaagaaagugacggaagucaagggcuauaccaaaggugggccaggacacgaggaaccuauucccauggccacauacggcuggaacuuagugaagcugcauuccggcaaagauguauuuuucaugccacccgagaagugugacacucuucugugcgauaucggggaaaguagcccuaauccgaccguggaggagggacgaacacuaagaguucucaagaugguggaacccuggcugaaagguaaccaguuuuguauaaagaucuugaauccauacaugccuucugucguggagacucuggaacaaaugcagaggaaauauggcgggaugcucguccggaacccccuuucccgcaauucaacccacgagauguacugggugagcugcggaacaggcaacauuguuucggcgguaaacaugaccucuagaaugcuguuaaauagguucacuauggcucaccgaaagccuacguaugagcgggacguggaucugggugcagggacacgucaugucgccguggaaccagagguugcuaacuuggacaucauuggacagagaaucgaaaauauuaaaaacgagcacaagaguaccuggcauuacgaugaagacaaucccuauaagacuugggccuaccacggcuccuaugaggugaaaccuagcggcucagcauccucuauggucaacggggugguacgccuccugaccaagccaugggaugugauccccaugguuacacaaauagccaugacggacaccacuccguuuggacagcagagggucuucaaagagaagguggacacacggaccccuagagcuaaacgcgguacuacacagauuauggaagugaccgcgaaguggcuauggggcuuucuuagcaggaauaagaaaccacgaaucuguacacgggaggaauucacuagaaaggucaggaguaacgccgcaaucggggcuguuuuuguggaugagaaucaauggaacuccgccaaagaagcaguagaggacgagcgcuucugggaucuggugcaccgugaacgggagcuccauaagcagggaaaaugcgccaccugcgucuacaauaugaugggcaagagagaaaagaaacugggugaguuugggaaggcuaaaggaagcagggccauuugguacaugugguugggcgcgcgcuuccuggaauucgaggcacucggcuuuaugaacgaggaccacugguucucucgagaaaauucacuuagugggguggagggagaaggucugcauaaguuaggcuauauacugcgggauaucuccaaaauucccgggggaaacauguacgccgacgauacggcuggcugggacaccagaaucacagaggaugacuugcagaaugaggccaagauuacugauaucauggaaccugagcacgcacuccuggcuaccagcauauuuaaacuaacauaucagaacaagguugugaggguccaacgcccagccaagaacgguacugugauggacguaaucucuagacgggaucagagggggucgggacagguuggcaccuacggccuuaauacguucacaaacauggaagugcagcugauucgucaaauggagucagaagggaucuuucuccccagcgagcuggagaccccgaauuuggcugaacgagucuuagacuggcuggagaaacauggagccgaacgccucaagagaauggcaauuuccggugacgauuguguggugaaaccuaucgacgaucgguucgcgacugcccuuacagcucugaacgacaugggcaaggucaggaaagauauaccccagugggagccaaguaagggguggaaugacuggcagcagguuccuuuuugcucucaccacuuccaucaacuaauuaugaaggauggacgcgaaaucgugguacccuguagaaaccaggacgagcuggugggccgggccagggucagccagggugcaggguggucccuccgagagaccgcuugcuugggaaaaucauaugcccaaauguggcagcugauguacuuucaccguagagaucuucgccuggcagccaaugcgaucuguagugcugugccaguugacugggugcccacuucucggaccacauggagcauucaugcccaccaccaguggaugacgaccgaagauaugcucuccgucuggaacaggguguggauagaggaaaauccuuggauggaggacaagacucauguaucaagcugggaagagguuccauauuuaggcaaaagagaggaccaguggugcggcucucugaucggguugacagcacgcgccaccugggcuacuaacauucaaguggccaucaaucagguccggaggcugauuggaaacgaaaauuaccucgauuacaugacauccaugaagcgauucaaaaacgagagugacccggaaggugcacuuugguga

SEQ ID NO: 13441 - RNA, 9879 nt, Artificial Sequence
  derived and/or modified CDS sequence (opt3) from DENV-1__KF973472__SS-prME
agcgugaccaugcugcucaugcuucugcccaccgccuuggcuuuccacuuaacuacgagaggaggggaaccucauaugaucgucuccaagcacgaaaggggaaaaucucugcuguuuaagaccucaacagguguuaauaugugcacucucauugccauggaccugggagaacuuugugaagauaccaugacauacaaaugcccacggauaaccgaggccgaaccggacgauguggacuguuggugcaaugcgacugauacauggguaaccuaugggacguguagucagacuggagagcaucgccgagacaagcguagcguggcucuggcaccccacgucggcuugggucucgagaccagaacagaaacuuggauguccucugagggggcuuggaaacaaauccagaggguggaaaccugggcccugcggcauccuggauucacaguuauugcucuguuucucgcacacgccaucggcaccucgauuacgcagaagggcaucauauucaucuuacugaugcuugugacuccaucaauggcuaugcgcugcgucgggauuggaaacagagauuuuguggaggguuugagcggcgccacauggguagacguugugcuggagcacgggaguugugucaccacuauggcgaagaauaaacccacacuagauaucgaacuccugaagaccgaggugacgaacccugcagugcuuaggaaacugugcauugaagccaagaucuccaauaccacaacugacucucgguguccaacccagggagaggcuacauuggucgaagaacaagaugccaacuucguuugccgccgaacucucguggacagaggcugggguaauggguguggacuguuuggcaaaggcagcuuacugaccugcgcaaaguucaagugcguaacaaaacucgaggggaagauagugcaguacgaaaaccuuaaauauuccgucauugugaccguucauacuggagaucagcaccagguggguaaugagacgacagaacauggcaccaucgcuacuauuacaccccaagccccuacaucagagauccagcugaccgacuacggggcguuggcccuagacuguaguccaaggacuggacuggauuuuaacgaaaugguccuccugacaaugaaggagaaaagcuggcuugugcacaagcagugguuccuggacuugccgcuccccuggacgucuggcgcauccaccucacaggagacuuggaaucggcaagaucuguuaguaacauuuaaaaccgcucacgccaagaagcaggaaguugugguccuggguagccaggagggggcuaugcauacagcccuaacuggcgcaaccgaaauccaaacgaguggaaccacaacuauuuucgccggccaccucaaaugccgucugaagauggacaaacuuaccuugaaggggacaucuuaugugauguguacuggauccuuuaaacuggagaaggaagucgcugagacccagcaugguacggugcucguucaggugaaguacgagggcacagaugcgccuugcaaaauaccauucagcacccaggacgaaaaggggguaacucaaaacggacgccugaucacagcaaaucccauugucaccgauaaagagaagccugugaacaucgaaacugagccacccuucggcgagucguauauaguugugggugccggggaaaaagcucuuaagcugucuugguuuaagaaaggcuccucaauuggaaagauguucgaggccaccgcaagaggcgccaggcggauggcuaucuugggggacacagccugggauuuuggaaguaucgguggcgucuucacgagcguggggaaacucguacaccagguguuuggaaccgcauacggcguucuguucuccggugucucuuggacuaugaagauugggaucggcauuuuacugacauggcuaggacucaauagccgaucaaccagucuguccgugacauguauagcggugggcauggucacucuuuacuuggggguuauggugcaggcugacagcggaugcgugaucaacuggaaaggccgcgaacugaagugugguucugggauuuuuguaaccaacgagguccauacguggacagaacaguauaaguuccaagccgauucaccgaaaagacucagugcagccaucggaaaggcuugggaggagggcgugugcgguaucaggagcgccacccggcuggaaaauauuauguggaaacagauauccaacgaguuaaaucacauccugcuugaaaacgacaugaaguuuacuguuguggucggcgacgcaaaugggauuuuggcucagggcaagaaaaugauccgcccucagcccauggagcacaaauacucuuggaaaucguggggcaaggccaaaauuaucggggcggauauacaaaacaccacauucaucauugacggaccagauacuccugaaugucccgacgaucagagagccuggaauaucugggagguggaggacuauggcuuugguauuuucaccacaaacaucuggcucaagcugagggauagcuacacgcagaugugcgaccaucgucuaauguccgcugcaauaaaagauucaaaggccguucacgcugacaugggguauuggauugaaagugagaaaaaugaaaccuggaagcuggcccgggcaucuuuuaucgaggugaagacuuguacauggccaaaaagccauacccucugguccaacggaguacuggaaucagagaugauuauccccaagauauacggcgguccuaucagccagcacaauuaucgaccaggcuacuucacucaaacagcggggccguggcaccuuggaaaauuggagcuggauuucgacuuaugcgaaggcaccacggucgugguggaugagcauugcgggaacagaggacccucucucaggacuaccacagucaccggcaagauuauccacgaaugguguugccgcuccuguacucugccuccacuucgguuuagaggugaggacgggugcugguacggaauggagauuaggcccguuaaagaaaaggaggaaaaucuggugcgcaguaugguaagcgccggcucuggugagguggacuccuucucauugggcauccucugugucaguauaaugauugaagaggugaugcgaagccgguggucgcguaagaugcugaugacagggacccuagcuguuuuucugcuccugaucaugggacagcuuacauggaacgauuugaucagacugugcauuauggugggcgccaaugcauccgacaggauggggaugggaacuaccuauuuagcucucauggccacguucaaacugcgcccuauguuugcagucggcauccuuuuccggagacugacaucuagggaggugcuacuccugaccauugguuugagccugguugccucaguggaauuaccaaacagucucgaggaacugggggauggacuugcuaugggcauaaugaugcugaaguugcucacugaguuucagccccaucaacuguggaccacacuacugucccuuacuuucauccgaaccacgcucucucuggacuacgcguggaaaacaaccgccauggcauugagcauugucucccuguuuccguuaugucucucaacuacaagccagaagaccacuuggcugccuguacuucugggcaguuucgggugcaaaccauugacaauguauuuuaucaccgaaaacaagauuuggggacgcaagucuuggcccaucaaugaggguauaauggcuaucggcauuguguccauccuccugagcucgcuacugaaaaacgauguuccucuugccgggccccucauugccggaggcaugcugaucgcuuguuacgugauaucagguucuagugcagacuuguccuuagagaaggccgcggaagucagcugggagcaggaagcugagcacucugggacgagccauaauauucugguggaaguacgggaugacggaacuaugagaaucaaagaugaggagaaggacgauacccucacaauccugcuuaaagccacccuguuggcaguguccggcgucuauccaaugucaauuccugccacacuauucguuugguacuuuuggcagaagaaaaagcaaaggaguggcgugcugugggacacucccagcccaccggaaguggagcgugcuguccucgaugacgggauauaucgcauccugcagcggggacuuuuagguagaucucaggugggcguugggguauuccaggacggaguguuccacaccauguggcacgucacgaggggcgcagugcugauguaccaagguaagcgacucgaaccuuccugggccucaguuaaaaaggauuugauuaguuacgggggaggcuggcgguuucagggcagcuggaacacaggggaggaggugcaggucaucgcgguggaacccggcaaaaauccaaagaacguacagacuacccccgguacauucaaaaccccugagggcgaagucggggcuauugcccuggacuuuaagccaggaacuuccggcucucccaucgugaaucgcgaggguaagauaguugggcucuauggaaacggcguggucaccacaucgggcacguacgugagcgcaaucgcccaagcuaaagccucacaggaagggccucugccggagauugaggaugaaguuuucaagaaaagaaaucuuacuaucauggaccugcauccaggauccgguaagaccaggcgguauuugcccgcaauugugcgagaggcuaucaaaagaaagcuacgcacacugauacucgccccuaccagggucguggcgagugaaauggccgaggcauuaaagggcaugccaauucguuaccagacuacagcuguaaaaucugaacacaccgggcgggagaucguggaucugaugugccaugccacguuuacuaugagacuucugagccccguuagggucccuaacuauaauaugaucauuauggacgaggcucacuucacagauccggcauccaucgccgcccgcggauacauaucaacccgagugggcaugggugaagcugcggcaauuuuuaugaccgccacucccccagggucuguggaggcuuucccucaaagcaacgccgucauccaggacgaagagagagauauucccgaacggaguuggaacuccggauaugacuggaucacagauuuuccaggcaagaccguaugguucgugccuagcauaaaaucuggcaacgacauugcaaauugucucaggaagaacgggaaacgcguuauccaguugucacguaagacauuugacacugaguaccagaagacgaaaaacaaugauugggacuacguggucaccacagauaucuccgagaugggagccaacuucagagcugaccgggugauugaucccaggcgcugccugaagccaguuauccucaaagacgguccggaacgagugauucuggcgggcccuaugcccgucacuguggccagugcagcucaaagacgggggaggauaggacgcaaucagaacaaggagggcgaucaguauguauacaugggucagccacuuaauaacgacgaagaucaugcccacuggaccgaggcaaaaaugcuacuggacaauaucaacacacccgaggggauuaucccugccuuguucgaaccagagagagaaaagagcgcugccaucgauggcgaguauagguuacggggagaagcgcguaagaccuuuguggagcugaugcgccgaggcgaccuccccguuuggcugucguacaaagucgcaucugagggguuccaauauuccgauagaagguggugcuuugacggagaacggaauaaccaggugcuugaggaaaauauggacguggagauuuggacuaaggaaggugagcgcaaaaagcugagaccuagguggcucgaugcccggacguacagcgacccguuggcucugcgagaguucaaagaauuugccgcuggcagacgcucagucaguggggaucuaauacuggagaucggaaagcucccacagcaccuuacccugagggcacagaacgccuuagacaauuugguuaugcugcauaacucugaacaaggcgguaaggcuuaucggcacgccauggaggaacuccccgauacaauugagacucugaugcuucuggcacucaucgcgguguugaccgggggcguaacacuguucuuuuuauccggaaagggccuagggaagaccagcauuggacugcucugugugacugccucaagugcacuucuguggauggccagcgucgagccucauuggaucgcagcuuccauaaucuuggaguucuuucugauggugcuccugauucccgagccagaccgucagagaacaccucaggauaaucagcuugccuacguugugaucggucuccuguucaugauuuugacggucgcagccaacgaaaugggccuguuagagaccacuaaaagggaccuagggaucggacacguagcugcggagaaccaccaacaugccacaaugcuggauguggaccuccgccccgcaucugcuuggacccuuuacgccguugccaccacagugauaacuccaaugaugcggcacacgauugaaaauaccacagcaaacaucagccugacugcuauugccaaucaggcggcuaucuugaugggccuggauaaggguuggccuauauccaaaauggacaucggggucccgcuccuggcccuuggcugcuauucacaggugaaccccuuaacccugacagcagccguccucauguugguggcucauuacgcaauuaucggaccaggccugcaagccaaggcgacccgagaggcucagaaaagaacugccgcagggauuaugaagaauccuacgguugauggaaucguggccauagaccuagaccccguaguguaugaugcuaaguuugaaaaacagcugggccagauuaugcuccuuauccuguguacaucucaaaucuugcugaugaggaccacuugggcccucugcgagaguauuacccuggcaacagguccauuaacuacccuuugggaagggucgccuggaaaguucuggaacacaacgaucgcugucagcauggccaauauauuucgcggcuccuaccuggcgggugccggccucgcauucucucuaaugaaaucacuagggggaggccggagagggaccggagcucagggcgagacuuugggugagaaguggaaacgucagcugaaccagcucagcaagcccgaguucaauacauauaagagguccgggauuauggagguugaccggagugaagccaaagagggacuuaagcgcggcgaaaccacuaaacacgcagugucucgagguacagcuaagcugagaugguuugucgagaggaacuuggugaaaccggagggcaagguaaucgaucugggguguggacggggcggguggagcuacuauugcgccggacucaagaaagugaccgaaguuaagggcuacacgaaaggugggccaggacaugaggaaccuauucccauggccaccuacggcuggaauuuagugaagcugcacucaggcaaagacgucuucuuuaugccacccgagaagugugauacacuucugugcgacaucggggaauccaguccuaacccgacuauagaggagggacgcacccuaagagugcucaaaauggucgaacccuggcugagggguaaucaauucuguaucaagauuuugaacccauauaugccuagcgugguugagacacuggaacagaugcagcgaaagcacggcgggaugcucguacggaauccccuuucucguaacuccacucaugagauguacugggugucaugcggaaccggcaauaucgucagcgcggugaacaugacaucgagaaugcuguuaaaccgcuuuaccauggcucacaggaaaccuacuuaugagcgggauguugaccugggugcagggacgagacauguggccgucgaaccagagguggcuaauuuggauauuaucggacagcgcauugaaaacaucaagaaugagcacaaaucuacauggcacuacgacgaagauaaccccuauaagaccugggccuaccauggcaguuaugagguaaaaccuuccggcagcgcaucauccauggugaaugggguugucaggcuccugacuaagccaugggacgugauacccauggugacccaaauugccaugacagacacgaccccguucggacagcagcgagucuuuaaggagaaaguugauacucggacaccuagagcuaagagggguaccacucaaaucauggaagugacagcgaaauggcuauggggcuuccuuucucgcaacaagaaaccacguaucuguacccgggaggaauuuacaagaaagguaaggagcaaugccgcaauuggggcuguguucgucgacgagaaccaguggaauagugccaaggaagcaguggaggaugagcgcuuuugggaccugguucaccgagaacgggagcuccauaaacagggaaagugcgccacuugcguguacaacaugaugggcaaaagagaaaagaaacugggugaguucgggaaggcuaagggauccagggccauaugguacaugugguugggcgcgcgcuuucuggaguucgaggcacucggcuucaugaaugaggaucacugguuuagcagagaaaacucucuuucaggggucgagggagaaggucugcauaaauuaggcuauauccugcgggacauuaguaagauccccgggggaaauauguacgccgaugacaccgcuggcugggauacgaggauuaccgaggacgauuugcagaacgaggccaaaaucacagacauaauggaaccugagcacgcacuccuggcuacuuccaucuucaagcuaaccuaucaaaauaaagugguacguguucagcgaccagccaagaacgguacagugauggaugucauuagccgcagagaccagcgggggucuggacaggugggcacuuacggccuuaacaccuuuacgaauauggaagugcaacugaucaggcagauggagucggaagggauuuuccuccccucagagcuggagacaccgaacuuggcugaacgcgucuuagacuggcuggagaaacacggagccgaaagacucaagcggauggcaaucagcggugaugacuguguugugaagccuauagaugacagguuugcgaccgcccuuacugcucugaaugauaugggcaaaguacgaaaggacauuccccagugggagccauccaaaggguggaacgauuggcagcaagugccuuucugcagucaucacuuucaucagcuaaucaugaaggacggacgugaaaucgucgugcccuguagaaaucaggaugagcugguuggccgcgcccgggugucucagggugcaggguggagccucagggagacagcuugcuugggaaaauccuaugcccaaauguggcagcugauguacuuccacagacgcgaccuucggcuggcagccaacgcgauuuguucagcugucccaguggauuggguacccaccaguaggacuaccuggucuauacacgcccaucaccaguggaugacaacggaagacaugcucagcguuuggaaucgaguguggaucgaggaaaacccuuggauggaggacaagacccaugucuccucaugggaagaggugccauauuuaggcaagagagaggaucaauggugcggcagccugauuggguugacugcacgggccacaugggcuaccaauauccagguugccauuaaccaggugaggcgccugaucggaaaugaaucuuaccucgacuacaugacuuccaugaaacguuuuaagaacgagagugauccggaaggugcacuuugguga

SEQ ID NO: 13442 - RNA, 9879 nt, Artificial Sequence
  derived and/or modified CDS sequence (opt3) from DENV-1__KF973474__SS-prME
agcgugaccaugcugcucaugcuucugcccacugccuuggcuuuccacuuaacuacgagaggaggggaaccucauaugaucgucuccaagcacgaaagaggaaaaucucuguuauuuaagaccucaaccgguguuaacaugugcacucucauugcaauggaccugggcgaacuuugugaagauaccaugacauacaaaugcccacggauaaccgaggccgaaccggacgauguggacuguuggugcaaugcgacugauacauggguaaccuaugggacguguagucaaacuggagagcaucgccgagacaagcguagcguggcucuggccccacacgucggcuugggucucgagaccagaacagaaacuuggauguccucugagggggcauggaaacaaauccaaaggguggaaaccugggcccugcggcauccuggauucacaguuauugcucuguuucucgcacacgccaucggcaccucgauuacgcagaagggcaucauauucaucuuacugaugcuugugacuccaucaauggcuaugcgcugcgucgggauuggaaacagagauuuuguggaggguuugagcggcgccacauggguagacguugugcuggagcacgggaguugugucaccacuauggcgaagaauaaacccacauuggauaucgaacuccugaagaccgaggugacgaacccugcagugcuuaggaaacugugcauugaagccaagaucuccaauaccacaacugacucucgguguccaacccagggagaggcuacauuggucgaagaacaagaugccaacuucguuugccgccgaacucucguggacagaggcugggguaauggguguggacuguuuggcaaaggcagcuuacugaccugcgcaaaguucaagugcguaacaaaacucgaggggaagauagugcaguacgaaaaccuuaaauauuccgucauugugaccguucauacuggagaucagcaccagguggguaaugagacgacagaacauggcaccaucgcuacuauuacaccccaagccccuacaucagagauccagcugaccgacuacggggcguuggcccuagacuguaguccaaggacuggacuggauuuuaacgaaaugguccuccugacaaugaaggagaaaagcuggcuugugcacaagcagugguuccuggacuugccgcuccccuggacgucuggcgcauccaccucacaggagacuuggaaucggcaagaucuguuaguaacauuuaaaaccgcucacgccaagaagcaggaaguugugguccuggguagccaggagggggcuaugcauacagcccuaacuggcgcaaccgaaauccaaacgaguggaaccacaacuauuuucgccggccaccucaaaugccgucugaagauggacaaacuuaccuugaaggggacaucuuaugugauguguacuggauccuuuaaacuggagaaggaagucgcugagacccagcaugguacggugcucguucaggugaaguacgagggcacagaugcgccuugcaaaauaccauucagcacccaggacgaaaaggggguaacucaaaacggacgccugaucacagcaaaucccauugucaccgauaaagagaagccugugaacaucgaaacugagccacccuucggcgagucguauauaguugugggugccggggaaaaagcucuuaagcugucuugguuuaagaaaggcuccucaauuggaaagauguucgaggccaccgcaagaggcgccaggcggauggcuaucuugggggacacagccugggauuuuggaaguaucgguggcgucuucacgagcguggggaaacucguacaccagguguuuggaaccgcauacggcguucuguucuccggugucucuuggacuaugaagauugggaucggcauuuuacugacauggcuaggacucaauagccgaucaaccagucuguccaugacauguauagcggugggcauggugacucuuuacuugggggucaugguucaggcugacagcggaugcgugaucaacuggaaaggccgcgaacugaagugugguucugggauuuuugugaccaacgagguacauacguggacagaacaguauaaguuccaagccgauucaccgaaaagacucagugcagccaucggaaaggcuugggaggagggcgucugcgguaucaggagcgccacccggcuggaaaauauuauguggaaacagauauccaacgaguuaaaucacauccugcuugaaaacgacaugaaguuuacugugguugugggcgacgcaaaugggauuuuggcucagggcaaaaagaugauccgcccucagcccauggagcacaaauacucuuggaagucguggggcaaggccaaaauuaucggggcggauauacaaaacaccacauucaucauugacggaccagauacuccugaaugucccgacgaucagagagccuggaauaucugggaggucgaggacuauggcuuugguauuuucaccacaaacaucuggcucaagcugagggauagcuacacgcagaugugcgaccaucgucuaauguccgcugcaauaaaagauucaaaggccgugcacgcugacaugggguauuggauugaaagugagaaaaaugaaaccuggaagcuggcccgggcaucuuuuaucgagguuaagacuuguacauggccaaaaagccauacccucugguccaacggagugcuggaaucagagaugauuauccccaagauauacggcgguccuaucagccagcacaauuaucgaccaggcuacuucacucaaacagcggggccguggcaccuuggaaaauuggagcuggauuucgacuuaugcgaaggcaccacgguagucguggaugagcauugcgggaacagaggacccucucucaggacuaccacagugaccggcaagauuauccacgaaugguguugccgcuccuguacucugccuccacuucgguuuagaggugaggacgggugcugguacggaauggagauuaggcccgucaaagaaaaggaggaaaaucugguucgcaguauggugagcgccggcucuggugagguagacuccuucucauugggcauccucugugugaguauaaugauugaagaggucaugcgaagccgguggucgcguaagaugcugaugacagggacccuagcuguguuucugcuccugaucaugggacagcuuacauggaacgauuugaucagacugugcauuaugguuggcgccaaugcauccgacaggauggggaugggaacuaccuauuuagcucucauggccacguucaaacugcgcccuauguuugcagugggcauccuuuuccggagacugacaucuagggagguccuacuccugaccauugguuugagccugguggccucaguugaauuaccaaacagucucgaggaacugggggauggacuugcuaugggcauaaugaugcugaaguugcucacugaguuucagccccaucaacuguggaccacacuacugucccuuacuuucaucaaaaccacgcucucucuggacuacgcguggaagacaaccgccauggcauugagcauugugucccuguuuccguuaugucucucaacuacaagccagaaaaccacuuggcugccuguccuucugggcaguuucgggugcaagccauugacaauguaucucaucaccgaaaacaagauuuggggacgaaaaucuuggcccaucaaugaggguauaauggcuaucggcauuguauccauccugcuaagcucgcugcuuaagaacgaugugccucucgccgggccccugauugccggaggcauguugaucgcuuguuacguuauaucagguucuagugcagacuuaucccuggagaaagccgcggaagugagcugggagcaggaagcugagcacucugggacgagccauaauauucucgucgaagugcaggaugacggaacuaugcgcaucaaggaugaggagaaagacgauacccugacaauccuucugaaggccaccuugcuagcaguauccggcguguauccaaugucaauuccugccacacuguuugucugguacuucuggcagaaaaagaagcagcggaguggcguucucugggacacucccagcccaccggaaguggagagagcugugcuggaugacgggauauauaggauccuucagcguggauuacugggucgcucucaggucggcguggggguuuuucaagacggaguauuccacaccauguggcacgugacgcggggcgcaguccucauguaccaggguaaaagauuggaaccuuccugggccucagugaagaaagaucugauuaguuacgggggaggcuggagguuccagggcagcuggaacacaggggaggagguucaggugaucgcggucgaacccggaaagaaucccaaaaaugugcaaacuacccccgguacauuuaagaccccugagggcgaaguaggggcuauugcccucgacuucaagccaggaacuuccggcucucccaucgucaaucgagaggguaaaauaguggggcuguauggaaacggcguugugaccacaucgggcacguacgucagcgcaaucgcccaggcuaaggccucacaggaagggccucuuccggagauugaggaugaaguguuuaaaaagcggaaucugacuaucauggacuugcauccaggauccgguaaaacccgcagauaucuacccgcaauuguuagggaggcuaucaagcggaagcugcgaacacucauauuagccccuaccagaguggucgcgagugaaauggccgaggcacugaaaggcaugccagugcgcuaccaaacuacagcuguaaagucugaacacaccgggagggagauuguggaucuuaugugccaugccacguucacuaugcgucugcucagccccguucgggucccuaacuauaauaugaucaucauggacgaggcucacuuuacagauccggcauccauugccgccagaggauacaucucaaccagggugggcaugggugaagcugcggcaauauucaugaccgccacucccccagggucuguggaggcuuuuccucagagcaacgccgucauucaggacgaagaacgcgauauccccgaacgaaguuggaacuccggauaugacuggauuacagauuucccaggcaaaaccguaugguuugugccuagcaucaagucuggcaacgacauagcaaauuguuugaggaaaaacgggaagcggguuauucagcugucaaggaagacauucgacacugaguaccagaaaacgaagaacaaugauugggacuacguggucaccacagauaucuccgagaugggagccaacuuucgcgcugaccgugugaucgaucccagacggugccucaaaccaguuauucugaaggacgguccggaaagggugauccuugcgggcccuaugcccgucacuguggccagugcagcucagcgccgagggagaauuggacggaaucagaacaaagagggcgaucaguauguauacaugggucaaccacuaaauaacgacgaagaucaugcccacuggaccgaggcaaagaugcuguuggacaauauaaacacacccgaggggaucauuccugccuuauucgaaccagagagggaaaagagcgcugccaucgauggcgaguaucgccugagaggagaagcgaggaaaaccuucguggagcucaugcggcguggcgaccugcccguuuggcuuucguacaaggucgcaucugagggguuucaguauuccgaucgccgauggugcuucgacggagaaagaaauaaccaggugcuggaggaaaauauggacguggagaucuggacuaaagaaggugagaggaagaaacuccggccucgcugguuggaugccagaacguacagcgacccgcuggcucuaagggaguuuaaggaguucgccgcuggccggcgaucagucaguggggaucugauucucgagauaggaaaacuuccacagcaccugaccuuaagagcacaaaacgccuuggacaaucugguuaugcuccauaacucugaacagggcgguaaggcuuaucgccacgccauggaggaacugcccgauacaaucgagacucuuaugcugcucgcauugauugcggugcugaccgggggcguaacauuauuuuuccuauccggaaagggccuggggaaaaccagcaucggacuccuuugugugacugccucaagugcucuguuguggauggccagcgucgagccucauuggauugcagcuuccaucauacuggaauuuuuccucauggugcugcuuauccccgagccagacaggcagcggacaccucaggauaaucaacucgccuacguugugauuggucuguuguuuaugauccugacggucgcagccaacgaaaugggcuuacuagagaccacuaagcgugaccuggggauuggacacguagcugcggagaaccaccagcaugccacaaugcucgauguggaccuuagacccgcaucugcuuggacccuguacgccguugccaccacagugaucacuccaaugaugaggcacacgauagaaaauaccacagcaaacauuagcuugacugcuaucgccaaucaggcggcuauucugaugggccucgauaaagguuggccuaucuccaagauggacauaggggucccgcugcuugccuuaggcugcuauucacaagugaacccccugacccucacagcagccgucuugaugcugguggcucauuacgcaaucauuggaccaggccuacaggccaaagcgacccgcgaggcucagaagcggacugccgcagggaucaugaagaauccuacgguugauggaauuguggccaucgaccuggaccccguaguguaugaugcuaaauucgaaaagcagcucggccaaauaaugcuucugauuuuguguacaucucagauccugcucaugcgaaccacuugggcccugugcgagaguaucaccuuagcaacagguccacuuacuacccugugggaagggucgccuggaaaauuuuggaacacaacgauugcugucagcauggccaauaucuucagaggcuccuaccucgcgggugccggccuagcauuuucucugaugaagucacuagggggaggcaggcgcgggaccggagcucagggcgagacucugggugagaaauggaagcggcagcucaaccaacuuagcaagcccgaguucaauacauauaaaagauccgggauaauggagguugaccguagugaagccaaggagggacugaaaaggggcgaaaccacuaagcacgcagugucucgggguacagcuaaauugcgcugguucgucgagcgaaaccuggugaagccggagggcaagguaauugaucucggguguggaagaggcggguggagcuacuauugcgccggacugaaaaaggugaccgaaguuaaaggcuacacgaagggugggccaggacaugaggaaccuauccccauggccaccuacggcuggaaucuagugaaacuucacucaggcaaggacgucuuuuucaugccacccgagaaaugugauacacugcuaugcgacauuggggaauccaguccuaacccgacuaucgaggagggaaggacccuccgggugcugaagauggucgaacccugguugcgcgguaaucaguuuuguauaaagauccugaacccauauaugccuagcgugguugagacacucgaacagaugcagagaaaacacggcgggaugcuuguaaggaauccccugucucgaaacuccacucaugagauguacugggugucaugcggaaccggcaauauugucagcgcggugaacaugacaucgcggauguuacugaaccguuucaccauggcucacagaaagccuacuuaugagcgcgauguugacuugggugcagggacgaggcaugugacagucgaaccagagguggccaaucucgauaucauuggacaacggaucgaaaacauuaaaaaugagcacaagucuaccuggcacuacgacgaagauaaccccuauaaaacuugggcuuaccauggcaguuaugagguaaagccuuccggcagcgccucauccauggugaaugggguugucagacugcuaaccaagccaugggacgugauccccauggugacacagauagcaaugacggacaccacuccguuuggacagcaacgcgucuucaaagagaagguugauacaaggaccccucgagccaaacgggguacuacacagauuauggaagugaccgcuaaguggcuuuggggcuuucugucuagaaacaaaaagccaaggaucuguacacgcgaggaguucacucguaagguacggagcaaugcggccaucggggcaguguuugucgacgagaaccaguggaauagugcuaaagaagccguggaggaugagagauucugggaccucguucacagggaacgcgagcugcauaagcagggaaaaugcgcaaccugcguguacaacaugaugggcaagcgagagaaaaaguugggugaguuugggaaggccaaaggaucccgggcuauuugguacauguggcugggcgccagauuccucgaauuugaggcgcuuggcuucaugaaugaggaucacugguucagcagggaaaacucucugucaggggucgagggagaagguuuacauaagcugggcuauauauugcgcgacaucaguaaaauucccgggggaaauauguacgcagaugacacggccggcugggauaccagaaucacagaggacgaucuccaaaacgaggcuaagauuacugacaucauggaaccugagcacgcccugcuagcaaccuccauauuuaaacuuacauaucagaauaaggugguacggguucagaggccagcuaaaaacgguacugugauggaugucaucagccgucgagaccagcgcgggucuggacaagugggcaccuacggccugaacacguucacaaauauggaagugcagcucauuagacagauggagucggaagggaucuuucugcccucagaguuggagaccccgaacuuagccgaacggguccuggacuggcucgagaagcacggagcugaaaggcuuaagcgcauggccauuagcggugaugacuguguugugaaaccuaucgaugacagauucgcaacugcgcugacagcccuaaaugauaugggcaagguacggaaagacauaccccagugggagccauccaagggguggaacgauuggcaacaggugccuuuuugcagucaucacuuccaucagcugauuaugaaagacggaagggaaaucgucgugcccugucgaaaucaggaugagcucguuggccgugcuagagugucucaaggugccggguggagcuugcgcgagaccgcaugccugggaaaguccuaugcucagauguggcagcuuauguacuuucaccggagggaccugagacucgccgcaaacgccaucuguucagcggucccaguggauuggguacccacaagucgcaccacauggucuauucacgcucaucaccaauggaugacgaccgaagacauguuaagcguuuggaaucggguguggauagaggaaaacccuuggauggaggacaagacucaugucuccucaugggaagaggugccauaucugggcaaaagggaggaucaguggugcggcagcuugaucgggcugacagcccgagcaaccugggccacuaauauucagguugcuaucaaccaggugagacggcucauuggaaaugaaaacuaccuugacuacaugacaucuaugaagagguucaaaaaugaguccgauccggaaggugcccugugguga

SEQ ID NO: 13443 - RNA, 9879 nt, Artificial Sequence
  derived and/or modified CDS sequence (opt3) from DENV-1__KF973475__SS-prME
agcgugaccaugcugcucaugcuuaugcccacagcccuggcuuuccacuugacuacgagaggcggggaaccucauaugaucgucuccaagcacgaaagaggaaaagcauuacuguuuaagaccucuacagguguuaacaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacagacuggagagcaucgccgagacaagcguaguguggcccuugcaccccacgucggccuggguuuggagaccagaacagaaacuuggaugagcuccgagggggccuggaaacaaauccaaaggguggaaaccugggcucuccggcauccuggauucacaguuauugcacuguuucuggcccacgcuaucggcaccucuauuacgcagaagggcaucauauucauccucuuaaugcuggugacuccaucgauggccaugcgcugcgucgggauuggaaacagagauuuuguggagggucuuucaggcgcgacauggguagacguuguguuggagcacgggagcugugucaccacuauggcaaagaauaaacccacacuggauaucgaacuacucaagaccgaggugacgaacccugccgugcugaggaaacuuugcauugaagcuaagaucaguaauaccacaacugacucccgguguccaacccagggagaggccacacuggucgaagaacaagaugcaaacuucguuugccgccgaacuuuuguggacagaggcugggguaauggguguggauuguucggcaaaggcucucuccugaccugcgcuaaguuuaagugcguaacaaaauuagaggggaagauagugcaguacgaaaaccugaaauauagcgucauugugaccguucauacuggagaucagcaccagguggguaaugagacgacagaacauggcaccaucgccacuauuaccccacaagcgccuacauccgagauccagcucaccgacuacggggcccuuacucuggacuguucaccaaggacaggauuggauuucaacgaaaugguccuacugacgaugaaggagaaaaguuggcucgugcacaagcagugguuucuggaccuuccgcugcccuggaccagcggcgcaucuacuucccaggagacauggaaucggcaagauuugcucguaaccuucaaaacagcucacgccaagaagcaggaaguugugguccuggguucacaggagggggcuaugcauacugccuuaaccggcgcaacggaaauccaaaccagcggaacaacuaccauuuuugccggccaccugaaaugccgucuaaagauggacaaacucacacugaaggggacaaguuaugugauguguaccggaucuuucaaacuugagaaggaagucgcugagacgcagcaugguacaguguugguucaggugaaguacgagggcaccgaugcgccuugcaaaauaccauucuccacucaggacgaaaaggggguaacacaaaacggacgccugaucaccgcaaaucccauugucacugauaaagagaagccugugaacaucgaaaccgagccacccuuuggcgagagcuauauaguugugggugccggggaaaaagcucucaagcugucgugguucaagaaaggaucuuccauuggaaagauguuugaggccacagcaagaggcgccaggcggauggcuauccuuggggacacggccugggauuucggaucaaucgguggcgucuuuaccaguguggggaaacugguacaccagguguucggaacugcauacggcguuuuguuuagcggugucuccuggacaaugaagauugggaucggcauucuccugaccugguuaggacuaaauucucgaagcacaucacuaaguaugacuuguauagcggugggcauggugacccucuaccugggggucaugguucaggcugacuccggaugcgugaucaacuggaaaggccgcgaacuuaagugugguagcgggauuuucgugacgaacgagguacauacauggaccgaacaguauaaguuucaagccgauucuccgaaaagauugucagcagccaucggaaaggcuugggaggagggcgucugcgguaucaggagugccacucggcuggaaaauauuauguggaaacagauaagcaacgagcucaaucacauccuguuagaaaacggcaugaaguucaccgugguugugggggacgcaaauggcauucuggcucagggcaaaaagaugauccgcccucagcccauggagcacaaauacuccuggaagucuugggggaaggccaaaauuaucggagcggacauacaaaacacaacuuuuaucauugauggcccagacaccccugaaugucccgaugaccagagagccuggaauaucugggaggucgaggauuaugguuucgggauuuuuacaacgaacaucuggcuuaaguugagggacucguacacccagaugugcgaucaucgucucaugagcgcugcaauaaaagacuccaaggccgugcacgcugauaugggauauuggauugaaucagagaaaaaugaaacuuggaagcuggcccgggcaaguuucaucgagguuaagacauguaccuggccaaaaucucauacucuauggagcaacggcgugcuggaauccgagaugauuauccccaagauauacgguggcccuaucucacagcacaauuaucgaccaggguacuucacacaaaccgcgggaccguggcaccucggcaaacuggagcuugacuuugauuugugcgaagggacgacuguagucguggacgagcauugcggaaacagaggccccagccugaggaccacaaccgugacugguaagauuauccacgaaugguguugccgcucuuguacauuaccuccacuccgguucagaggggaggauggaugcugguacggcauggagauuaggcccgucaaagaaaaggaggaaaaucugguucgcuccauggugagugccgguagcggcgagguagacucuuuuucccuugggauccugugugugucaauaaugauugaagaggucaugcgaagucgguggagccguaagauguugaugaccggaacacucgcuguguuccugcuacugaucaugggccagcucacuuggaacgaccugaucagacuuugcauuaugguuggggccaaugcaucggauaggaugggaaugggcaccacguauuuggcucugauggccacauuuaaaaugcgcccuauguucgcaguggguaucuuauuucggagacucaccuccagggagguccugcuucugacuauugggcuaucucucguggccagcguugaacugccaaacucauuggaggaacugggagacggcuuagcuaugggcauaaugaugcucaagcugcuuaccgaguuccagccccaucaacuguggacaacuuugcucagucugaccuuuaucaaaacgacacuaucccuggauuacgcguggaagaccacugccauggcacuuucuauugugagccucuucccgcuguguuuguccacaaccucacagaaaacuacauggcugccugucuuacucgggagcuuuggaugcaagccacugaccauguuccuuaucacggaaaacaagauuuggggucgaaaaaguuggcccaucaaugagggcauaauggcuaucgggauuguaucuauccuguuguccagccuccugaagaacgacgugccucuagccggaccccugauugccggcgguaugcuuaucgcuuguuauguuauaucggggucaucugcagaucucagucuggagaaagccgcggaaguguccugggagcaggaagcugagcacagcggaacuucucauaauauuuuggucgaagugcaggacgauggcaccaugcgcaucaaggacgaggagaaagaugacacauuaaccauccugcucaaggccacacugcuugcaguaagcggcguguacccaauguccauuccugccacucuguuugucugguauuucuggcagaagaagaagcagcggucagggguuuugugggauacccccaguccaccggaaguggagagagcugugcuagacgauggaauauacaggauccugcagcguggucuccugggccgcagccaggucggggugggaguuuuccaagacggcguauuucacacgauguggcacgugacacggggugcaguccuuauguaucaggggaaaagauuagaaccuucuugggccuccgugaagaaagaccugauuucauacggaggcggcuggagguuccaggggaguuggaacacuggagaggagguucaggugaucgcggucgaacccgguaagaaucccaagaacgugcaaaccacacccggcaccuuuaagacuagcgagggggaaguaggagcuauugcccucgauuucaagccuggcaccuccgguucuccaaucgucaaucgagaggggaaaauagugggauuguacggcaacggcguugugacaacgucggggacuuaugucagcgcaaucgcccaggcuaagaccucacaggaaggaccccugccugagauugaggacgaaguguuuaaaaagcggaaucucacaaucauggaucugcauccggguuccggcaaaacccgcagauaccuuccagccauuguuagggaggcaaucaagcggaagcugcgaacuuugauacuagcucccacaagaguggucgccagugaaauggcggaggcccugaaagggaugccuauucgcuaucaaaccacggcagugaagucugaacacacuggaagggagaucguagaccucaugugccaugcuacauucaccaugcguuuacugagcccagugcggguucccaacuacaauaugaucauuauggaugaggcccacuuuaccgacccugcuuccaucgcagccagaggcuauauaucaacuagggucgguaugggggaagccgcugcgauuuucaugacagcaaccccgcccggaucuguggaggccuuuccacagagcaacgcugugauccaggaugaagaacgcgacauuccugaacgaaguuggaacuccggcuacgauuggaucacagacuuccccggcaaaacugucugguuuguaccaagcauaaagucugggaaugauauugccaauugucuuaggaaaaacggaaagcgggugauccagcugucaaggaagacguucgacaccgaguaucagaaaacuaagaacaaugacugggauuacguugugacuaccgacaucuccgagaugggugcaaacuuccgcgccgaucgugucauugacccuagacggugccucaaacccgugaucuugaaggauggcccagaaaggguuauucuggcugggccgaugccugugacagucgcgagugccgcacaacgccgaggaagaauaggccggaaucagaacaaagagggugaccaguacguguauauggggcaaccccucaauaacgaugaagaccaugcucacuggaccgaggccaagaugcugcuugauaauaucaacacuccagagggcauuauccccgcacuauuugaaccugagagggaaaagagcgccgcuaucgacggagaguaccgccugagaggcgaagccaggaaaacguucguagaguugaugcggcguggggauuuaccaguguggcugucguauaagguugcgucugagggauuucaguacuccgaccgccgauggugcuucgauggugaaagaaauaaccagguccucgaggaaaauauggacguggagauuuggaccaaagaaggcgagaggaagaaacugcggccccgcuggcuugacgcaagaacauauagcgauccucuggcccucagggaguuuaaggaguucgcugccgggcggcgaucagugaguggagacuugauacuggagaucggcaaacuaccgcagcaccugacucucagagcucaaaacgcacuugauaaucuggucauguuacauaacucugaacagggugggaaggccuaccgccacgcuauggaggaauugccagacaccauugagacacugaugcuccuggcccuuaucgcaguucugaccggcggagugacucucuuuuucuuguccggcaaggggcugggaaaaacaagcauugguuuacuauguguaacggcgucaagugcccugcucuggauggcuagcguggagccccauuggaucgccgcauccauaauccuugaauuuuuccugauggucuugcugauuccugagcccgauaggcagcggaccccacaggacaaucaacucgcuuaugugguuaucggccugcuuuuuaugauucucacuguggccgcaaacgaaauggggcuguuggagacaaccaagcgugaucugggaaucggccacgucgccgcugagaaccaccagcaugcgaccauguuagacguagaucuaagaccugccucugcauggacacuguacgcuguggccacuacgguuauaacccccaugaugaggcacacaauugaaaauacuaccgccaacaucagccucacagcaauugcuaaucaggccgcgauccuuaugggucuggacaaaggguggccaauauccaagauggauaucggcgugccuuugcuggcucucggaugcuacucacaagucaacccgcugacccuuacugccgcaguguuaaugcuggucgcccauuaugcuauuaucggccccgggcuccaggcaaaagccacgcgcgaggcgcagaagcggacagcugccggaauuaugaagaauccaaccguggacggcaucguugcaauagauuuggacccugugguauacgacgccaaauucgaaaagcagcugggucaaauuaugcuacugauccucuguacuucucagauccuucugaugcgaaccacaugggcuuugugcgagaguauuacucuggccaccgggccccucacaacgcugugggaaggaucgccaggcaaauuuuggaacaccacuaucgcagugagcauggcuaauauauucagagguuccuauuuagccggcgcggggcuugccuucucucugaugaagucacucggaggcgggaggcgcggaacaggcgcacagggugagacccuaggggagaaauggaagcggcagcugaaccaauugagcaagccugaauuuaauacuuacaaaagauccggaauuauggaggucgaucguagugaagcuaaggagggccugaaaaggggugaaacaaccaagcacgccguuucucggggcacggcaaaacuccgcugguucguggagcgaaaccuugucaagcccgaggggaaggugaucgaccugggauguggcagagggggauggagcuauuacugcgcuggcuugaaaaagguaaccgaagugaaagguuauacaaaagggggaccgggccaugaggaaccaauuccuauggccacuuacggcuggaaucugguuaaacuccacucagggaaggauguguuuuucaugcccccagagaaaugugacaccuuacugugcgauaucggagaauccagucccaacccuacaauagaggaggguaggacucuucggguccugaagaugguggaaccguggcuacgcggcaaucaguuuuguaucaagauucucaaccccuacaugccaagcgucguggagacccuggaacagaugcagagaaaacacgggggaauguugguuaggaauccucugucucgaaacuccacacaugagauguauuggguaucaugcggcaccgguaauaucgugagcgccgucaacaugacuucgcggaugcuccuuaaccguuucacgauggcgcacagaaagcccacauacgagcgcgacguggaucugggggcuggaaccaggcauguugcaguggaaccugaggucgccaauuuagacauuaucggccaacggauugaaaacaucaaaaaugagcacaagucuacuuggcacuaugaugaagacaacccauacaaaaccugggcuuaucauggcaguuacgaggugaagcccuccgggagcgccucauccaugguaaauggagugguuagacuguugacaaagccuugggaugucauaccaauggugacgcagauugcaaugaccgacacuacacccuuuggucagcaacgcguguucaaagagaaggucgacaccaggacuccgcgagccaaacggggcacaacccagaucauggaaguuacagcuaaguggcucuggggguuucugucuagaaacaaaaagccuaggaucuguacucgcgaggaguucacccguaaggugcggagcaaugcggccauuggagcaguauuuguggaugagaaccaguggaauagugcuaaagaagccgucgaggacgagagauucugggaucuagugcacagggaacgcgagcuucauaagcagggcaaaugcgcaacgugcguuuauaacaugauggguaagcgagagaaaaagcugggggaguuuggaaaggccaaaggcucccgggcuauaugguacauguggcucggcgccagauuccuggaguucgaggcguugggguuuaugaaugaggaccacugguucagcagggaaaacucucugucaggaguggagggugaaggccuccauaaacuuggguacauccugcgcgauauuaguaaaaucccaggaggcaauauguaugcagacgauaccgccgguugggacacaagaauuacugaggaugacuuacaaaacgaggcuaagaucaccgauauaauggaacccgagcacgcccuguuggcaacauccaucuuuaaacucacuuaccagaauaaggucgugcggguacagaggccugcuaaaaacgggaccguuauggacgugauuagccgucgagaucagcgcggaucuggccaagucggcacguaugggcugaacacauucaccaauauggaagugcagcuaaucagacagauggagucggaaggaauuuuucuuccaucagagcuggagacucccaaccucgccgaacgggugcuggacugguuggagaagcacggugcugaaagguuaaagcgcauggccaucagcggcgacgauugugucguuaaaccgauagacgauagauucgcaacagcgcugaccgcccucaaugacauggggaaggugcggaaagauauuccucagugggagcccuccaagggauggaacgacuggcaacagguaccauuuugcagucaucacuuccaucagcuuaucaugaaagauggcagggaaaucguggucccuugucgaaaucaggacgagcuggugggucgugcuagaguuucucaaggggccggauggagccuacgcgagacugcaugccugggcaaguccuacgcucagauguggcagcucauguauuuucaccggagggauuugagacuggccgcaaacgccauuuguucagcggugcccgucgacugggugccaaccagucgcacaacguggucuauacacgcucaucaccaauggaugaccacugaagauaugcuuagcguauggaaucggguuuggaucgaggaaaaccccuggauggaggacaagacacauguguccucaugggaagaggucccuuaccugggcaaaagggaggaccaguggugcgggagccucauuggauuaaccgcccgagcaacuugggccacaaauauccagguggcuauuaaccagguuagacggcugaucgguaaugaaaacuauuuggauuacaugaccucuaugaagagguucaaaaaugaguccgacccagaaggcgcccugugguga

SEQ ID NO: 13444 - RNA, 9879 nt, Artificial Sequence
  derived and/or modified CDS sequence (opt3) from DENV-1__FJ898448__SS-prME
agcgugaccaugcugcucaugcuucugcccaccgucuugacuuuccacuuaacgaccagaggaggggagccucauaugaucguuuccaagcaggaaaggggaaaaucucuguuauuuaagacaucagccggugugaauaugugcacucucauugcuauggaccugggcgagcuuugugaugacaccaugacauacaaaugcccgcggauaaccgaaacugagccggaugacguagauuguuggugcaaugcaacagaaaccugggugacguaugggacuuguagucaaaccggagagcaccgccgagacaagcguagcgucgcccuggcgccccaugugggcuugggucucgagacaagaacugaaaccuggauguccucugagggggcuuggaggcagauccagaaaguugaaacaugggcccugcggcacccuggauucaccgugauugcacuguuucucgcccaugcuaucggcacgucgauuacucagaagggcaucauauucaucuuacugaugcuugucacaccaucaauggcaaugcgcugcguggggauuggaaauagagauuuuguagaggguuugagcggcgccaccuggguugacgugguccuggagcacgggaguugugugacuacaauggcuaaggauaaacccaccuuggacaucgaacuccugaagacggaggugaccaauccugccguccuuaggaaacugugcauugaagcgaagaucuccaacacaacuaccgauucucgguguccaacacaaggagaggcaacuuugguugaagaacaagacaccaauuucgugugccgccgaacauuuguagauagaggcugggguaacggguguggacucuucggcaaaggcagccugauaaccugcgccaaguuuaagugcgugacuaaauuagaggggaagauuguccaguacgaaaaucugaaauauuccgugaucguuacggugcacacaggagaccagcaucaagucgguaacgagaccacugaacacggcaccauugcuacaaucacaccccaggccccuacuucagagauccagcucacagacuacggggcacuuacgcuggauuguaguccaaggaccggauuggacuucaaugaaauggugcuacugacuaugaaggagaaaagcuggcucguacauaagcagugguuucuggaucuuccgcugcccuggacaucuggcgcuuccaccucacaagagacauggaaccggcaggacuugcucguuacuuucaaaaccgcccacgcgaagaagcaggaaguggucgugcuggguagccaagagggggccaugcacacggcauuaaccggcgcuacagaaauucagacaaguggaaccacaacuauauuugccggccaucugaaaugccgucuaaagauggauaaacucacccugaaggggaucucuuaugucauguguacgggauccuucaaacuugagaaggaaguggcugagacacagcacgguaccguuuuggugcagguaaaguacgagggcacugacgccccuugcaaaauuccauucagcucgcaagaugaaaagggggucacacagaauggacgccuggugaccgcaaaccccaucguuacugacaaagagaagccugugaauauagaagccgagccacccuuuggcgagucuuauauugucgugggugcuggggaaaaagcgcucaagcuguccugguucaagaaaggcucaaguaucggaaagauguuugaggcaaccgccagaggcgcuaggcggauggccauccuuggggauacagcaugggacuucggaagcauugguggcguauuuacguccguggggaaacugguucaucagaucuucggaaccgccuacggcgucuuguuuucuggugugagcuggacuaugaagauugggauaggcauccuccugacaugguuaggacugaacucacgaaguaccucccuaagcaugacauguauugcugugggcauggucacucucuaccuggggguuauggugcaggccgauucuggaugcgugaucaauuggaaaggccgcgaacuuaagugugguucagggaucuucguaaccaacgagguccacacguggacagaacaauauaaguuucaggcagacaguccgaaaagauugagcgcggcuauuggaaaggccugggaggagggcgugugcgguauaagguccgcaacccggcuggaaaacaucauguggaaacagauuucuaaugagcucaaccauauccuguuagaaaaugacaugaaguucacuguuguggucggcgaugugucggggauucuggcccagggcaagaaaaccauccgcccucaacccauggagcacaaauacagcuggaaguccuggggcaaggcuaaaauaaucggggccgacguucagaacacaacuuuuauuaucgauggaccaaauaccccugaaugucccgacgaucagagagcauggaacauuugggagguggaggacuauggcuucgguaucuuuacaacgaauauauggcuuaaguugagggauucauacacccagguaugcgaccaccgucucaugagugcugccauuaaagauucuaaggcgguccaugccgacaugggguauuggaucgaaagcgagaaaaacgaaacuuggaagcuggcucgggcauccuucauugaggugaagacauguguguggccaaaaucacacacccuauggagcaauggaguccuggaaucugagaugaucauacccaagaucuacggcgguccuauuucccaacauaacuaucgaccaggcuacuucacucagacagccgggccguggcaccucggaaaacuggagcuugauuuugacuugugcgaaggcaccacgguugugguagaugagcacugcgggaauagaggacccagucugaggacuaccacagugaccggcaagaucauucaugaaugguguugccgcagcuguacuuuaccuccacuccgguucaaaggugaggacgggugcugguacggaauggagaucagacccgucaaggaaaaggaggaaaaccuggugaaaucuaugguuuccgcuggcucaggugagguggacaguuuuagccuuggccuguuguguauaucgauuaugaucgaagaggucaugaggucccgcuggucucgaaagaugcucaugacagggacccuggugguuuuccuacugcucacacugggacagcuuacuuggaaugauuugauccggcugugcauuauggugggcgccaacgcaagcgacaauauggggaugggaaccacguauuuagcgcucauggccacauuucguaugagaccuauguucgcugucggccugcuuuuuaggcgccugaccucacgggagguacuacuccugacuguggguuugagucugguugccuccguggaauuaccaaacucucucgaugagcugggggacggacuugcaaugggcaucaugauucugaaauugcucaccgauuuccaaagccaccagcugugggcuacacuacugucccuuacuuuugucaagaccacgcucucacugcauuacgccuggaaaacaauggcaaugauauugagcaucgugagucuguuaccccucugucugucuaccacuucccagaagacaaccuggcuuccgguacuguugggcagccucgggugcaagccucugacuauguuccuaauuacagaaaacaaaaucuggggaagaaagucguggccacugaaugaggguauuauggccgugggcaucgucucaauacuucucucuagucuguugaaaaacgacguucccuuagcugggccucugaucgcgggaggcaugcucauugccuguuaugugaucuccgguagcucugcagaucugagccuugaaaaggcugccaaaguguccugggaggaggaagccgagcacucaggggcuagucauaauauucuggucgaaauccaggacgauggaaccaugaagauaaaagacgaggaaagggaugacacgauuacuaucuugcuaaaggcaacccugcucgccaucagcggcguguaccccaugucuauuccagcgacacuguuuguuuggcacuucuggcaaaagaaaaagcagcgauccggcguacuuugggauaccccuucacccccagagguggagaaagcugucuuagacgacgggauauaucgcauccugcagcggggacucuuggguagaagucaggugggcguugggguguuucaagaaggagucuuccacacaauguggcaugugacuaggggcgccguacugauguaccaggguaagcgucucgagccgagcugggcauccgucaaaaaggaucugauuucuuaugggggaggcuggcgcuuccagggcucguggaacaccggggaagaggugcagguuaucgccguggagccuggaaagaaucccaaaaacguccaaacggcuccagguacauuuaagacuagcgaaggcgaggugggggcaauugcccuugacuucaaacccggaaccucaggcuccccuaucguuaaucgggaagguaagauaguggggcuguacggaaacggcgucgugacaaccaguggcacuuacguaucugcgaucgcucaggccaaagcaagccaggaggggccauugcccgaaauugaggaugagguguuuagaaagaggaaucuaaccaucauggaccugcacccuggauccgguaagacacgacgguaucucccggccauuguucgcgaagcuaucaaaagaaaguuaaggacgcugguccuugccccaacucgggugguggcaucagagauggcugaagcccugaaaggcaugcccauacgauaccaaaccacagcggucaagucugagcauaccgggaaagaaauuguagaucucaugugccacgccacuuucacaaugagauugcugagcccugugcgcguuccaaacuauaauaugaucaucauggacgaggcacauuuuaccgaucccgcuaguauugccgcuaggggauacaucuccacgcgugugggcaugggugaggcagccgccauauucaugacugcuacaccuccggggagcgucgaagcguuuccccagucuaacgcagugauucaggacgaggaaaaggauaucccagagcggucauggaacuccggauaugacuggauuaccgauuucccuggcaagaccguuugguuugugcccaguaucaaaagcggcaacgacauagccaauugucucagaaagaacgggaaaagggucauucagcugucgcgcaagacuuucgacacagaauaccagaaaaccaagaacaaugauugggacuaugugguaacaacugauaucucugagaugggagcuaacuuucgagccgacagagugaucgauccacggaggugccuuaagccuguuauucuaaaagacggucccgagcgcgucauccuggcaggcccaaugccggugacgguggccuccgcugcgcagcguagagggcggauuggaaggaaucagaacaaggaaggcgaucaguacauauacaugggucaaccuuugaauaacgacgaggaucacgcccacuggaccgaagcaaaaauguuacuggacaauaucaacacacccgaggggauuaucccagcucucuucgagcccgaacgcgaaaagagcgccgcaaucgauggcgaauaucgacugagaggagaggcccggaaaacuuucgucgaacuuaugaggcgcggcgaccugccuguuuggcucucauacaagguggcuagugagggguuucaguauucugauagaagguggugcuucgacggagagcggaauaaccagguauuggaagagaauauggacguggaaauuuggaccaaagagggugaacguaagaagcugcgcccacgauggcuagaugccagaacauacuccgacccccuggcgcucagggaguuuaaagaguucgcagccggccggcgcagcgucucaggggaucuuauacuggaaaucggaaaguuaccucagcauuugacccaaagagcucagaacgcccuggacaaucucgugaugcugcacaacagugagcagggcgguaaggcuuauaggcaugcaauggaggagcuuccggauacuauugaaacgaucaugcugcucgccuugauugcuguucugaccgggggcgugacauuauuuuuccuaagcggacggggccuggggaagacuuccaucggacuccuuugugucaccucuagcuccgcccuguuguggauggcaucaguagagccacacuggauagcggccucuaucauucuggaguuuuuccucauggugcugcuuauccccgaaccugaccgacagagaacaccccaagauaaucagcucgcuuacguugugauuggucuguuguuuaugauccugaccgucgccgcaaacgagaugggcuuacuagaaacuacuaaaaaggaccuggggauaggacacgcugccgcagagaaccaucaccaugccgcuaugcucgauguggaccuucacccagcgagugccuggacgcuguaugcagucgcuaccacuauuaucacaccuaugaugcgccauaccauugagaauaccacagccaacaucucguugacugccauagcaaaucaggcugccauccugaugggccucgauaaggguuggcccauuagcaaaauggacaucggggugccacugcuugcguuaggcugcuacucccaaguuaacccucugacgcucaccgcugccguguugaugcugguagcacacuacgccauuaucggaccgggccuacaggcuaaggcaacaagggaagcccagaaacggacugcggcugggauaaugaagaaucccaccguggauggaauugucgccaucgaccuggacccaguuguguaugaugcaaaauucgagaagcagcucggccaaaucaugcuucugauuuuguguacaucucagauccugcucaugcguaccacuugggcccugugcgaaucaauaacguuagcuacagguccucuuaccacucugugggaggggagccccggaaaguuuuggaacaccacaauugccgucuccauggcaaauaucuucagaggcaguuaccucgcuggugccggccuagcguuuucucugaugaaaagccuagggggaggcaggcgcgggacuggagcccagggcgaaacccugggugagaaguggaaacggcagcucaaccaacuuucaaaguccgaguucaauacauauaaacgaagugggauuaucgaaguggacagaagcgaggcaaaggaaggacugaagaggggcgagacgaccaaacacgcuguaucucgcgguacugccaaguugcggugguucguggaaagaaaccugguuaaaccagagggcaaggugauagaucucggguguggacguggcgggugguccuacuauugcgcaggacugaaaaaggucacagaggugaaaggcuacaccaagggugggccuggacaugaggagcccaucccgauggcuacuuauggcuggaaucuagucaaacuucacucaggcaaagacguguuuuucauuccaccugaaaagugugauacacugcuaugcgacaucggggagagcucgcccaacccaaccauugaagagggaaggacgcuccggguucugaaaaugguagagcccugguugcgcgguaaucaguuuuguaucaagauucugaacccuuacaugccgucuguggucgaaacccucgagcagaugcagcgaaaacauggcgggaugcuugugagaaauccccugaguaggaacuccacacacgaaauguacuggguuagcugcggaacuggcaauaucgugucagccgucaacaugaccucccggauguuacugaaccgcuucacaauggcccacagaaagccaacuuaugagagggauguggacuugggugcggggacccgacauguagcuguggagccugaaguugcaaaucucgauauaauuggacaacggaucgagaacaucaagaaugaacacaaaucuacauggcauuacgacgaggauaaccccuauaagaccugggccuaccacggcagcuaugaagucaaaccuaguggcuccgcuagcucuauggugaauggggugguccgucugcuaacuaagccaugggacguuauucccauggugacgcagauagccaugacagacaccacuccuuuuggacagcaaagaguauucaaagagaagguggauacccgcacaccaaaggcaaaaagggguacggcccagaucauggaggucaccgcuaaguggcuuuggggcuuucugucacggaacaaaaagcccagaauuuguacucgcgaagaguucacaaggaaagugcgaaguaaugcggccaucggggcaguuuuuguggacgaaaaccaguggaacuccgcuaaggaggccgucgaagaugagcgguucugggaccucgugagaagggagcgcgaacugcauaagcagggaaaaugcgcaaccugcguauacaacaugaugggcaagcgugagaaaaaguugggugaauuugggaaagccaagggaagccgggcuauuugguauauguggcugggcgccagauuccucgaguuugaagcgcuuggcuucaugaaugaggaucacugguucucuagggagaacucgcugucagggguugaaggagaggguuuacacaaacugggcuacaucuugcgcgacauaagcaagaucccagggggaaauauguacgcagaugacacugccggcugggauacacgaauuaccgaagacgaucuccaaaacgaggcuaagaucacagacauuauggagccugaacaugcccugcuagcaacuuccaucuuuaaacuuaccuaucagaauaaggugguccgggugcagagaccagcuaaaaacgguacggugauggaugucauaaguaggcgcgaccagagagggucuggacaaguuggcaccuacggccugaacacauucacuaauauggaggcccagcucauucggcagauggaaagcgaggggaucuuuucccccucagaacuggagaccccuaacuuggcuggaaggguguuagacuggcuggagaagcacgguacagaacgucuccgacgcauggccaucaguggcgaugacuguguagugaaaccaauugaugacagauucgcaacugcgcuuaccgcccugaaugauauggggaagguccggaaggacauaccccagugggagccgucuaaaggauggaacgauuggcaacaggugccuuuuugcagccaucacuuccaccagcuaaucaugaaggacggcagggaaauuguugugcccugucgcaaucaggaugagcuggucgguagagcucgggugucccaaggggccggauggucacucagggaaacggcaugcuugggcaaaagcuaugcucagauguggcagcugauguacuuucaucgacgugaccuuagacuggccgcaaacgccaucuguucugcgguaccaguugauugggugccuacaucccgcaccacuuggaguauucacgcucaucaccaauggaugacaaccgaggacaugcucagcgucuggaaucggguguggaucgaggaaaaccccuggauggaggacaagacucauguuucguccugggaagaugugccauauuuaggcaaaagggaggaccaguggugcgggucucugauaggauugaccgccagagcaacaugggccacgaauauccaggucgcuauuaaccaggugcgccggcugaucgguaaugaaaacuaccucgauuauaugaccucaaugaagagguucaagaaugagagcgaccccgagggcgcccuuugguga

SEQ ID NO: 13445 - RNA, 9879 nt, Artificial Sequence
  derived and/or modified CDS sequence (opt3) from DENV-1__GQ868602__SS-prME
uccgugaccaugcugcucaugcuucugcccacugccuuggcuuuccacuuaacuacgcggggaggggaaccucauaugaucguauccaagcaggaaaggggaaaaucucugcuauuuaagaccucagccgguguuaauaugugcacccucauugccauggaccugggcgaacuuugugaagauacuaugaccuacaaaugcccacggauaacagagaccgaaccggacgauguggacuguuggugcaaugcgacugagacauggguaaccuaugggacguguagucaaacuggagagcaccgccgagauaagcguagcguggcucuggcaccccaugucggcuugggucucgaaaccagaacagagacuuggauguccucugaaggggcauggaggcagauccagaaaguggagaccugggcccugcggcacccuggauucacaguuauugcucuguuucucgcccaugccaucggcaccucgauuacgcagaagggcaucauuuucaucuuacugaugcuugugacuccaucaauggcuaugcgcugcgucgggauuggaaauagggacuuuguggaggguuugagcggcgccacauggguagauguugugcuggaacacgggaguugugucaccacuauggcgaaggacaaacccacacuagauaucgagcuccugaagaccgaagugacgaauccugcagugcuuaggaaacugugcauugaggccaagaucuccaacaccacaacugacucucgguguccaacccaaggagaagcuacauuggucgaggagcaggauacuaauuucguuugccgccgaaccuuuguggacagaggcugggguaacggguguggacucuucggcaaaggcagccugauaacaugcgccaaguuuaagugcguaaccaaauuagaagggaagauugugcaguacgagaaucugaaauauuccgucaucgugacuguucacacgggagaucagcaucaaguggguaacgaaacaaccgagcacggcacuaccgcaacaauuacaccccaggcuccuacuucagaaauccagcucacagacuacggggcccuuacgcuggacuguaguccaaggaccggauuggauuucaaugagaugguccuacugacuaugaaggagaaaagcuggcucgugcauaagcagugguuucuggaccuuccgcugcccuggacaucuggcgcguccaccucacaagaaacauggaaccggcaggauuugcucguaacuuucaaaaccgcccacgcaaagaagcaggagguugugguccuggguagccaagaaggggcuaugcacacggccuuaaccggcgcuacagagauccagacaaguggaaccacaacuauuuuugccggccaucugaaaugccgucuaaagauggacaaacucacccugaagggggugucuuaugucauguguacgggauccuucaaacuugaaaaggagguggcagagacacagcacgguaccguuuuggugcagguaaaguacgaaggcacugaugccccuugcaaaauaccauucagcucgcaagacgagaagggggucacacagaauggacgccugaucaccgcuaaccccauugugacugauaaagaaaagccuguuaauaucgaggcggagccacccuuuggcgaaucuuaucucguggucggugcaggggagaaagcccugaaacuuuccugguucaagaaaggcucaaguauaggaaagauguuugaagcuaccgccagaggcgcaaggcggauggccauucugggggacacagcuugggauuucggaagcaucgguggcguguuuacguccguagggaaauugauccaucagauuuucggaaccgccuacggcgugcucuuuucugguguuagcuggacuaugaagaucgggauuggcauacuguuaacauggcugggacuaaacucacgaaguaccucccucagcaugacauguaucgcagucggcauggugacucuguaccuuggggugaugguccaggcggacucuggaugcguuauuaauuggaaaggccgcgaguugaagugugguucagggaucuucgugaccaacgaagugcacacguggacagagcaauauaaguuucaggcugauaguccgaaaagacugagcgccgcaaucggaaaggccugggaggaaggcguaugcgguauuagguccgcuacccggcucgagaacauaauguggaaacagaucucuaaugaacugaaccauauuuuacuggagaaugacaugaaguucacugucgugguuggcgacgugaacgggguccuugcccagggcaagaaaaugauccgcccucaacccauggaacacaaauacucguggaaaagcuggggcaaggcaaaggugauuggggcugauguucagaauaucaccuuuauaaucgacggaccaaacacaccugagugucccgaugaccagagagccuggaauauuugggagguggaagauuauggcuucgguaucuuuacuaccaacauuugguugaagcucagggacuccuacacacagguaugcgaucaccgucugaugucagcggccaucaaagacaguaaggcuguccaugcagauaugggguauuggauagagucugagaagaaugagacguggaagcuaacccgggccagcuucauugaagugaagacuuguaucuggccaaaaucccacacacuguggucaaacggagugcucgagagcgagaugauuauccccaagauauacggcgguccuaucucucaacauaauuaucgaccaggcuacuucacccagacugcugggccguggcaccugggaaaacuugaauuggacuuuggccugugcgaggggacaaccgucguuguggaugaacacugcggaaacagaggccccuccuuaaggacgacuaccguaacagguaagauuauccaugagugguguugccgcaguuguacccucccuccacugcgguucaaaggggaggacggaugcugguacggcauggaaauuagacccgugaaggagaaggaagagaaucuugucaaaagcauggugucugccgguuccggcgaaguugauucauuuagucugggguugcucuguaucagcauaaugauugaggaggugaugaggucgcgcuggucccgaaagaugcugaugacuggaacacuagcagucuuccugcuccugaucaugggccagcuuaccuggaacgacuugauccggcugugcauuauggugggggcgaaugccucugacaaaaugggaaugggcacaacuuauuuagcucucauggccaccuuucguaugagaccuauguucgcaguuggucugcuuuuuaggcgccugacgagccgggaagugcuacuccugacagucggguugucacugguagcuaguguggaguuaccaaacucccucgaagaacugggagauggccuugccaugggcaucaugaugcugaaguugcucaccgacuuccaaucucaccagcugugggcaacucuacugagccuuaccuuuguuaaaacaacuuucucccuccauuacgccuggaagaccauggcuaugauucugucaauagugagcuuguuuccccuguguuuaaguacgacaucucagaagaccacuuggcucccgguccugcuugggucccugggaugcaaaccuuugacaauguuccucaucaccgaaaacaagauuugggguagaaaaagcuggccacugaaugagggcaucauggcgguggggauuguaucgauccuacugucaucucuucucaagaacgaugugccccuggccggaccuuugauagcaggcgguauguuaaucgcuuguuaugucauuaguggguccagcgccgaccugucucucgagaaagccgcugaaguuagcugggaggaagaggcagaacacuccggagccucacauaauauccugguggaggugcaggaugacggcacuaugaagauuaaagaugaggaaagggacgauacacuuaccauccuguugaaggcgacgcuacuggcuauaaguggcgucuaccccaugagcauuccagccacucucuuugugugguauuucuggcaaaagaaaaagcagcgaucugggguucugugggacaccccuucacccccagagguagaacgcgcagugcuugaugacggaaucuaccggaucuuacagagaggucugcucggcaaaagccaggucggggugggaguuuuccaagagggcguguuucacacaauguggcacgucaccaggggugccguguugauguaucaggggaagcgucuggagccgaguugggcuagcgucaaaaaggaucucauuuccuacggaggcggcuggcgcuuccaggggucuuggaacaugggagaagagguccaggugauagcaguugaaccugguaagaaucccaaaaacgugcaaacagccccaggcacuuuuaagacccccgagggggaagucggagcgaucgcucuggacuucaaaccuggcacgucggguagcccaauugugaaucgggaggggaagaucguuggacuuuacggcaacggcguggucacaacuucagggaccuauguguccgccauugcacaggccaaagcuagucaggagggaccccugccugaaaucgaggacgaaguauuuagaaagaggaauuugacaauaauggaucuacauccggguucuggcaagacccgacgguaccugccagccaucgugcgcgaggcaauuaaaagaaagcucaggacuuuaguucuggcucccacccgggucguggccagcgaaauggcggaggcccuuaaagggaugccuauccgauaucaaacaacggcagugaaguccgagcacacuggaaaagaaauugucgaccugaugugccaugcuaccuucacaaugagacucuugucaccaguacgcgugcccaacuacaauaugaucauaauggaugaggcccacuuuaccgacccugcuucuauugcagccaggggcuauaucagcacucguguugguaugggggaagccgcugcgaucuucaugacagcaaccccgcccggaaguauggaggccuuuccacaguccaacgcugccauucaggaugaagaacgggacaucccugagagaagcuggaacucuggcuacgauuggauaacggacuuccccggcaagacugugugguuugucccaucaauuaaguccgggaacgauaucgcaaauugucugaggaaaaacggaaagcgcgugguucagcucagucgaaaaacauucgacaccgaauaucaaaagaccaaaaacaaugauugggacuacguggucacuacagacauuagcgagaugggugccaacuucagagcugaucgggugaucgacccuaggcgcugccugaagcccguaauacuuaaggauggcccagaacgugugauucuagcggggccgaugccuguuaccgucgccucggcagcucagagacggggaaggaucggccgcaaucagaacaaagagggugaccaguacaucuauauggggcaaccccugaauaacgaugaggaccaugcccacuggacagaagcaaagauguuguuagauaauauuaacacuccagagggcaucauucccgcccuguuugaaccugagcgagaaaaaucugcugccauagacggagaguacagacuccggggcgaggcgaggaagacguucguggaacugaugcgcagaggggaucuuccaguguggcuguccuauaaagucgcaagcgagggauuucaguacucagacaggcgguggugcuucgauggugaacguaauaaccagguucucuugaagaauauggacguggagaucuggaccaaagaaggcgagcgcaagaagcugcgacccagauggcuagaugccaggacauauagugacccucuggcucuccgggaguuuaaagaguucgccgcugggcgcagaucuguauccggagaccuuauucuggagaucggcaaguuaccgcagcacuugacucaaagggcacagaacgcccuggauaaucucgugaugcugcauaacagcgaacagggugggaaggcuuaccggcacgccauggaggaacuuccagacaccaucgagacacugaugcucuuggcacugauugcggucuuaaccggcggagugacucuauuuuuccugucaggccgagggcucggaaagacgaguauaggucuucuguguguuauggccagcuccgcuuugcuguggauggccucuguggagccccauuggaucgcagcuagcauuauccucgaauuuuuccugaugguccuucucauuccugagcccgauagacagcgcaccccacaagacaaucagcuggccuauguagugaucggcuugcuguuuaugauauuaacaguugcagccaacgaaauggggcuacuggagacuaccaaaaaggaucucggaaucggccacguggcugcggagucccaccaucacgccgcaaugcuugacgucgaucugcauccugcuucagccuggacauuguacgccguggcaaccacuauuaucacacccaugaugaggcacacgauugaaaacaccacugcuaauaucucucugacagccauagcgaaccaggcugccauucucaugggucuggacaagggguggccaaucaguaaaauggauauuggcgucccucuuuuagcacugggaugcuacucgcaagugaauccgcucaccuugaccgccgcuguucugaugcuaguggcacauuaugccaucauaggccccgggcugcaggcgaaggcuacacgggaggcccagaaacguacugcagccggaaucaugaagaacccaacgguagacggcauuguggcuaucgaucucgacccugucguuuacgaugccaaauucgaaaagcagcuuggucaaauuaugcuguugauccuguguaccagccagauacuccugaugagaacaacuugggcauuaugcgaguccauuacccuugcuacagggccccugaccacucucugggaaggaucuccaggcaaguuuuggaauacgacaaucgccgugucaauggcgaacaucuucagggguagcuaucuagccggcgcagggcuggcuuucuccuugaugaaaagucugggaggcgggcgccggggaaccggcgcccagggugagacucucggggagaaguggaaacgacagcuuaaucaacugucuaagagcgaauuuaacaccuacaaaagaucaggaauuaucgaggucgacagguccgaagcaaaggagggcuugaagcgcggugaaacaacuaaacacgcugugagucggggcaccgccaagcugagaugguucguagagcguaaucucgugaaaccugaggggaagguuauagacuuaggauguggcagagggggauggagcuauuacugcgccggccugaaaaaggugacagaagucaaagguuauacgaaagggggacccggccacgaggaaccgauuccaauggcgaccuacggcuggaaccuugugaagcuguacucugggaaagaugucuuuuucacuccucccgagaagugugacacacuacucugcgauaucggagaauccucaccaaaucccaccauugaggagggucggacucugcgcguguugaaaaugguugaaccuuggcugcgaggcaaccaguuuuguaucaagguacucaauccguauaugcccagcguggucgagacacuugaacagaugcagagaaaacaugggggaaugcuggugaggaacccauuaucgagaaauucuacccacgagauguacuggguuaguugcggcacggguaacauaguguccgcugucaauaugaccagccgcaugcuguugaacagauucacaauggcacauaggaagccuacuuaugagcgagacguggaucucggggccggaacccggaacguagcuguggaacccgagguugccaaucuggacaucauuggccaacguaucgaaaacauuaagaaugagcacaaaucaacauggcacuacgaugaagacaacccuuauaagacuugggcauaccauggcuccuaugaggucaaaccaucugggagcgccaguuccauggugaauggaguggucagacuacuuaccaagcccugggauguuaucccuauggugacacagauugcuaugaccgacacuacgccauuuggucagcaacgcguauucaaagagaagguggauacaaggacccccaaggcgaaacggggcacugcccagaucauggaagucaccgcaagauggcuguggggguuucucagccgcaacaagaaaccgaggauauguacacgagaggaguucacgcggaaggugagaucuaaugcugccauuggagcaguuuuuaucgacgagaaccaguggaacucagccaaagaagcuguggaggacgagagguucugggaucugguccaccgcgaacgugaguugcauaagcagggcaagugcgcaaccugcguguacaacaugauggguaaacgggaaaagaaacugggggaguuuggaaaggcgaaaggcaguagagcaaucugguacauguggcucggcgccagguuccuugaguucgaggcucugggguuuaugaaugaggaccacugguucucccgcgaaaacagcuuaucuggaguagagggugaaggccugcauaaguugggguauauucuccgagauauaucgaaaaucccuggaggcaauauguacgccgacgauacugcagguugggacacacggauuaccgaggaugaccugcaaaacgaggcuaagaucacugauauuauggaaccagagcacgcccuacuugcuacaucaaucuuuaagcugaccuaucagaauaaaguugugagaguccagaggcccgccaagaacgggacagugauggacgugauaagccgcagagaucagcggggauccggccaagucggcacuuacgggcucaacaccuucacgaauauggaagcacagcugaucaggcagauggagagugaaggaauauuuuugccuucugaguuagagaccccaaaccuggcggaacguguucucgacuggcuugagaaacacgguaucgaacgacugaagcgcauggccauuagcggcgaugacugugugguaaaacccaucgacgauagauucgcuacagcccuaacugcacugaaugacauggggaaggugcggaaggauauaccgcagugggagccuuccaaaggauggaacgacuggcaacagguccccuuuugcucacaucacuuccaucagcucauuaugaaggauggcagggaaaucgugguuccaugucgcaaucaggacgaguugguggguagagcucgggucagucaaggggccggauggucucugagggagaccgcaugccuuggcaaaagcuaugcccagauguggcagcugauguacuuucaccgacgugaucucagauuagcggcuaacgccaucuguuccgcagugccuguagacuggguucccacaucacgcacuaccuggagcauucacgcccaucaccaauggaugacgacagaagauaugcugucuguguggaaucgggucuggauagaggaaaacccauggauggaggacaagacccauguguccaguugggaagauguucccuauuugggcaaaagggaggaccaguggugcgggagccugaucggacucacugcuagagccacaugggcaaccaauauucagguggcuaucaaccagguccgccggcuuauugguaaugagaacuaccuggacuacaugacuucgaugaagagguucaagaaugaaaacgauccugagggcgcccuaugguga

SEQ ID NO: 13446 - RNA, 9879 nt, Artificial Sequence
  derived and/or modified CDS sequence (opt3) from DENV-1__KF921911__SS-prME
agcgugaccaugcugcucaugcuucugcccaccgccuuggcuuuccacuuaacuacgagaggaggggagccucauaugaucgucuccaagcaggaaaggggaaaaucucuguuauuuaagaccucaguugguauuaacaugugcacacucauagcaauggaccugggagagcuuugugaagauacuaugaccuacaaaugcccacggaucacagaggccgaaccggacgauguggacuguuggugcaaugcgaccgauacuuggguaacauaugggaccuguagucaaacgggagagcaccgccgagacaagcguagcguggcucuggcaccccaugucggcuugggucucgagacuagaaccgaaacauggauguccucugagggggcauggaaacagauucagaagguggaaacuugggcccugaggcacccuggauucaccguuacagcucuguuucucgcacaugccaucggcaccucgauuacgcagaagggcaucauauucaucuuacugaugcuugugacuccaucaauggcuaugcggugcgucgggauuggaaaccgcgauuuuguggaggguuugagcggcgccacauggguagacguugugcuggagcacgggaguugugucaccacuauggcgaaagauaagcccacacuagacaucgaacuccugaaaaccgaggugacgaauccugcagugcuuagaaagcugugcauugaagccaaaaucuccaacaccacaacugauucuagguguccaacccaaggagaggcuacauuggucgaggaacaggacagcaauuucguuugccggcgcacuuuuguggaucgaggcugggguaacggguguggacucuucggcaagggcucccuguuaaccugcgccaaguuuaaaugcguaacaaagcuggaggggaaaauagugcaguacgaaaaucucaaguauucagucauugugaccguucacacuggagaccagcaucaaguggguaacgagacgacagaacacggcaccaucgcaacuauuacaccccaggcuccuacaagugagauccagcuuaccgacuacggggcccugacuuuggauuguagcccaagaacaggacuagacuucaaugaaaugguccugcucacgaugaaagagaagucuuggcuggugcauaaacagugguuucuugaucugccguugcccuggaccuccggcgcgucaacuagccaagagacauggaacaggcaggaccuccugguaaccuucaagacagcccacgcaaagaaacaggaaguuguggucuuagguagucaagagggggcuaugcacacugcccugaccggcgcuacggaaauccagaccucuggaacaacuaccauuuuugccggccaucuaaagugccggcucaaaauggauaagcugacacuuaaagggauguccuaugugauguguacuggcagcuucaaguuggagaaggaagucgcagagacccagcacgguacggugcugguucaggugaaauacgagggcacagacgccccuugcaagauaccauucucggcucaagaugaaaaagggguaacccagaauggacgucucaucacugcgaaccccauugucacagacaaggagaaaccugugaauaucgaaaccgagccacccuuuggcgagucuuauauaguuauuggugcaggggaaaaggcccugaaacuuuccugguucaaaaagggcucaaguaucggaaaaauguuugaggcuacugcccgcggcgcaagaaggauggccauccugggggauaccgcuugggacuucggaagcauugguggcguguuuacauccgucgggaaguuggugcaucagguauucggagccgcauacggcgugcucuuuucugguguuagcuggacgaugaaaaucgggauuggcauacuguuaaccuggcugggacuaaacucacggaguacuucccucagcaugacauguaucgcggucggcauggugacccuguaccuuggggugaugguccaggcugauucuggaugcguuauuaauuggaagggccgagaauugaagugugguucagggaucuucgugacaaacgaggugcacacuuggaccgaacaauauaaauuucaggccgacaguccgaagcgccugagcgcagccaucggaaaggcuugggaggagggcguaugcgguauuagauccgccacgaggcucgaaaacauaauguggaagcagaucucuaaugagcugaaccauauuuuacuggaaaaugacaugaaauucacagucgugguuggcgaugcaaacgggauccuugcucagggaaagaaaaugauucggccucaacccauggagcaccgcuacucguggaaaagcuggggcaaggccaaaaucauaggggcggacauccagaauaccacuuuuauuaucgauggaccagacaccccugaaugucccgaugaccagagagccuggaacauuugggagguggaggauuauggcuucgguaucuuuacaacuaauauaugguugaagcucagggacuccuacacccagaugugcgaucaccgucugaugucagcugcaauuaaagacaguaaggccguccaugcugauaugggguauuggaucgaaucugagaaaaacgaaacauggaagcuagcccgggccagcuucauugaggugaagacguguaucuggccaaaaucccacacccuguggucaaauggaguucucgaaagcgagaugauaauccccaagauuuacggcgguccuaucucucaacauaacuaucgaccaggcuacuucacucagacagcggggccguggcaccugggaaaacuugaguuggacuuugaucugugcgaaggcaccacugugguagucgacgagcacugcgggaauagaggacccuccuuaaggacaaccacggugacuggcaagauuauccaugaaugguguugccgcaguuguacccucccuccacugcgguucagaggugaggacgggugcugguacggaauggagauaaggcccgugaaagaaaaggaggaaaaccuuguccgcagcaugguuucugccggcuccggugagguggauucauuuagucugggcauuuuguguguaagcaucaugaucgaagaggugaugcgaucgcgguggaaucguaagaugcucaugacagggacccuggcugucuuccuacugcucauuaugggacagcugacuuggaacgaccuuaucagauugugcauuauggugggcgccaaugcauccgauaggauggggaugggaacaaccuaucuggcuuuaauggccacauuuaaaaugcgcccuauguucgcaguuggccuccuguuucggagacuuacuucuagggaggugcugcuacucaccauaggucugagcuuggucgccucaguggaacugccaaacaguuuagaggaacucggggacggacuggcuaugggcaucaugaugcuuaagcuguugacggaguuccaaccccaccagcucuggacaacccugcuaucccugacuuuuauuaaaaccacacuuucucucgauuacgcguggcgaacuauggccaugguucugagcaucguguccuuguucccgcuguguuuaucaaccacgagccagaagacaaccuggcucccuguccugcuuggcaguuuugggugcaaaccacugacuauguucuugauuacagaaaacaagaucuggggacgcaagucuuggccccucaaugaggguauaauggcaaucggcauuguauccauccugcuaagcucgcugcuuaaaaacgacgugccucucgcugggccccugauugccggaggcauguugaucgccuguuauguuauaucagguucuagugcugauuuaucccuggagaaggcagccgaagugagcugggaggaagaggcggaacauucugggaccagccacaauauucucgucgaggugcaggacgauggaacuaugaaaaucaaggacgaggaacgggaugacacacugaccauccuucugaaagcuacguugcuagccguauccggcguguacccaaugucaauuccugcaacucuguuugucugguauuucuggcaaaagaaaaagcagagaaguggcguucucugggauacccccagcccaccggagguggaaagggccgugcuggacgacgggauauaccguauccuucagcgcggauuacugggucggucucaggucggcguggggguuuuccaagauggaguauuucauacaauguggcacgugaccagaggcgcuguccucauguaucaggguaagagguuggagccuuccugggcaucagugaaaaaggaccugauuaguuacgggggaggcuggcgauuccagggcagcuggaacacaggggaggaaguucaggugaucgccgucgagcccggcaagaauccaaagaacgugcaaacuacccccgguacguuuaaaacaccugaaggcgagguaggggcgauugcucucgauuucaagccaggaacuuccggcucucccaucgucaaucgggaagguaagauagugucgcuguacgggaacggaguugugaccacaagcggcaccuaugucucagccaucgcacaggccaaaacuucccaggagggcccucuuccggagauugaagacgagguguuuaagaaacgcaaucugaccaucauggauuugcacccagggaguggaaagacaagaagguaccuacccgcuauuguucgggaagccaucaaacgaaagcugagaacgcucauauuagcaccuacucgcguggucgcuucugagauggccgaagcgcugaaggguaugccaauuagguaucaaaccacagccgugaaaagcgagcauaccggccgugagaucguagaccuuaugugccacgcaacuuucacaaugcggcugcucucccccgugagaguuccuaacuacaauaugaucauuauggaugaagcucauuuuaccgacccggccucaaucgcugcaaggggguauauaucuacgcgcgucggaaugggcgaggccgccgcuauuuucaugacugcgacacccccagguagcguggaagcauuuccucagaguaacgccgugauccaggaugaggaacgagacauucccgagagauccuggaauagcggguacgauuggaucaccgacuucccaggaaagaccgucugguuuguaccuucuauaaaaucaggcaacgacauugcuaauuguuugcggaagaacggcaaaagggugauccagcugucccgcaagacuuucgauacagaguaucaaaagaccaaaaacaaugacugggauuacguugugacaacugacaucagugaaaugggggccaacuuccgugcagauagagucauugacccccggaggugccucaagccagugauccugaaagauggaccggagcgcguuauucuugccgguccuaugcccgugacggucgcuagcgcggcccagcgaagaggccggauagggaggaaucagaacaaggaaggagaccaguacguguauaugggccaaccacuaaauaacgaugaggaccacgcacauuggaccgaggcuaaaaugcuguuggauaauaucaacacacccgaagguauuaucccugccuuauuugagccagaacgcgagaagucggcagccaucgacggggaauacagacugaggggcgaggcucggaagacuuucguagagcucaugcgucgcggagaucugcccguguggcuuucuuauaaaguugccuccgaaggcuuucaguacagcgaccgaagauggugcuucgacggggagaggaauaaccagguccuggaagagaauauggauguggaaauuuggaccaaggagggagagcggaaaaagcuccgcccuagaugguuggacgcgaggacauauucagauccgcuggcacuacgggaauuuaaagaguucgccgcuggucgaagaagugugucuggcgaccugauacucgaaaucgggaaacuuccacagcaccugaccuuacgcgcccaaaacgcuuuggauaaucuggucaugcuccacaacuccgagcagggaggcaaagcauacaggcaugccauggaggaacugcccgacacuauugagacgcuuaugcugcucgcuuugaucgccguucugaccgguggggugacauuauuuuuccuaagcggcaagggacugggcaagacuucaauugggcuccuuuguguaauggcaaguagcgcgcuguuguggauggccaauguggaaccucacuggaucgcugccuccauaauccuggaguuuuuccucaugguccugcuuauucccgaaccagaucggcagcguaccccucaggacaaccaacucgcauaugugguuaucggacuguuguuuaugauucugacaguggcugccaacgagauggguuuacuagagaccacuaaaaaggaucugggcaucgggcaugucgcagccgaaaaucagcaccacgcuacaaugcucgacguagaucuuagacccgcgucugccuggacgcuguacgcaguggcuaccacuguuauaacaccaaugaugaggcauaccauugagaacaccacagccaauaucagcuugacugccauugcaaaccaggcugccauccugaugggacucgacaaaggcuggccuauauccaagauggauaucggugugccgcugcuugcguuagggugcuacucacaagucaauccccugacgcucaccgcugccguguugaugcuggucgcacacuaugccauuaucggcccaggacuacaggcuaaagcaacacgcgaagcccagaagcggacugcggcuggcauuaugaagaacccuaccguggacgggaucguugccauagaccuggaucccgugguauacgacgcaaaauucgagaagcagcucggacaaauuaugcuucugaucuuguguacaucucagauccugcucaugcgaaccacuugggcccugugcgaaaguauuacguuagcuacaggcccacuuaccacucugugggaggguucgccugggaaauuuuggaauaccacaaucgccgugagcauggcaaacauauucagaggauccuaucucgcuggcgccggucuagcguucucucugaugaagucauugggcgggggaaggcgcggcacuggggcccagggagagacccugggcgaaaaauggaagcggcagcucaaucaacuuagcaaguccgaguuuaacacauacaaaagaagugguauuauggaagucgaucguucugaggcaaaggaagggcugaaaaggggagagacgaccaagcaugcuguuagccggggcacugccaaauugcgcugguucguggagcgaaaucuggucaagcccgaagguaaggugaucgaccucggcugugggagaggaggcuggucauauuacugcgcagggcuaaagaagguaacagaggugaaaggauauaccaagggcgguccggggcacgaggagccaauuccuauggcuacuuacggauggaaccugguuaaacuuuacuccggcaaggauguguuuuucacacccccagaaaaaugugacacccugcuaugcgauaucggcgagaguagccccaauccuacgauagaggaagggaggacccuccggguccugaagaugguggagccgugguugcgcggaaaccaguuuuguaucaagauucugaaucccuauaugccaucugucguggaaacacucgagcagaugcagagaaaacaugguggcaugcuuguuaggaacccucugucccgaaauucaacucacgagauguacuggguaagcugcgggaccggaaacaucgugucggccgucaacaugacaucucggauguuacugaaucguuucacuauggcccacagaaagcccaccuaugaacgcgacguggauuugggcgcggguacaaggcauguugcuguggagccugaagucgcaaaccucgacauuaucgggcaacggauugagaauaucaaaaacgaacacaagaguaccuggcauuacgaugaggacaauccauauaaaacuugggccuaccacggauccuaugaggugaagcccagcggcucagcuuccucuaugguaaacggcgugguuagacugcuaacgaagccuugggacgucauaccaauggugacacagauugccaugaccgauacuacccccuuugggcagcaacgcguguucaaagaaaaggucgacacaaggacgccgcgagcaaaacggggaaccgcccagaucauggagguuacugcuaaguggcuuugggguuuucugagcagaaauaaaaagccuaggaucuguacacgcgaagaguucacccguaaggugcggaguaacgcggccauuggcgcaguauuuguggaugaaaaucaguggaacuccgcuaaagaggccgucgaggacgaaagauucugggaucucguguacagggagcgcgaacugcacaagcaggggaaaugcgcaacuugcguuuacaauaugaugggaaagcgagagaaaaaguugggcgaauuugguaaggccaaagggagccgggcuauaugguauauguggcugggagccagauuccucgaguucgaggcgcuuggcuuuaugaacgaagaccauugguucucuagggaaaauucauuuaguggcguggaaggggagggacugcacaaguuagguuacauccugcgcgauauuuccaaaaucccaggcgggaacauguaugcagacgauacagccggaugggacaccagaauuacagaggaugacuugcaaaaugaagcuaagaucacugauauaauggagcccgaacaugcccuccuggcaaccagcaucuucaaacuaacguaccagaacaaggucgugcggguacagaggccugcuaaaaacggcaccguuauggacgugauuucucgucgagaccagcgcgguucggggcaagucggaacauauggccuuaauacuuuuaccaacauggaggugcagcugaucagacagauggaaucagagggcauuuuccucccaagcgagcuggaaacacccaauuuggccgagcggguguuagauuggcuggaaaagcacgggacugagaggcucaagcgcauggcuaucuccggagacgauugugucguuaaaccgguggacgauagauuugccaccgcacuuauagcgcugaacgacauggguaagguacggaaagauauuccucagugggaacccaguaagggcuggaaugacuggcaacaggugccauucugcucucaucacuuucaccagcuaaucaugaaagaugggagggagaucgucgugccuugucgaaaccaggacgagcugguuggacgugccagagugagccaaggcgcugguuggucccuccgcgaaacggccugcuuggggaagucauacgcacagauguggcagcugauguauuuccaucggagggaucuuagacuggcugccaaugcaauuuguagugccguccccguggacuggguaccaacaucucgcaccacuuggagcauacacgcgcaucaccaauggaugacaaccgaggacaugcucuccguuuggaaccggguguggaucgaagagaaucccuggauggaagauaagacucacgucucaagcugggaggaggugccuuacuuaggaaaaagggaagaccaguggugcggcucucugauuggcuugaccgcucgagccacaugggcaacgaacauccagguugccauuaaucaggugagacggcugaucgggaacgagaauuaccucgauuauaugaccuccaugaagagguuuaaaaacgaaagugacccagagggagcucuuugguga

SEQ ID NO: 13447 - RNA, 9879 nt, Artificial Sequence
  derived and/or modified CDS sequence (opt3) from DENV-1__KJ189350__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaaacggagagcaccgccgagagaagcguagcguggcccuggcaccccaugucggcuugggucucgaaacgagaacugagaccuggauguccucugaaggggccuggaaacagauccagaggguggagacaugggcucugcggcacccuggauucacuguuauugcauuuuuccuggcccaugcuaucggcaccucgauuacacagaagggcaucauauuuauccucuuaaugcuggugaccccaucaauggccaugcgcugcgucgggauuggaaauagagacuucguggagggucuuagcggcgcgacguggguagauguuguguuggaacacgggaguugugucacuacaauggcaaagaacaaacccacccuggacaucgagcuacucaagacugaagugacaaauccugccgugcugaggaaacuuugcauugaggcuaagaucuccaacaccacgaccgauucucgguguccaacacaaggagaagccacucuggucgaggagcaggacgcaaauuuuguuugccgccgaaccuucguggauagaggcugggguaacggguguggauuguuuggcaaaggcagccuccugacaugcgcuaaguucaagugcguaacuaaauuagaagggaagauagugcaguacgagaaucugaaauauuccgucauugugaccguucacacaggagaccagcaucaaguggguaacgaaaccacugagcacggcacgaucgccacaauuaccccccaggcgccuacuucagaaauccagcucaccgauuacggggcccuuacacuggacuguaguccaaggaccggauuggacuuuaaugagaugguccuacugacuaugaaggagaaaagcuggcucgugcauaagcagugguuccuggaucuuccgcugcccuggacaucuggcgcauccacgucacaagaaaccuggaaccggcaggacuugcucguaacuuuuaaaacagcucacgccaagaagcaggagguugugguccuggguagccaagaaggggcuaugcacaccgccuuaacaggcgcaacugagauccagaccaguggaacgaccacaauuuucgccggccaucugaaaugccgucuaaagauggauaaacucacucugaaggggaugucuuaugugauguguaccggauccuucaaacuugaaaaggaggucgcugagacacagcacgguacuguguugguucaggugaaguacgaaggcaccgacgcgccuugcaaaauaccauuuagcacgcaagaugagaaggggguaacacagaauggacgccugaucaccgcaaaccccauugucacugacaaagaaaagccugugaauaucgagacagagccacccuucggcgaaucguauauaguugugggugccggggagaaagcucucaagcugucuugguuuaagagaggcuccucaauuggaaaaauguucgaagccaccgcaaggggcgcccggcgaauggcuauccuuggggauacugccugggacuuuggaaguaucgguggcgucuucaccagcguggggaagcugguacaucagauuuuuggaacagcauacggcguguuguucuccgguguuucuuggacgaugaaaaucgggauuggcauacuccugaccugguuaggacugaacagccgcucaacuagucuauccaugacauguaucgcggucggcauggugacccucuaccugggggugaugguccaggcugauagcggaugcguuauuaacuggaagggcagagagcuuaaaugugguucugggaucuuugugacaaaugaagugcacacuuggaccgagcaauauaaguuccaggccgacucaccgaagagguugagugcagccaucggaaaagcuugggaggaaggcguaugcgguauucggagcgccacgcgccuggagaacauaauguggaagcagaucuccaaugaacucaaccauauucuguuagagaaugauaugaaauuuacagucgugguuggcgacgcaaacgggauccuggcucagggaaagaaaaugauuagaccucaacccauggaacacaaguacucuuggaaaucguggggcaaggccaagaucauaggggcggacauccagaauaccacuuucauuaucgauggaccagacaccccugagugucccgauggccagagggccuggaacauuugggagguggaagacuaugguuuuggggucuucacaacuaauaucuggcuuaaauugcgugauagcuacacccagaugugcgaccaccggcucauguccgcugcaauaaaggauucaaaagccgugcaugcugacaugggauauuggauugagagugaaaagaacgagacauggaaacuggcccgagcaucuuucaucgaaguuaagacguguaccuggccaaagagccacacucuaugguccaauggcgugcuggagucagagaugauuauccccaaaauauacgguggcccuaucagccaacauaacuauagaccaggguacuuuacacagaccgcgggaccguggcaccucggcaagcuggaacuugauuucgacuugugcgaggggacuacaguagucguggaugaacacugcggaaauaggggccccucucugcgcaccacgacugugaccgguaaaauuauccaugagugguguugccgguccuguacauuaccuccacucagauuuaggggggaggacggaugcugguacggcauggaaauucgccccgucaaggagaaagaagagaaccugguucgaaguauggugagcgccgguucuggcgaaguagauuccuucucacuugggauccugugugugaguauaaugauugaggaggucaugcggagccguuggucgagaaagauguugaugaccggaacucucgcuguguuucugcuacugaucaugggccagcucacauggaaugaccugaucaggcuuugcauuaugguuggggccaacgcauccgaccgcaugggaaugggcaccacauauuuggcucugauggccacuuucaagaugcggccuauguuugcaguggguuuacucuucagaaggcugaccucucgagaaguccuucugcuaacgaucgggcucagccugguggccucaguugaguugccaaacagucuggaagaguuaggagauggccucgcuaugggcauuaugaugcugaaacuucugacagaauuucaaccccaccaguuguggaccacucuccugucccuaaccuucgugaagacaacucugucucuugacuacgcguggaaaaccacggccauggcacucagcauagucucccuguuuccguugugucugucaacaaccagccagaagacuacaugguuaccuguacuccuggggaguuucggaugcaaaccacuuaccauguuucugaucacugagaauaagauuuggggucgcaagucuuggcccuugaacgagggcaucauggcuauugggaucguguccauacuccugagcucgcuacugaaaaaugauguuccucuugccggaccccucaucgccggcgguaugcugauugcuuguuaugugaucucagggucuagugcagacuuguccuuagaaaaggccgcggaggucagcugggaacaggaggcugaacauucuggagccagccacuccauucugguggagguacaagaugacggcacaaugaaaaucaaggaugaggaacgggacgauacccucacgauacugcuuaaagcaacucuguuggccgugucaggcgucuacccaaugaguauuccugcuacccuauucguuugguauuucuggcagaagaaaaagcagagaagcggggugcugugggacacacccucuccaccggagguggaaagggcaguccucgauaacggaaucuaccguauccugcagcgcggucuuuuaggccggucccaaguggggguuggaguauuucaggacggcguguuccauaccauguggcacgucacaagaggugccgugcugauguaucaggggaagaggcucgagccuucaugggcgaguguuaaaaaggauuugauuagcuacggaggcggcuggcgauuucagggguccuggaauacuggagaggaagugcaagucauagcuguggagcccgguaaaaacccaaagaauguacagaccacgcccggcacauucaaaacuccugaaggggaggucggagccaucgcacuggacuuuaagccaggcaccucugguucgcccauugugaaccgggaagggaagaucguuggacucuacggcaauggcguggucacaaccagcgggacuuaugugucagccauugcucaggccaaagcaucccaagagggaccucugccggagaucgaagacgagguuuucaagaaacgcaaccuuaccauaauggaucugcacccagguaguggcaagacaagaagguacuugcccgcuaucgugcgggaagccauuaaacgaaagcuaagaacgcugauccucgcgccuacucgcgucguggccucugagauggcagaagcuuuaaaggggaugccaauuagguaucagaccacagccguaaaaagcgagcauaccggacgugagaucguggaccugaugugccacgcuacuuuuacaaugcggcuucugucccccguuagagucccuaauuacaacaugauaauuauggaugaagcacauuucaccgacccggccucaaucgccgcuaggggcuauaucucuacgcgcguggguaugggggaggcggcagccauuuuuaugacugcuacacccccaggaagcguggaagccuucccucagaguaaugcagucauccaggaugaggaacgagacauacccgagagauccuggaacagcggcuacgauuggauuaccgacuuuccaggcaagaccguaugguucgugccuucuaucaaaucagggaaugauauugccaacugucuccggaagaacggaaaaaggguuauccaauugucccgcaagacuuucgacacagaguaucagaagaccaaaaauaacgauugggacuacguggucacaacugacauaagugaaaugggugcuaauuuucgugcggauagagugauugacccccggaggugccugaagccaguuauccucaaagauggcccggagcgcgugauccuggccgggccuaugcccgucacggcagcuagcgccgcacagcgaagaggacggauuggcaggaaccagaauaaggaaggugaccaauacguguauauggggcagccacuuaacaaugaugaggaccacgcccauuggaccgaggcuaaaaugcuacuggauaacaucaauacacccgaaggcauuauaccugccuuguucgagccagaacgcgagaagucggcggcaaucgacggagaauacagauuaaggggcgaggcccggaagacuuuuguagagcugaugcgucgcggggaucuccccguguggcugucuuauaaaguugcuuccgaaggauuccaguacagcgaccgaagauggugcuuugauggugagaggaacaaucagguccuugaagagaacauggacguggaaauuuggaccaaggagggcgagcggaaaaagcugcgcccuagauggcucgaugccaggacauauucagacccguuggcucugcgggaauucaaagaguuugcagccgggcgaagaagugugucuggagaccuaauccuggaaaucggcaagcucccacaacaccuuacccugcgcgcucagaaugccuuagauaacuuggucaugcugcacaauuccgagcagggugggaaagcauacaggcaugcgauggaagagcuccccgacacuauugagacgcugaugcuucuggcccucauagcuguuuugaccggcggagugacacuguucuuuuuaagcggcaaggggcuaggaaagacuucaaucggucugcucuguguaaccgccaguagcgcacuucuguggauggcuuccguggaaccucacuggauugccgcaucuaucauuuuggaguucuuucugaugguccuccugauccccgaaccagaucggcagcguacaccucaagacaaccagcuugccuaugugguuauaggccuccuguucaugaucuugaccguggcugcgaacgagauggggcuguuagagacuacaaaaaaggaucuaggaauuggcuacgucgccgcagaaaaucaucagcacgcuacgaugcuggacguagaucuccaccccgccagcgccuggacccuuuacgcaguggcuacuacaguuaucaccccaaugaugagacauaccauugagaacacaacugccaauaucucccugacggcgauagcuaaccaagccgcaauuuugaugggucuggacaaaggguggccuaucucaaagauggauauuggcgugccgcuccuggcccuuggaugcuauucucaggucaaucccuuaacccugacagcugcagugcucauguuggucgcccacuacgcgaucauaggcccagggcugcaggcuaaagccacuagggaagcacagaagcgcaccgccgcuggaaucaugaagaacccuacaguggacggcauuguugccaucgaucuagaccccgugguauaugaugcaaaauuugagaagcaacugggucagauuaugcuccuuauccuguguaccagucagauauugcugaugcggacuacgugggcucucugcgaaucgauuacacuggccaccgggccauuaacuacccuuugggagggaagcccuggcaaauucuggaauacaacuaucgcgguguccauggccaacaucuuccgagguucuuaccuggcaggcgcugggcucgccuuuucacuaaugaagagccugggaggcgggagaaggggaaccggcgcacagggugagacauugggggaaaaauggaagcgccaacugaaucagcucuccaagagugaguucaacacguauaaacggucuggaauuauggaagucgacagaagcgaggcuaaggaaggccuuaaacguggugagaccacuaagcaugccguuucaaggggcacagccaaacugcggugguuuguggagcgcaauuuggucaagcccgaagggaaggugaucgaccugggauguggccgagggggaugguccuacuauugcgcgggccucaaaaagguaaccgaggugaaagguuacacuaaggggggaccgggccacgaagagccaauaccuauggcuacauacggcuggaacuuaguuaaacugcauagugggaaggauguguucuuuaugcccccagaaaaaugugacacccuucugugcgauauuggagagagcucucccaauccuacgaucgaggaagguagaacccuaaggguccucaagaugguggagccguggcugcggggcaaccaguucuguauuaagaucuugaaucccuauaugccauccgucguggaaacacuggagcgcaugcagagaaaacacgggggaaugcucguuaggaacccucuuucacgaaauagcacucacgagauguacuggguaucgugcggcaccgguaacauagugucugcagucaacaugacaagucggaugcuguuaaaucguuuuacuauggcccauagaaagcccaccuaugaacgcgacguggaucugggggcuggaacaaggcacguugccguggagccugaagucgcaaacuuggacaucauuggccaacggaucgagaauauuaaaaacgaacauaaguccaccuggcacuacgaugaggacaauccauauaaaacuugggccuaccacggcagcuaugaggugaagcccucaggguccgcuucuagcaugguaaacggagugguuagacuccugacgaagccuugggaugucaucccaauggugacacagauugcgaugaccgacacuacccccuucggucagcaacgcguguuuaaagaaaaggucgauacaaggacgccgcgagccaaacggggcaccacucagaucauggagguuacagcaaaguggcuauggggguuccuuaguagaaauaaaaagccuaggauauguacccgcgaagaguuuacucguaaggugcgguccaacgcugccauuggagcaguauucguggacgaaaaucaguggaacagcgccaaagaggcugucgaggacgaaagauuuugggaucuggugcauagggagcgcgaacuccacaagcagggcaaaugcgccacaugcguuuacaauaugauggguaagcgagagaaaaagcugggggaauucggaaaggcgaaaggcucucgggcaaucugguacaugugguugggcgccagauuccuggaguuugaggcucucggguucaugaacgaagaccauugguuuucaagggagaauagucuuuccggaguggaaggugagggccugcacaaguuaggguauauccugcgcgauauuagcaaaauaccaggaggcaacauguacgccgacgauaccgcagguugggacacaagagucacugaggaugacuugcaaaaugaagcuaagaucaccgauauuauggagcccgaacaugcccuccuggcuacgucuaucuucaaacuaaccuaucagaacaaggugguacggguucagaggccugccaaaaacgggacagugauggacgucauuucgcgucgagaucagcgcggaucaggccaagugggcacuuacgggcuuaauaccuuuacaaacauggaggugcagcugaucagacagauggaaagcgagggaauauuccucccauccgagcuggaaacucccaauuuggcagagcgggcguuagacuggcuggaaaagcacggugccgagaggcucaagcgcauggcuaucaguggcgaugacugugucguuaaaccgauugacgauagauuugccaccgcacuuacggcucugaacgacauggggaaggugcggaaagauaucccucagugggaacccucuaagggauggaaugacuggcaacagguaccauucugcagccaccauuuucaccagcuaauuaugaaagauggcagggagaucguggucccuugucgaaaccaggacgagcuggugggucgugccagaguuucccaaggggcaggauggucacuccgcgaaacagccugcuugggcaagaguuaugcgcagauguggcagcugauguacuuccaucggagggaucuuagacuggcugccaaugcaauauguucugccgugcccgucgacugggugccaaccagccgcacuacaugguccauucacgcucaccaucaauggaugaccacugaggauaugcucucaguauggaaccggguuuggaucgaagagaaucccuggauggaaaacaagacccacgugagcucuugggaggaggucccuuauuuaggcaaaagggaagaccaguggugcgggucccugaucggauugacagcccgagcaacgugggcuaccaauauucagguggccauaaaccagguuagacggcugaucgguaaugagaacuaccucgauuacaugacuaguaugaagagguuuaaaaaugaaagcgacucggagggcgcgcuuugguga

SEQ ID NO: 13448 - RNA, 9879 nt, Artificial Sequence
  derived and/or modified CDS sequence (opt3) from DENV-1__KJ189351__SS-prME
agcgugaccaugcugcucaugcuucugcccacugucuuggccuuccacuuaacuacgaggggcggggagccucauaugaucguuuccaagcaggaaaggggcaaaucucugcuguuuaagaccucagcuggugugaacaugugcacccucauugccauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagagaagcguagcgucgcucuggcaccccaugugggcuugggucucgaaacuagaaccgagacauggauguccucugaaggggcuuggaaacagauccagaggguugagacuugggcccugcggcacccuggauucaccgugauugcauuuuuccuggcacaugccaucggcacaucgauuacccagaagggcaucauauuuauccucuuaaugcuggucacgccaucaauggcuaugcgcugcguggggauuggaaacagagacuucguagagggucuuagcggcgccacuuggguugauguggucuuggaacacgggaguugugugacaaccauggcgaagaauaaacccacucuggacaucgagcuacucaagacagaagugaccaacccugcaguccugaggaaacuuugcauugaggccaagaucuccaauacgaccacagauucucgguguccaacucaaggagaagcuacccugguugaggagcaggacgccaacuuugugugccgccgaacauucguagauagaggcugggguaauggguguggauuguuuggcaaaggcagccuccugacuugcgcaaaguucaagugcgugaccaaauuagaagggaagauaguccaguacgagaaccugaaauauuccgugauuguuacagugcacaccggagaccagcaucaagucgguaaugaaacuacggagcacggcacaaucgcuaccauuacuccccaggccccuaccucagaaauccagcucacagauuacggggcgcuuacccuggacuguaguccaaggacuggauuggacuuuaacgagauggugcuacugacaaugaaggagaaaagcuggcucguacauaagcagugguuccuggaucuuccgcugcccuggacgccuggcgccucuaccucccaagaaacuuggaaucggcaggacuugcucguuacauuuaaaaccgcacacgcuaagaagcaggagguggucgugcuggguucacaagaaggggccaugcacacagcuuuaacuggcgccaccgagauccagacgagcggaaccacaacuauuuucgcaggccaucugaaaugccgucuaaagauggauaaacucacccugaaggggaugaguuaugucauguguacaggaucuuucaaacuugaaaaggagguggccgagacucagcacgguaccguuuuggugcagguaaaguacgaaggcacggacgcuccaugcaaaauacccuuuuccacacaagaugagaagggggucacccagaacggacgccugaucacugcgaauccuauugugacagacaaagaaaagccaguuaacaucgagaccgagcccccguucggcgaaagcuauauaguggucggugcaggggagaaagcccucaagcugucgugguuuaagagaggaucuuccauuggaaaaauguucgaagcuacugccaggggcgcacggcgaauggccauccuuggggauaccgcuugggacuuuggaucaaucgguggcguguucacaaguguagggaagcuggugcaucagguuuuuggaacggccuacggcgucuuguucagcgguguguccuggaccaugaaaauugggaucggcauucuccugacuugguuaggacuaaauucucgcagcacaucacuaaguaugaccuguauagcagugggcauggucacacucuaccuggggguuauggugcaggcggauuccggaugcgugaucaacuggaagggcagagagcuuaaaugugguagcgggauuuuuguaacuaacgaaguccacaccuggacggagcaauauaaguuccaggcugacucuccuaagagguugucagccgcaaucggaaaagccugggaggaaggcgugugcgguauccggagugcuacacgccuggagaauauuauguggaagcagauaagcaacgaacucaaucauauccuguuagagaacgauaugaaauuuaccguuguggucggcgacgccaaugggauucuggcacagggaaagaaaaugaucagaccccaaccaauggaacacaaguacuccuggaaaucuuggggcaaggcuaagauuaucggggccgacauacagaacacuaccuucaucauugauggaccugacacacccgaguguccagauggccagagggcguggaauaucugggagguggaagacuaugguuuugggguuuucacuaccaacauuuggcuuaaauugcgugauucguacacacagaugugcgaccaccggcucaugagcgccgcuaucaaggauuccaaagcagugcaugccgacaugggauauuggauagagucagaaaagaaugagacguggaaacuggcucgagccaguuucauugaaguaaagaccuguacuuggcccaagucucacacacuauggagcaacggcguccuggaguccgagaugaucauuccuaaaaucuacgguggcccaauaucacaacauaauuauagaccgggguacuuuacccagacugcaggacccuggcaccucggcaagcuggaacuugauuucgacuugugcgaggggacaaccgugguggucgaugaacacugcggaaacaggggcccuagccugcgcacgacuaccguuacagguaaaaucauucaugagugguguugccggucuuguaccuuaccaccccucagauuuagaggggaagacggaugcugguacggcauggaaauccgcccugugaaggagaaagaagagaaucugguacgauccauggugagugcggguagcggcgaagucgauucuuucucccuugggauucugugugugucaaucaugauagaggagguuaugcggagucguuggagcagaaagauguugaugacuggaacacucgccguguuucugcuacugauuaugggccagcucaccuggaacgaccugacaaggcuuugcaucauggucggggcuaaugccucggaccgcaugggaaugggcacuaccuauuuggcacugauggcuacguucaagaugcggccaauguuugccguggguuuacucuucagaaggcugacaucccgagaaguucuucugcuaaccaucgggcucucucugguggcaagcgucgaguugcccaacucacuggaagaguuaggagauggccucgccaugggcauuaugaugcugaaacuucugacugaauuucaaccgcaccaguuguggaccacacuccugagucuaacuuucguaaagaccacgcugucccuugacuacgcuuggaaaacaaccgcgauggcccucucuaucgugagccuguuuccuuugugucuguccacuacaucacagaagaccacuugguuaccaguucuccuggggagcuucggaugcaaaccccuuacaauguuucugauugcagagaaccgcauauggggucggaagaguuggccuuugaaugagggcaucauggcuauugggaucgugucuauucuccuguccagccuacugaagaacgaugucccccuugccggaccacucaucgccggcgguaugcugauagcuuguuaugugaucucggggucaucugcagacuugaguuuagaaaaagccgcggagguauccugggaacaggaggcugaacauagcggagccucucacagcauucugguggagguccaagaugacggcaccaugaagaucaaagaugaggaaagagacgauacgcucacuauucugcuuaaggcaacccuguuggccguuuccggcguguacccuaugucaauccccgcuacacuauucgugugguauuucuggcagaaaaagaaacagaggagugggguccugugggacaccccaagcccgccugagguggaacgugcaguucucgauaauggaauauaccgcauucugcagcggggucuuuuaggcagaucucaaguaggggugggagucuuucaggacggcguguuccauacaauguggcacguuacuaggggugccgugcugauguaucaggggaagcgacucgagcccuccugggcgucagucaagaaagauuugaucaguuacggaggcggcuggcgguuucaggggagcuggaacaccggagaggaagugcaaguaaucgcugucgagccagguaagaaucccaaaaacgugcagacgacaccuggcacuuucaagaccccagaaggggagguuggagccauugcacuggacuuuaaacccggcacauccgguucuccuauagugaaucgcgaagggaagaucgucggacucuacggcaacggcgugguuaccacuucggggaccuaugugagcgccauugcucaggccaaggcaucacaagagggaccgcugccagagaucgaagacgaggucuucaaaaagagaaaucuuacaauuauggaucugcaccccgguuccggcaaaacgaggcgguacuugccugcuaucgugcgagaagccauaaagagaaaacuacgcacucugauccucgcgccaaccaggguaguggccagugagauggcagaggcuuuaaaggggaugcccauucguuaucagacaaccgccguuaagucugagcauacuggacgggagaucgucgaccugaugugccacgcuacauuuaccaugagacuucugagcccugugagggugccgaacuacaauaugauuaucauggaugaagcacauuucacggaccccgccuccauagccgcucgcggcuauauuucaacucgagucgguaugggggaggcggcagccaucuuuaugacagcuaccccaccuggaucuguagaagccuucccccagagcaacgcagugauccaggaugaggaaagagacauuccagagcggaguuggaacuccggcuacgauuggaucaccgacuuuccuggcaaaacuguuugguucgugcccagcauaaagucugggaaugauauugccaauugucucaggaaaaacggaaagcgcgucauccaauugucacguaaaacauucgacaccgaguaucagaagacaaagaacaaugauugggacuacgugguuacuacggacauuuccgaaaugggugcuaacuuuagagcggaucgggugaucgacccaaggcgcugccugaaaccggucauacucaaggauggcccugagcgagugauucuggccgggcccaugccaguaaccguggcaagugcugcccagagacggggaaggaucggccgcaaucagaacaaagaaggugaccaauacguuuauauggggcagccccuuaauaacgaugaggaccacgcacauuggacagaggccaagaugcuacuggauaauaucaacacuccugaaggcauuaucccagcuuuguucgagcccgaaagagagaaaagcgccgcgauugacggagaauacagguuacggggcgaggcacguaagaccuuugucgagcugaugcgccgaggggaucucccuguguggcugucguauaagguggccucugaaggauuccaguacuccgacagaagguggugcuuugauggugagcggaauaaccagguccuugaagagaauauggacguugaaauauggacaaaagagggcgagcgcaagaaacugagaccgagguggcucgaugcucggaccuauagcgacccauuggcccugcgagaguucaaggaguuugcugcagggagacgcucagugaguggagaccuaauccuggaaauuggcaaacucccccaacaccuuacucugagggcccagaacgcuuuagauaauuugguaaugcugcacaacucugagcagggugggaaggccuaccggcaugcaauggaagaacucccugacacgaucgagacccugaugcuucuggcgcucaucgccguguugacaggcggagucacucuguucuuuuuauccggcaaagggcuaggaaagaccagcauuggucugcucugugugacagcuucaagugcccuucuguggauggcaagcguugaaccccacuggauagcugccuccaucauuuuggaguucuuucugauggugcuccugaucccagaaccugaucgucagagaacaccccaagacaaucagcuugcauaugucguaauuggccuccuguucaugaucuugacuguggccgcuaacgagauggggcuguuagagacaacgaagaaagaucuaggaauaggcuacguugcggccgaaaaccaucagcacgcaaccaugcuggacguggaucuccacccagcuucugccuggacucuuuacgccgucgcaacaaccgugaucaccccuaugaugaggcauacaauugagaauacuacggcuaacaucagccugaccgccauugcgaaucaagcugccaucuugaugggucuggacaagggguggccgauauccaaaauggauauuggcgucccccuccuggcacuuggaugcuauucacaggugaacccauuaacacugacugccgcuguucucauguugguggcacacuacgccaucauuggcccugggcugcaggcgaaggcuacccgcgaagcccagaaacggacagcagccggaaucaugaagaaucccaccguagacggcauaguggcuaucgaucuagacccagucguuuaugaugccaaguuugagaaacaacugggucagauuaugcuccuuauccuguguacuucucagauuuugcugaugcgaacgacaugggcacucugcgaaaguaucacccuggcuacugggccuuuaaccacacuuugggagggaucgcccggcaaguucuggaacacuaccauagccgugagcauggcgaauauuuucagagguuccuaccuggccggcgcagggcucgcuuuuucucuaaugaaaucacugggaggcgggaggcgcggaacaggcgcccagggugagacguugggggaaaaguggaaacggcaacugaaccagcucagcaaguccgaguucaauaucuauaagagaaguggaaucauggaagucgaccguucugaggcaaaagaaggccuuaagaggggugagaccacuaaacaugcugugagccggggcacagccaagcugcgcugguuuguagagcgaaacuuggugaaaccggaagggaagguuauugaccugggauguggcagagggggauggucauacuauugcgccggccucaagaaagugaccgaggucaaggguuacacuaaagggggaccaggccacgaagaaccuauccccauggcgacauacggcuggaauuuagugaagcugcauuccgggaaagaugucuucuuuaugccacccgaaaagugugacacccuucugugcgauauaggagagaguagcccuaacccgacgauugaggaagguaggacccuacgggugcucaaaaugguugagcccuggcugcgcggcaaucaguucuguguaaagaucuugaacccauauaugccuucuguggucgaaacacuggagagaaugcagaggaagcacgggggaaugcucgugcgaaauccccuuucccggaacucaacucacgagauguacuggguuagcugcggcaccgguaauauugugucggcugucaacaugacaucucguaugcuguuaaacagauuuacuauggcacaucgcaaaccuaccuaugaaagggacguggaucugggggccggaacacggcacguagcuguggagccagaaguugccaauuuggacaucauaggccaaagaaucgagaacauuaagaaugaacauaaaaguaccuggcacuacgaugaggacaaccccuauaagacuugggcauaccacggcuccuaugaggucaaaagcucaggguccgccucuagcauggugaauggagugguccgccuccugacgaagccuugggauguuaucccaauggugacacagauugcuaugaccgacacuacccccuucggucagcaaaggguauuuaaggaaaaaguggauacacgaacgccgcgggcgaagagaggcaccacucagaucauggaggucacagccaaauggcuauggggguuccuuaguaggaacaagaaaccucgcauuuguacccgugaagaguuuacucggaaggugagauccaaugcagcuaucggagccguuuucguggacgaaaaccaguggaauagcgcaaaggaggccgucgaggacgaaagguuuugggaucuggugcaucgcgagcgagaacuccacaaacagggcaagugcgcuacaugcguauacaacaugauggguaaacgggagaagaaacugggggaguucggaaaggccaagggcucuagagcgauaugguacaugugguugggcgcaagguuccuggaguuugaggcccucggguucaugaaugaagaccauugguuuucacgcgagaacagucuuuccggaguugaaggugagggccugcacaaauuaggguauauucugagagauaucagcaagaucccaggaggcaauauguacgcugacgauaccgccgguugggacacacggauuacugaggaugacuugcaaaacgaagcaaaaauaaccgauaucauggagcccgaacaugcucuccuggccacgucuauuuucaagcuaaccuaucagaauaaaguggucagggugcagcguccugcuaagaacgggacagugauggacgucaucucgcgacgcgaucagagaggaucaggccaaguuggcacuuacgggcuuaacaccuuuacaaauauggaggugcagcugauucggcagauggaaagcgagggaaucuuccucccauccgagcuggaaacucccaacuuggccgagagggcauuagacuggcuggaaaaacacggugcggagcgccucaagagaauggccauaaguggcgaugacuguguagugaagccgaucgacgaucgguuugcuaccgcccuuacggcacugaaugacauggggaaagucaggaaggauauuccucagugggaacccucuaaaggauggaacgacuggcaacaggugccauucugcagccaccauuuucaccagcuaaucaugaaggauggccgagagauuguugugccuugucguaaucaggacgagcuggucgguagagcucgcgugucccaaggggccggauggucacuccgggaaacagcaugcuugggcaaaaguuaugcccagauguggcagcugauguacuuccauaggagagaucuucgccuggcggcuaacgccaucuguucugcaguacccguugacugggugccaaccagccggacuacaugguccauacacgcccaccaucaauggaugaccacugaggauaugcucucagucuggaauaggguguggauugaagagaaccccuggauggaagacaagacccacguuagcucuugggaggaggugccuuauuuaggcaagcgagaagaucaguggugcgggucccugaucggauugacagcuagagccacgugggcaaccaauauccaggucgcuauuaaccaggugcggaggcugauagguaaugagaacuaccucgacuacaugacaaguaugaaacgcuuuaagaaugaaagcgacucggagggcgcccuuugguga

SEQ ID NO: 13449 - RNA, 9879 nt, Artificial Sequence
  derived and/or modified CDS sequence (opt3) from DENV-1__KJ189352__SS-prME
agcgugaccaugcugcucaugcuucugcccacugccuuggcuuuccacuuaacuacgagaggaggggaaccucauaugaucgucuccaagcaggaaaggggaaaaucucugcuauuuaagaccucagccgguguuaacaugugcacccucauugccauggaccugggcgaacuuugugaagauacuaugaccuacaaaugcccacggauaacagaggcggaaccggacgauguggacuguuggugcaaugcuaccgauacuugggugacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagauuuuuggaacggcauacggcguguuguucuccgguguuucuuggaccaugaaaaucgggauuggcauacuccugacuugguuaggacugaauagccgcucaacaagucuauccaugaccuguaucgcggucggcauggugacacucuaccugggggugaugguccaggcugauagcggaugcguuauuaacuggaagggcagagagcuuaaaugugguucugggaucuuugugacuaacgaagugcacaccuggacggagcaauauaaguuccaggccgacucaccgaagagguugagugcagccaucggaaaggcuugggaggaaggcguaugcgguauucggagcgccacacgccuggagaauauaauguggagacagaucuccaacgaacucaaucauauucuguuagagaacgauaugaaguuuaccgucgugguuggcgacgcaaaugggauccuggcucagggcaagaaaaugauuaggccucaacccauggaacacaaauacucuuggaagucguggggcaaagccaaggugaucggggcggacauacagaacacuaccuucaucauugauggaccagacacaccugagugucccgauggccagcgugccuggaauaucugggaggucgaagacuaugguuuugggguguucacuaccaacauuuggcuuaaguugcgggauagcuacacacagaugugcgaccaccgacucauguccgcugcaaucaaagauucaaaggccguucaugcugacaugggauauuggauagagagugagaaaaaugagacguggaagcuggccagagcaucuuucauugaagugaaaaccuguacuuggccaaagagccacacacuaugguccaacggcguacuggagucagagaugaucauucccaagaucuacgguggcccuauaagccaacauaauuauaggccaggguacuuuacccagacugcgggaccguggcaccucggcaaacuggaacuugauuucgacuugugcgaggggacaaccgucgugguggaugaacacugcggaaaccgcggccccucucugcggacgacuaccgucacagguaagaucauucaugagugguguugcagauccuguaccuuaccuccacucagguuucgcggggaggacggaugcugguacggcauggaaauccgacccguuaaagagaaggaagagaaucuggugcggaguaugguaagcgccgguucuggcgaaguggauuccuucucacuugggauucugugugucaguaucaugauagaggaggugaugcguagcagauggucgaggaaaauguugaugacuggaacacucgcuguuuuucugcuacugauuaugggccagcucaccuggaacgaccugauccgccuuugcaucauggugggggccaaugcauccgaccggaugggaaugggcacaacuuauuuggcucugauggccaccuucaagaugagaccuauguuugcagucgguuuacucuucaggcgacugacgucucgcgaagugcuucugcuaacaauugggcucagccugguugccucaguggaguugccaaacagucuggaagaguuaggagauggccucgcuaugggcaucaugaugcugaaacuucugaccgaauuucaaccccaccaguuguggacuacccuccugucccuaacauucgucaaaacuacccugucucuugacuacgcguggaagacgacagccauggcacucagcauuguaucccuguuuccguugugucugucaaccacuagccagaaaacaaccugguuaccugugcuccuggggaguuucggaugcaagccacuuacuauguuucugauaacagagaacaaaaucuggggucggaagucuuggcccuugaaugagggcauuauggcuaucgggauuguuuccauccuccugagcucgcuacugaagaacgaugugccucuugccggaccccucauagccggcgguaugcugaucgcuuguuaugucauuucagggucuagugcagacuuguccuuagaaaaagccgcggaggugagcugggaacaggaggcugaacauucuggagccagccacuccauccugguagaggugcaagaugacggcaccaugaagauuaaagaugaggaaagagacgauacgcucacuauccugcuuaaggcaacccuguuggccgucucaggcguuuacccaaugaguauaccugcuacacuauucgugugguauuucuggcagaaaaagaaacagaggagcggggugcugugggacacccccucuccaccggaggucgaacgugcagugcucgauaauggaauuuaccgcauccugcagcggggucuuuuaggcagaucccaaguugggguaggaguguuucaggacggcgucuuccauacaauguggcacgugacuaggggugccguucugauguaucaggggaagcgacucgagccuucaugggcgagugugaagaaagauuugaucagcuacggaggcggcuggcgguuucagggguccuggaacaccggagaggaaguccaagugauugcuguagagcccgguaagaaucccaaaaacguccagacgacacccggcacuuucaagaccccugaaggggaggugggagccauagcacuggacuuuaaaccaggcacaucugguucgcccaucguuaaucgcgaagggaagauugugggacucuacggcaacggcgucgugaccacuagcgggaccuauguuucagccaucgcucaggccaaggcaucccaagagggaccucugccggagauugaagacgagguguucaaaaagagaaaucuuacaaucauggaucugcacccagguaguggcaaaacgaggcgguacuugcccgcuauaguccgagaagccaucaagagaaaacuacgcacucugauucucgcgccuaccagggugguagccucugagauggcagaggcuuuaaaggggaugccaauccguuaucagacaaccgccguaaagagcgagcauacuggacgggagauuguugaccugaugugccacgcuacauuuaccaugagacuucugucccccgucagggugccuaacuacaauaugaucauaauggaugaagcacauuucacggacccggccucaauugccgcucgcggcuauaucucuacucgaguggguaugggggaggcggcagccaucuuuaugacagcuacaccaccaggaagcgucgaagccuucccucagaguaacgcaguaauucaggaugaggaaagagacauccccgagcgguccuggaauagcggcuacgauuggauaaccgacuuuccaggcaaaacugugugguucguuccuucuauuaagucagggaacgauaucgccaauugucucaggaaaaacggaaagcgcgugauucaauugucccguaaaacauucgacaccgaguaucagaagacaaagaacaaugauugggacuacgucgugacuacggacaucagugaaaugggugcuaacuuuagagcggaucggguuauagaccccaggcgcugccugaaaccagugauucucaaggauggcccggagcgagucauccuggccgggccuaugcccgugaccgcagcuagcgccgcacagagacggggaaggaucggccgcaaucagaacaaagaaggugaccaauacguauauauggggcagccacuuaauaacgaugaggaccacgcccauuggacagaggcuaagaugcuacuggauaauauuaacacucccgaaggcaucauuccugccuuguucgagccagaaagagagaaaucggcggcaauagacggagaauacagguuacggggcgaggcccguaagaccuuuguggagcugaugcgccgaggggaucuccccguuuggcugucuuauaaggucgcuuccgaaggauuccaguacagcgacagaagguggugcuuugauggugagcggaauaaccaggugcuugaagagaauauggacguggaaaucuggacaaaagagggcgagcgcaagaaacugagaccuagguggcucgaugcccggaccuauucagacccguuggcucugcgagaguucaaggaguuugcagccgggagacgcagugucucuggagaccuaauucuggaaaucggcaaacucccacaacaccuuacucugagggcucagaacgccuuagauaauuugguuaugcugcacaacuccgagcagggugggaaggcauaccggcaugcgauggaagaacuccccgacacgaucgagacccugaugcuucuggcccucauugcuguguugacaggcggaguaacucuguucuuuuuaagcggcaaagggcuaggaaagaccucaauaggucugcucugugugacagccaguagcgcacuucuguggauggcuuccgucgaaccucacuggaucgccgcaucuauuaucuuggaguucuuucugauggugcuccugauucccgaaccagaucgucagagaaccccucaagacaaucagcuugccuauguugugaucggccuccuguucaugauauugacugucgcugcgaacgagauggggcuguuagagacaacgaagaaagaucuaggaaucggcuacguagccgcagaaaaccaucagcacgcuaccaugcuggacguggaucuccaccccgccagcgccuggacucuuuacgcaguugcuacaaccgugauuaccccaaugaugaggcauacaaucgagaauacuacggccaacauuucccugaccgcgaucgcuaaucaagccgcaauauugaugggucuggacaagggguggccuauuucaaaaauggauaucggcgucccgcuccuggcccuuggaugcuauucucaggugaaccccuuaacacugacugcugcaguccucauguugguggcccacuacgcgauuaucggcccagggcugcaggcuaaggccacccgcgaagcacagaaacggacagccgcuggaauaaugaagaauccuaccguugacggcaucguggccauugaucuagaccccguaguguaugaugcaaaguuugagaaacaacugggucagaucaugcuccuuauucuguguacgagucagaucuugcugaugcgaacuacaugggcucucugcgaaucgauaacccuggccacugggccauuaaccacacuuugggagggaagcccuggcaaguucuggaacacuaccauugcggucuccauggccaauaucuucagagguucuuaccuggcaggcgcugggcucgccuuuucacuaaugaaaagccugggaggcgggaggcgcggaacaggcgcacagggugagacguugggggaaaaguggaaacggcaacugaaccagcucuccaagagugaguucaauaccuauaagagaucuggaaucauggaaguugaccguagcgaggcuaaagaaggccuuaagaggggugagacuacaaaacaugccgugucacggggcaccgccaagcugcgcugguuugucgagcgaaacuuggugaaacccgaagggaagguaauugaccugggauguggcagagggggaugguccuacuauugcgcgggccucaagaaagugacugagguuaaggguuacacaaaagggggaccgggccacgaagaaccaaucccuauggcuaccuacggcuggaauuuagugaagcugcauagugggaaagaugucuucuuuaugcccccagaaaagugugacacgcuucugugcgauauaggagagagcucucccaacccuaccauugaggaagguaggacacuacgggugcucaaaauggucgagccguggcugcgcggcaaucaguucuguaucaagauuuugaaccccuauaugccauccgugguugaaacucuggagagaaugcagaggaagcacgggggaaugcucguacgaaauccucuuucacggaacagcacccacgagauguacugggugucgugcggcacagguaauaucgucucugcagugaacaugacaagucguaugcuguuaaacagauuuaccauggcccaucgcaaacccacauaugaaagggacguugaucugggggcuggaacccggcacguggccgucgagccugaaguggcaaauuuggacauaaucggccaaagaauugagaacaucaagaaugaacauaaauccacuuggcacuacgaugaggacaacccauauaagacgugggccuaccacggcagcuaugagguaaaacccucaggguccgcuucuagcauggugaauggaguuguccgccuccugacaaagccuugggaugugauuccaauggugacccagaucgcgaugacugacaccacacccuucggucagcaaagggucuuuaaggaaaaaguugauacgcgaaccccgcgggccaagagaggcacuacacagauuauggaggugaccgcaaaauggcuauggggguuccuuaguaggaacaagaaaccucgcaucuguacucgugaagaguuuacacggaagguaagauccaaugcugccauaggagcaguguucgucgacgaaaaccaguggaauagcgccaaggaggcuguggaggacgaaagguuuugggaucugguucaucgcgagcgagaacuccacaaacagggcaagugcgcaaccugcguguacaacaugauggguaaacgggagaagaaacugggggaguucggaaaggcgaagggcucuagagcaauuugguacaugugguugggcgccagguuccuggaguuugaggcucucggguucaugaaugaagaccauugguuuucacgcgagaacagucuuuccggagucgaaggugagggccugcacaaauuaggguauauccugagagauaucagcaagauuccaggaggcaauauguacgccgacgauacagcagguugggacacucgggugaccgaggaugacuugcaaaacgaagcuaaaauaacggauaucauggagcccgaacaugcccuccuggcuaccucuauuuucaagcuaacauaucagaauaaaguaguuagggugcagcguccugccaagaacgggacugucauggacgugaucucgcgacgcgaucagagaggaucaggccaagugggcaccuacgggcuuaacacauuuacuaauauggagguccagcugauucggcagauggaaagcgagggaaucuuccucccauccgagcuggaaacccccaacuuggcagagagggcguuagacuggcuggaaaaacacggugccgagcgccucaagagaauggcuauaaguggcgaugacuguguugugaagccgaucgacgaucgguuugccacggcacuuacagcucugaaugacauggggaaaguaaggaaggauauuccucagugggaacccucuaaaggauggaacgacuggcaacaggugccauucugcagccaccauuuucaccagcuaaucaugaaggauggccgagagauugucgugccuugucguaaucaggacgagcugguugguagagcccgcgugucccaaggggcaggauggucacuccgggaaaccgccugcuugggcaaaaguuaugcgcagauguggcagcugauguacuuccauaggagagaucuucgccuggcugccaacgcaaucuguucugccguccccguggacuggguaccaacuagccggacaaccugguccauacacgcucaccaucaauggaugacuaccgaggauaugcucucaguuuggaauaggguguggauugaagagaaccccuggauggaaaauaagacacacgucagcucuugggaggaggugccuuauuuaggcaagcgagaagaccaguggugcgggucccugaucggauugacggccagagcaaccugggcuacuaacauccagguugccauuaaucaggugcggaggcugauagguaacgagaauuaccucgauuacaugacaaguaugaaacgcuuuaagaacgaaagcgacucggagggcgcgcuuugguga

SEQ ID NO: 13450 - RNA, 9879 nt, Artificial Sequence
  derived and/or modified CDS sequence (opt3) from DENV-1__KJ189353__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagauuuuuggaacggcauacggcguguuguucuccgguguuucuuggaccaugaaaaucgggauuggcauacuccugacuugguuaggacugaauagccgcucaacaagucuauccaugaccuguaucgcggucggcauggugacacucuaccugggggugaugguccaggcugauagcggaugcguuauuaacuggaagggcagagagcuuaaaugugguucugggaucuuugugacuaacgaagugcacaccuggacggagcaauauaaguuccaggccgacucaccgaagagguugagugcagccaucggaaaagcuugggaggaaggcguaugcgguauucggagcgccacacgccuggagaauauaauguggaagcagaucuccaacgaacucaaucauauucuguuagagaacgauaugaaauuuaccgucgugguuggcgacgcaaaugggauccuggcucagggaaagaaaaugauuagaccucaacccauggaacacaaguacucuuggaaaucguggggcaaggccaagaucauaggggcggacauccagaacacuaccuucauuaucgauggaccagacacaccugagugucccgauggccagagggccuggaauauuugggagguggaagacuaugguuuuggggucuucacuaccaacaucuggcuuaaauugcgugauagcuacacacagaugugcgaccaccggcucauguccgcugcaauaaaggauucaaaagccgugcaugcugacaugggauauuggauugagagugaaaagaaugagacguggaaacuggcccgagcaucuuucaucgaaguuaagaccuguacuuggccaaagagccacacacuaugguccaacggcgugcuggagucagagaugauuauccccaaaauauacgguggcccuaucagccaacauaauuauagaccaggguacuuuacccagacugcgggaccguggcaccucggcaagcuggaacuugauuucgaguugugcgaagggacaaccguagucguggacgagcacugcggaaacaggggccccucucugcgcacgacuaccgugacagguaaaauuauccaugagugguguugccgguccuguaccuuaccuccacucagauuuaggggggaagauggaugcugguacggcauggagauucgccccgucaaggaaaaagaggaaaaucugguucgaaguauggugagcgccgguucuggcgagguagacuccuucucacuugggauccugugugugaguauaaugauugaggaagucaugcggagccguuggucgagaaagauguugaugacuggaacacucgcuguguuucugcuacugaucaugggccagcucaccuggaacgaucugaucaggcuuugcauuaugguuggggccaaugcauccgaccgcaugggaaugggcacaacuuauuuggcucugauggccaccuucaagaugcggccuauguuugcaguggguuuacucuucagaaggcugacgucucgagagguccuucugcuaacaaucgggcucagccugguggccucaguugaauugccaaacagucuggaggaauuaggagacggccucgcuaugggcauuaugaugcugaaacuucugaccgaguuucaaccccaccaguuguggacuacccuccugucccuaacauucgugaagacuacccugucucuugauuacgcguggaaaacgacagccauggcacucagcauagucucccuguuuccguugugucugucaaccacuagccagaagacaaccugguuaccuguacuccuggggaguuucggaugcaaaccacuuacuauguuucugaucacagagaacaagauuuggggucgcaagucuuggcccuugaaugaaggcaucauggcuauugggaucguguccauacuccugagcucgcuacugaaaaacgacguuccucuugccggaccccucaucgccggcgguaugcugauugcuuguuaugugaucucagggucuagugcagauuuguccuuagagaaggccgcggaagucagcugggagcaggaagcugagcauucuggagccagccacuccauucugguggagguacaagacgauggcaccaugaaaaucaaggacgaagagcgggaugacacgcucacuauacugcuuaaagcaacccuguuggccgugucaggcgucuacccaaugaguauuccugcuacacuauucguuugguauuucuggcagaagaaaaagcagagaagcggggugcugugggauacccccucuccaccggaaguggagagggcaguccucgacaauggaaucuaccguauccugcagcgcggucuuuuaggccggucccaaguggggguuggaguauuucaggauggcguguuccauacaauguggcacgucacuagaggugccgugcugauguaucaggggaagaggcucgagccuucaugggcgaguguuaaaaaggacuugauuagcuacggaggcggcuggcgauuucagggguccuggaacaccggagaagaggugcaagucauagcuguggaacccgguaaaaauccaaagaacguacagacgacacccggcacuuucaaaaccccugagggggaagucggagccaucgcacuggauuuuaagccaggcacaucugguucgcccauugugaaucgggaggggaagaucguuggacucuacggcaacggcguggucaccacuagcgggaccuaugugucagccauugcucaggccaaagcaucccaagagggaccucugccggaaaucgaggacgaaguuuucaagaaacgcaaucuuacaauaauggaccugcacccagguaguggcaagacgagaagguacuugcccgcuaucgugcgggaggccauuaaacgaaagcuaagaacucugauccucgcgccuacccgcgucguggccucugaaauggcagaggcuuuaaaggggaugccaauuagguaucagacaaccgccguaaaaagcgagcauacuggacgugaaaucguggaucugaugugccacgcuacauuuaccaugcggcuucugucccccguuagagucccuaacuacaauaugauaauuauggacgaggcacauuucacggauccggccucaaucgccgcuaggggcuauaucucuacucgcguggguaugggggaagcggcagccauuuuuaugacagcuacccccccaggaagcguggaggccuucccucagaguaacgcagucauccaggacgaagagcgagauauacccgagagauccuggaauagcggcuacgacuggauuaccgauuuuccaggcaagacuguaugguucgugccuucuaucaaaucagggaacgacauugccaauugucuccggaagaacggaaaaaggguuauccaauugucccgcaagacauucgauaccgaauaucagaagacaaaaaacaaugacugggauuacguggucacuacggacauaagugagaugggugcuaacuuucgugcggacagagugauugauccccggaggugccugaagccaguuauccucaaagacggcccggaacgcgugauccuggccgggccuaugcccgucaccgcagcuagcgccgcacagcgaagaggacggauuggcaggaaucagaacaaggagggugaucaauacguguauauggggcagccacuuaauaacgacgaggaucacgcccauuggacagaagcuaaaaugcuacuggacaauaucaacacucccgagggcauuauaccugccuuguucgaaccagagcgcgaaaagucggcggcaaucgauggagaguacagauuaaggggcgaggcccggaagaccuuuguagaacugaugcgucgcggggaccuccccguguggcugucuuauaaaguugcuuccgagggauuccaguacagcgaucgaagauggugcuuugacggugaaaggaauaaccagguccuugaggaaaauauggauguggagauuuggacaaaggagggcgaacggaaaaagcugcgcccuagauggcucgacgccaggaccuauucagauccguuggcucugcgggaguucaaagaauuugcagccgggcgaagaagugugucuggagaccuaauccuggagaucggcaagcucccacaacaccuuacucugcgcgcucagaacgccuuagacaauuuggucaugcugcacaacuccgaacagggugggaaagcauacaggcaugcgauggaggagcuccccgauacgauugaaacccugaugcuucuggcccucauagcuguuuugacaggcggagugacucuguucuuuuuaagcggcaaggggcuaggaaagaccucaaucggucugcucuguguaacagccaguagcgcacuucuguggauggcuuccguggagccucacuggauugccgcaucuaucauuuuggaauucuuucugaugguccuccugauccccgagccagaccggcagcguaccccucaagauaaucagcuugccuaugugguuauaggccuccuguucaugaucuugacuguggcugcgaacgagauggggcuguuagaaacaacgaaaaaggaccuaggaauuggcuacgucgccgcagagaaccaucagcacgcuaccaugcuggauguagaccuccaccccgccagcgccuggacucuuuacgcaguggcuacaaccguuaucaccccaaugaugagacauacaauugaaaauacuacggccaacaucucccugaccgcgauagcuaaucaagccgcaauuuugaugggucuggauaaaggguggccuaucucaaagauggacauuggcgugccgcuccuggcccuuggaugcuauucucaggucaaccccuuaacacugacugcugcagugcucauguuggucgcccacuacgcgaucauaggcccagggcugcaggcuaaagccaccagggaggcacagaagcgcacagccgcuggaaucaugaagaauccuaccguggauggcauuguugccaucgaccuagaucccgugguauaugacgcaaaauuugaaaagcaacugggucagauuaugcuccuuauccuguguacuagucagauauugcugaugcggacgacaugggcucucugcgagucgauuacccuggccacugggccauuaaccacacuuugggagggaagcccuggcaaauucuggaacacuaccaucgcgguguccauggccaauaucuuccgagguucuuaccuggcaggcgcugggcucgccuuuucacuaaugaagagccugggaggcgggagaaggggaacaggcgcacagggugaaacguugggggagaaauggaagcgccaacugaaccagcucuccaagagugaauucaauaccuauaaacggucuggaauuauggaggucgauagaagcgaagcuaaggagggccuuaaacguggugagacuacaaagcaugccguuucaaggggcaccgccaaacugcggugguuuguggaacgcaacuuggucaagcccgaggggaaggugaucgaccugggauguggccgagggggaugguccuacuauugcgcgggccucaaaaagguaacugaagugaaagguuacacaaaggggggaccgggccacgaggaaccaauaccuauggcuaccuacggcuggaauuuaguuaaacugcauagugggaaggacguguucuuuaugcccccagagaaaugugauacgcuucugugcgacauuggagagagcucucccaacccuaccaucgaagaggguagaacacuaaggguccucaagaugguggaaccguggcugcggggcaaucaguucuguauuaagaucuugaaccccuauaugccauccgucguggagacucuggagcgcaugcagagaaaacacgggggaaugcucguuaggaauccucuuucacgaaacagcacccacgaaauguacuggguaucgugcggcacagguaauauagugucugcagucaacaugacuagucggaugcuguuaaaccguuuuaccauggcccauagaaagcccacauaugagcgcgauguggaccugggggcuggaaccaggcacguugccguggaaccugaggucgcaaauuuggauaucauuggccaacggaucgaaaacauuaaaaaugagcauaaguccacuuggcacuacgacgaggauaacccauauaaaacgugggccuaccacggcagcuaugaagugaagcccucaggguccgcuucuagcaugguaaauggagugguuagacuccugacaaagccuugggacgucaucccaauggugacccagauugcgaugacugauaccacacccuucggucagcaacgcguguuuaaagagaaggucgacacgaggaccccgcgagccaaacggggcacuacacagaucauggaaguuaccgcaaaguggcuauggggguuccuuaguagaaacaaaaagccuaggauauguacucgcgaggaauuuacacguaaggugcgguccaaugcugccauuggagcaguauucguggaugagaaccaguggaauagcgccaaagaggcugucgaagacgagagauuuugggaccuggugcauagggaacgcgagcuccacaagcagggcaaaugcgccaccugcguuuacaacaugauggguaagcgagaaaaaaagcugggggaguucggaaaggcgaaaggcucucgggcaaucugguacaugugguugggcgccagauuccuggaguuugaagcucucggguucaugaaugaggaucauugguuuucaagggaaaacagucuuuccggaguggagggugagggccugcacaaguuaggguauauccugcgcgacauuagcaaaauaccaggaggcaauauguacgccgaugacacagcagguugggauacuagagucaccgaagacgauuugcaaaacgaggcuaagaucacggacauuauggaacccgagcaugcccuccuggcuaccucuaucuucaaacuaacauaucagaauaaggugguacggguucagaggccugccaaaaacgggacugugauggaugucauuucgcgucgagaccagcgcggaucaggccaagugggcaccuacgggcuuaacacauuuacuaauauggaagugcagcugaucagacagauggagagcgagggaauauuccucccauccgaacuggagacccccaacuuggcagaacgggcguuagauuggcuggagaagcacggugccgaaaggcucaagcgcauggcuaucaguggcgacgauugugucguuaaaccgauugacgacagauuugccacggcacuuacagcucugaaugauauggggaaggugcggaaagacaucccucagugggagcccucuaagggauggaacgauuggcaacagguaccauucugcagccaccauuuucaccagcuaauuaugaaagacggcagggagaucguggucccuugucgaaaucaggaugaacuggugggucgugccagaguuucccaaggggcaggauggucacuccgcgagaccgccugcuugggcaagaguuaugcgcagauguggcagcugauguacuuccaucggagggaccuuagacuggcugccaacgcaauauguucugccgugcccgucgauugggugccaacuagccgcacaaccugguccauucacgcucaccaucaauggaugacuaccgaagacaugcucucaguauggaaucggguuuggaucgaggaaaaccccuggauggagaauaagacacacgugagcucuugggaggaagucccuuauuuaggcaaaagggaggaucaguggugcgggucccugaucggauugacggcccgagcaaccugggcuacuaacauucagguggccauaaaucagguuagacggcugaucgguaacgaaaauuaccucgacuacaugacaaguaugaagagguuuaaaaacgagagcgauucggagggcgcgcuuugguga

SEQ ID NO: 13451 - RNA, 9879 nt, Artificial Sequence
  derived and/or modified CDS sequence (opt3) from DENV-1__KJ189354__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagauuuuuggaacggcauacggcguguuguucuccgguguuucuuggaccaugaaaaucgggauuggcauacuccugacuugguuaggacugaauagccgcucaacaagucuauccaugaccuguaucgcggucggcauggugacacucuaccugggggugaugguccaggcugauagcggaugcguuauuaacuggaagggcagagagcuuaaaugugguucugggaucuuugugacuaacgaagugcacaccuggacggagcaauauaaguuccaggccgacucaccgaagagguugagugcagccaucggaaaagcuugggaggaaggcguaugcgguauucggagcgccacacgccuggagaauauaauguggaagcagaucuccaacgaacucaaucauauucuguuagagaacgauaugaaauuuaccgucgugguuggcgacgcaaaugggauccuggcucagggaaagaaaaugauuagaccucaacccauggaacacaaguacucuuggaaaucguggggcaaggccaagaucauaggggcggacauccagaacacuaccuucauuaucgauggaccagacacaccugagugucccgauggccagagggccuggaauauuugggagguggaagacuaugguuuuggggucuucacuaccaacaucuggcuuaaauugcgugauagcuacacacagaugugcgaccaccggcucauguccgcugcaauaaaggauucaaaagccgugcaugcugacaugggauauuggauugagagugaaaagaaugagacguggaaacuggcccgagcaucuuucaucgaaguuaagaccuguacuuggccaaagagccacacacuaugguccaacggcgugcuggagucagagaugauuauccccaaaauauacgguggcccuaucagccaacauaauuauagaccaggguacuuuacccagacugcgggaccguggcaccucggcaagcuggaacuugauuucgacuugugcgaggggacaaccguagucguggaugaacacugcggaaacaggggccccucucugcgcacgacuaccgugacagguaaaauuauccaugagugguguugccgguccuguaccuuaccuccacucagauuuaggggggaggacggaugcugguacggcauggaaauucgccccgucaaggagaaagaagagaaucugguucgaaguauggugagcgccgguucuggcgaaguagauuccuucucacuugggauccugugugugaguauaaugauugaggaggucaugcggagccguuggucgagaaagauguugaugacuggaacacucgcuguguuucugcuacugaucaugggccagcucaccuggaacgaccugaucaggcuuugcauuaugguuggggccaaugcauccgaccgcaugggaaugggcacaacuuauuuggcucugauggccaccuucaagaugcggccuauguuugcaguggguuuacucuucagaaggcugacgucucgagaaguccuucugcuaacaaucgggcucagccugguggccucaguugaguugccaaacagucuggaagaguuaggagauggccucgcuaugggcauuaugaugcugaaacuucugaccgaauuucaaccccaccaguuguggacuacccuccugucccuaacauucgugaagacuacccugucucuugacuacgcguggaaaacgacagccauggcacucagcauagucucccuguuuccguugugucugucaaccacuagccagaagacaaccugguuaccuguacuccuggggaguuucggaugcaaaccacuuacuauguuucugaucacagagaacaagauuuggggucgcaagucuuggcccuugaaugagggcaucauggcuauugggaucguguccauacuccugagcucgcuacugaaaaacgauguuccucuugccggaccccucaucgccggcgguaugcugauugcuuguuaugugaucucagggucuagugcagacuuguccuuagaaaaggccgcggaggucagcugggaacaggaggcugaacauucuggagccagccacuccauucugguggagguacaagaugacggcaccaugaaaaucaaggaugaggaacgggacgauacgcucacuauacugcuuaaagcaacccuguuggccgugucaggcgucuacccaaugaguauuccugcuacacuauucguuugguauuucuggcagaagaaaaagcagagaagcggggugcugugggacacccccucuccaccggagguggaaagggcaguccucgauaauggaaucuaccguauccugcagcgcggucuuuuaggccggucccaaguggggguuggaguauuucaggacggcguguuccauacaauguggcacgucacuagaggugccgugcugauguaucaggggaagaggcucgagccuucaugggcgaguguuaaaaaggauuugauuagcuacggaggcggcuggcgauuucagggguccuggaacaccggagaggaagugcaagucauagcuguggagcccgguaaaaauccaaagaacguacagacgacacccggcacuuucaaaaccccugaaggggaggucggagccaucgcacuggacuuuaagccaggcacaucugguucgcccauugugaaucgggaagggaagaucguuggacucuacggcaacggcguggucaccacuagcgggaccuaugugucagccauugcucaggccaaagcaucccaagagggaccucugccggagaucgaagacgagguuuucaagaaacgcaaucuuacaauaauggaucugcacccagguaguggcaagacgagaagguacuugcccgcuaucgugcgggaagccauuaaacgaaagcuaagaacucugauccucgcgccuacccgcgucguggccucugagauggcagaagcuuuaaaggggaugccaauuagguaucagacaaccgccguaaaaagcgagcauacuggacgugagaucguggaccugaugugccacgcuacauuuaccaugcggcuucugucccccguuagagucccuaacuacaauaugauaauuauggaugaagcacauuucacggacccggccucaaucgccgcuaggggcuauaucucuacucgcguggguaugggggaggcggcagccauuuuuaugacagcuacccccccaggaagcguggaagccuucccucagaguaacgcagucauccaggaugaggaacgagacauacccgagagauccuggaauagcggcuacgauuggauuaccgacuuuccaggcaagacuguaugguucgugccuucuaucaaaucagggaacgauauugccaauugucuccggaagaacggaaaaaggguuauccaauugucccgcaagacauucgacaccgaguaucagaagacaaaaaacaaugauugggacuacguggucacuacggacauaagugaaaugggugcuaacuuucgugcggauagagugauugacccccggaggugccugaagccaguuauccucaaagauggcccggagcgcgugauccuggccgggccuaugcccgucaccgcagcuagcgccgcacagcgaagaggacggauuggcaggaaucagaacaaggaaggugaccaauacguguauauggggcagccacuuaauaacgaugaggaccacgcccauuggacagaggcuaaaaugcuacuggauaauaucaacacucccgaaggcauuauaccugccuuguucgagccagaacgcgagaagucggcggcaaucgacggagaauacagauuaaggggcgaggcccggaagaccuuuguagagcugaugcgucgcggggaucuccccguguggcugucuuauaaaguugcuuccgaaggauuccaguacagcgaccgaagauggugcuuugauggugagaggaauaaccagguccuugaagagaauauggacguggaaauuuggacaaaggagggcgagcggaaaaagcugcgcccuagauggcucgaugccaggaccuauucagacccguuggcucugcgggaauucaaagaguuugcagccgggcgaagaagugugucuggagaccuaauccuggaaaucggcaagcucccacaacaccuuacucugcgcgcucagaacgccuuagauaauuuggucaugcugcacaacuccgagcagggugggaaagcauacaggcaugcgauggaagagcuccccgacacgauugagacccugaugcuucuggcccucauagcuguuuugacaggcggagugacucuguucuuuuuaagcggcaaggggcuaggaaagaccucaaucggucugcucuguguaacagccaguagcgcacuucuguggauggcuuccguggaaccucacuggauugccgcaucuaucauuuuggaguucuuucugaugguccuccugauccccgaaccagaucggcagcguaccccucaagacaaucagcuugccuaugugguuauaggccuccuguucaugaucuugacuguggcugcgaacgagauggggcuguuagagacaacgaaaaaggaucuaggaauuggcuacgucgccgcagaaaaccaucagcacgcuaccaugcuggacguagaucuccaccccgccagcgccuggacucuuuacgcaguggcuacaaccguuaucaccccaaugaugagacauacaauugagaauacuacggccaacaucucccugaccgcgauagcuaaucaagccgcaauuuugaugggucuggacaaaggguggccuaucucaaagauggauauuggcgugccgcuccuggcccuuggaugcuauucucaggucaaccccuuaacacugacugcugcagugcucauguuggucgcccacuacgcgaucauaggcccagggcugcaggcuaaagccaccagggaagcacagaagcgcacagccgcuggaaucaugaagaauccuaccguggacggcauuguugccaucgaucuagaccccgugguauaugaugcaaaauuugagaagcaacugggucagauuaugcuccuuauccuguguacuagucagauauugcugaugcggacgacaugggcucucugcgaaucgauuacccuggccacugggccauuaaccacacuuugggagggaagcccuggcaaauucuggaacacuaccaucgcgguguccauggccaauaucuuccgagguucuuaccuggcaggcgcugggcucgccuuuucacuaaugaagagccugggaggcgggagaaggggaacaggcgcacagggugagacguugggggaaaaauggaagcgccaacugaaccagcucuccaagagugaguucaauaccuauaaacggucuggaauuauggaagucgacagaagcgaggcuaaggaaggccuuaaacguggugagacuacaaagcaugccguuucaaggggcaccgccaaacugcggugguuuguggagcgcaacuuggucaagcccgaagggaaggugaucgaccugggauguggccgagggggaugguccuacuauugcgcgggccucaaaaagguaacugaggugaaagguuacacaaaggggggaccgggccacgaagagccaauaccuauggcuaccuacggcuggaauuuaguuaaacugcauagugggaaggauguguucuuuaugcccccagaaaaaugugacacgcuucugugcgauauuggagagagcucucccaacccuaccaucgaggaagguagaacacuaaggguccucaagaugguggagccguggcugcggggcaaucaguucuguauuaagaucuugaaccccuauaugccauccgucguggaaacucuggagcgcaugcagagaaaacacgggggaaugcucguuaggaauccucuuucacgaaacagcacccacgagauguacuggguaucgugcggcacagguaauauagugucugcagucaacaugacuagucggaugcuguuaaaccguuuuaccauggcccauagaaagcccacauaugaacgcgacguggaucugggggcuggaaccaggcacguugccguggagccugaagucgcaaauuuggacaucauuggccaacggaucgagaacauuaaaaaugaacauaaguccacuuggcacuacgaugaggacaacccauauaaaacgugggccuaccacggcagcuaugaggugaagcccucaggguccgcuucuagcaugguaaauggagugguuagacuccugacaaagccuugggaugucaucccaauggugacccagauugcgaugacugacaccacacccuucggucagcaacgcguguuuaaagaaaaggucgauacgaggaccccgcgagccaaacggggcacuacacagaucauggagguuaccgcaaaguggcuauggggguuccuuaguagaaacaaaaagccuaggauauguacucgcgaagaguuuacacguaaggugcgguccaaugcugccauuggagcaguauucguggacgaaaaccaguggaauagcgccaaagaggcugucgaggacgaaaaguuuugggaucuggugcauagagagagggaacuccacaaacagggcaagugcgccaccugcguuuacaacaugauggguaaacgcgagaagaagcugggggaauucggaaaagcgaagggcucucgagcaaucugguacaugugguugggcgcccgguuccuggaguuugaggcucucggguucaugaaugaagaccauugguuuucaagagagaacagucuuuccggaguggaaggugagggccugcacaaauuaggguauauccugagggauauuagcaagauaccaggaggcaauauguacgccgacgauacagcagguugggacacucgcgucaccgaggaugacuugcaaaacgaagcuaaaaucacggauauuauggagcccgaacaugcccuccuggcuaccucuaucuucaagcuaacauaucagaauaaagugguaagaguucagcggccugccaagaacgggacugugauggacgucauuucgaggcgugaucagcgaggaucaggccaagugggcaccuacgggcuuaacacauuuacuaauauggaggugcagcugauccgccagauggaaagcgagggaauauuccucccauccgagcuggaaacccccaacuuggcagagagagcguuagacuggcuggaaaagcacggugccgagcggcucaaaaggauggcuaucaguggcgaugacugugucguuaagccgauugacgaucgcuuugccacggcacuuacagcucugaaugacauggggaaagugagaaaggauaucccucagugggaacccucuaaaggauggaacgacuggcaacagguaccauucugcagccaccauuuucaccagcuaauuaugaaggauggccgggagaucguggucccuuguaggaaucaggacgagcuggugggucgagcccguguuucccaaggggcaggauggucacucagagaaaccgccugcuugggcaagaguuaugcgcagauguggcagcugauguacuuccaucgccgggaucuuaggcuggcugccaacgcaauauguucugccgugcccgucgacugggugccaacuagcagaacaaccugguccauucacgcucaccaucaauggaugacuaccgaggauaugcucucaguauggaaucgcguuuggaucgaagagaaccccuggauggaaaauaaaacacacgugagcucuugggaggaggucccuuauuuaggcaagcgggaagaccaguggugcgggucccugaucggauugacggccagggcaaccugggcuacuaacauucagguggccauaaaucagguucgaagacugaucgguaacgagaauuaccucgauuacaugacaaguaugaaacgguuuaagaacgaaagcgacucggagggcgcgcuuugguga

SEQ ID NO: 13452 - RNA, 9879 nt, Artificial Sequence
  derived and/or modified CDS sequence (opt3) from DENV-1__KJ189355__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucaucgacaaagaaaagccugugaacauagagacagagccacccuucggcgaaucguauauuguugugggugccggggagaaagcucucaagcugucuugguuuaagagaggcuccucaaucggaaaaauguucgaagccaccgcaaggggcgcccggcgaauggcuauccuuggggauacugccugggacuuuggaaguauugguggcgucuucaccagcguggggaagcugguacaucagaucuuuggaacagcauacggcguguuguucuccgguguuucuuggacgaugaaaauugggauaggcauccuccugaccugguuaggacugaauagccgcucaaugagucuauccaugacuuguauugcggucggcauggugacacucuaccugggggugaugguccaggcugauagcggaugcguuaucaacuggaagggcagagagcuuaaaugugguucugggaucuuugugaccaacgaagugcacacauggacugagcaauauaaguuccaggccgacucaccgaagagguugagugcagccauuggaaaagcuugggaggaaggcguaugcgguauacggagcgccacccgccuggagaauaucauguggaagcagauuuccaacgaacucaaucauauccuguuagagaacgauaugaaauuuacggucgugguuggcgacgcaaaugggauucuggcucagggaaagaaaaugaucagaccucaacccauggaacacaaguacucuuggaaaucguggggcaaggccaagauaaucggggcggacauucagaacacaaccuucaucauugauggaccagacacuccugagugucccgauggccagagggccuggaauaucugggagguggaagacuaugguuuuggggucuucaccacaaacauauggcuuaaauugcgugauagcuacacucagaugugcgaccaccggcucauguccgcugcaauuaaggauucaaaagccgugcaugcugacaugggauauuggaucgagagugaaaagaaugagaccuggaaacuggcccgagcaucuuucauugaaguuaagacauguacguggccaaagagccacacccuaugguccaacggcgugcuggagucagagaugaucauacccaaaaucuacgguggcccuauuagccaacauaauuauagaccaggguacuuuacucagacagcgggaccguggcaccucggcaagcuggaacuugauuucgacuugugcgaggggaccacuguagucguggaugaacacugcggaaacaggggccccucucugcgcacaaccacggugacugguaaaaucauucaugagugguguugccgguccuguaccuuaccuccacucagauuuaggggggaggacggaugcugguacggcauggaaauccgccccgucaaggagaaagaagagaaucugguucgaaguauggugagcgccgguucuggcgaaguagauuccuucucacuugggauacugugugugaguauuaugaucgaggaggucaugcggagccguuggucgagaaagauguugaugacaggaacccucgcuguguuucugcuacugaucaugggccagcucacuuggaacgaccugauuaggcuuugcaucaugguuggggccaaugcauccgaccgcaugggaaugggcacaaccuauuuggcucugauggccacauucaagaugcggccuauguuugcaguggguuuacucuucagaaggcugacuucucgagaaguccuucugcuaaccauugggcucagccugguggccucaguugaguugccaaacagucuggaagaguuaggagauggccucgcuaugggcauaaugaugcugaaacuucugacggaauuucaaccccaccaguuguggacaacccuccugucccuaacuuucgugaagaccacacugucucuugacuacgcguggaaaacuaccgccauggcacucagcaucgucucccuguuuccguugugucugucaacgacaagccagaagaccacuugguuaccuguacuccuggggaguuucggaugcaaaccacuuacaauguuucugauuaccgagaacaagaucuggggucgcaagucuuggcccuugaaugagggcauuauggcuaucgggauaguguccauccuccugagcucgcuacugaaaaacgauguuccucuugccggaccccucauugccggcgguaugcugaucgcuuguuaugugauuucagggucuagugcagacuuguccuuagaaaaggccgcggaggucagcugggaacaggaggcugaacauucuggagccagccacuccauccugguggagguacaagaugacggcacuaugaaaauaaaggaugaggaacgggacgauacacucaccauucugcuuaaagcaacgcuguuggccgugucaggcgucuacccaaugaguaucccugcuacucuauucguuugguauuucuggcagaagaaaaagcagagaagcggggugcugugggacacccccucuccaccggagguggaaagggcaguccucgauaauggaaucuaccguauucugcagcgcggucuuuuaggccggucccaaguggggguuggaguauuucaggacggcguguuccauacaauguggcacgucaccagaggugccgugcugauguaucaggggaagaggcucgagccuucaugggcgaguguuaaaaaggauuugauaagcuacggaggcggcuggcgauuucagggguccuggaacacaggagaggaagugcaagucaucgcuguggagcccgguaaaaauccaaagaacguacagacuacccccggcacguucaaaacaccugaaggggaggucggagccauugcacuggacuuuaagccaggcacuucugguucgcccaucgugaaucgggaagggaagauuguuggacucuacggcaacggcguggucaccacaagcgggaccuaugugucagccaucgcucaggccaaagcaucccaagagggaccucugccggagauagaagacgagguuuucaagaaacgcaaucuuacuaucauggaucugcacccagguaguggcaagaccagaagguacuugcccgcuauugugcgggaagccaucaaacgaaagcuaagaacacugauucucgcgccuacgcgcgucguggccucugagauggcagaagcuuuaaaggggaugccaaucagguaucagacuaccgccguaaaaagcgagcauacaggacgugagauaguggaccugaugugccacgcuaccuuuacuaugcggcuucugucccccguuagagucccuaacuacaauaugauuaucauggaugaagcacauuucacagacccggccucaaucgccgcuaggggcuauauuucuacccgcguggguaugggggaggcggcagccaucuuuaugacggcuacucccccaggaagcguggaagccuucccucagaguaacgcagucauacaggaugaggaacgagacauucccgagagauccuggaauagcggcuacgauuggaucacagacuuuccaggcaagaccguaugguucgugccuucuauuaaaucagggaacgauaucgccaauugucuccggaagaacggaaaaaggguuauacaauugucccgcaagaccuucgacacugaguaucagaagacaaaaaacaaugauugggacuacguggucaccacagacauuagugaaaugggugcuaacuuucgugcggauagagugaucgacccccggaggugccugaagccaguuauccucaaagauggcccggagcgcgugauucuggccgggccuaugcccgucacugcagcuagcgccgcacagcgaagaggacggaucggcaggaaucagaacaaggaaggugaccaauacguguauauggggcagccacuuaauaacgaugaggaccacgcccauuggacggaggcuaaaaugcuacuggauaauauuaacacccccgaaggcauaaucccugccuuguucgagccagaacgcgagaagucggcggcaauugacggagaauacagauuaaggggcgaggcccggaagacauuuguagagcugaugcgucgcggggaucuccccguguggcugucuuauaaaguugcuuccgaaggauuccaguacagcgaccgaagauggugcuuugauggugagaggaauaaccagguccuugaagagaauauggacguggaaaucuggacuaaggagggcgagcggaaaaagcugcgcccuagauggcucgaugccaggaccuauucagacccguuggcucugcgggaauucaaagaguuugcagccgggcgaagaagugugucuggagaccuaauccuggaaauuggcaagcucccacaacaccuuacacugcgcgcucagaacgccuuagauaauuuggucaugcugcacaacuccgagcagggugggaaagcauacaggcaugcgauggaagagcuccccgacaccauagagacucugaugcuucuggcccucaucgcuguuuugacgggcggagugacccuguucuuuuuaagcggcaaggggcuaggaaagacaucaauuggucugcucuguguaacugccaguagcgcacuucuguggauggcuuccguggaaccucacuggaucgccgcaucuauuaucuuggaguucuuucugaugguccuccugauacccgaaccagaucggcagcguaccccucaagacaaucagcuugccuaugugguuaucggccuccuguucaugauuuugacaguggcugcgaacgagauggggcuguuagagaccacuaaaaaggaucuaggaaucggcuacgucgccgcagaaaaccaucagcacgcuacaaugcuggacguagaucuccaccccgccagcgccuggacgcuuuacgcaguggcuaccacuguuauuacaccaaugaugagacauaccaucgagaauaccacagccaacauaucccugacugcgauugcuaaucaagccgcaaucuugaugggucuggacaaaggguggccuauuucaaagauggauaucggcgugccgcuccuggcccuuggaugcuauucucaggucaaccccuuaacgcugaccgcugcagugcucauguuggucgcccacuacgcgauaaucggcccagggcugcaggcuaaagccacaagggaagcacagaagcgcacugccgcuggaauuaugaagaauccuaccguggacggcaucguugccauugaucuagaccccgugguauaugaugcaaaauuugagaagcaacugggucagaucaugcuccuuauacuguguacaagucagauuuugcugaugcggaccacuugggcucucugcgaaucgaucacgcuggccacagggccauuaaccacucuuugggagggaagcccuggcaaauucuggaacaccacaaucgcgguguccauggccaauauuuuccgagguucuuaccuggcaggcgcugggcucgccuuuucacuaaugaagagccugggaggcgggagaaggggaacuggcgcacagggugagaccuugggggaaaaauggaagcgccaacugaaccagcucuccaagagugaguucaauacauauaaacggucuggaaucauggaagucgacagaagcgaggcuaaggaaggccuuaaacguggugagacgaccaagcaugccguuucaaggggcacugccaaacugcggugguuuguggagcgcaacuuggucaagcccgaagggaaggugauagaccugggauguggccgagggggaugguccuacuauugcgcgggccucaaaaagguaacagaggugaaagguuacaccaaggggggaccgggccacgaagagccaauuccuauggcuacuuacggcuggaauuuaguuaaacugcauagugggaaggauguguucuuuaugcccccagaaaaaugugacacacuucugugcgauaucggagagagcucucccaacccuaccauugaggaagguagaacgcuaaggguccucaagaugguggagccguggcugcggggcaaucaguucuguaucaagauauugaaccccuauaugccauccgucguggaaacccuggagcgcaugcagagaaaacacgggggaaugcucguuaggaauccucuuucacgaaacagcacacacgagauguacuggguaucgugcggcacugguaauaucgugucugcagucaacaugaccagucggaugcuguuaaaccguuuuacaauggcccauagaaagcccacuuaugaacgcgacguggaucugggggcuggaaccaggcacguugccguggagccugaagucgcaaauuuggacauuaucggccaacggauugagaacaucaaaaaugaacauaaguccacauggcacuacgaugaggacaacccauauaaaaccugggccuaccacggcagcuaugaggugaagcccucaggguccgcuucuagcaugguaaauggagugguuagacuccugacuaagccuugggaugucauuccaauggugacgcagaucgcgaugacagacaccacucccuucggucagcaacgcguguuuaaagaaaaggucgauaccaggacaccgcgagccaaacggggcacgacccagauaauggagguuacugcaaaguggcuauggggguuccuuaguagaaacaaaaagccuaggauuuguacacgcgaagaguuuacccguaaggugcgguccaaugcugccaucggagcaguauucguggacgaaaaccaguggaauagcgccaaagaggcugucgaggacgaaagauuuugggaucuggugcauagggagcgcgaacuccacaagcagggcaaaugcgccacuugcguuuacaacaugauggguaagcgagagaaaaagcugggggaauucggaaaggcgaaaggcucucgggcaaucugguacaugugguugggcgccagauuccuggaguuugaggcucucggguucaugaaugaagaccauugguuuucaagggagaacagucuuuccggaguggaaggugagggccugcacaaguuaggguauauucugcgcgauauaagcaaaaucccaggaggcaauauguacgccgacgauacagcagguugggacaccagagucacagaggaugacuugcaaaacgaagcuaagauuacugauaucauggagcccgaacaugcccuccuggcuaccucuauuuucaaacuaacguaucagaauaaggugguacggguucagaggccugccaaaaacgggaccgugauggacgucaucucgcgucgagaucagcgcggaucaggccaagugggcacauacgggcuuaacacuuuuaccaauauggaggugcagcugauaagacagauggaaagcgagggaaucuuccucccauccgagcuggaaacacccaacuuggcagagcgggcguuagguuggcuggaaaagcacggcgccgagaggcucaagcgcauggcuauuaguggggacgauugugucguuaaaccgaucgacgacagauuugccacugcacuuaccgcucugaaugauaugggaaaggugcggaaagacauuccucagugggaacccucuaagggcuggaacgauuggcaacagguaccauucugcagccaccauuuucaccagcuaaucaugaaagacgguagggagauaguggucccuugucgaaaucaggaugagcugguggggcgugccagaguuucccaaggagcaggcuggucacuccgcgaaacggccugcuugggcaagaguuaugcgcagauguggcagcugauguacuuccaucggagggaccuuagacuggcugccaacgcaauuuguucugccgugcccgucgauugggugccaacaagccgcaccacuugguccauccacgcucaccaucaauggaugacaaccgaggacaugcucucaguauggaaucggguuuggaucgaagagaaccccuggauggaaaauaagacucacgugagcucuugggaggaggucccuuauuuagggaaaagggaagaucaguggugcggaucccugauugguuugaccgcccgagcaacaugggcuacgaacauacagguggccaucaaucagguuagacggcugauuggcaacgagaauuaccucgacuacaugaccaguaugaagagguuuaaaaacgaaagcgauucggagggggcgcuuugguga

SEQ ID NO: 13453 - RNA, 9879 nt, Artificial Sequence
  derived and/or modified CDS sequence (opt3) from DENV-1__KJ189358__SS-prME
agcgugaccaugcugcucaugcuucugcccacagucuuggccuuccacuuaacuacgagaggcggggagccucauaugaucguuuccaagcaggaaaggggaaaaucucugcuauuuaagaccucagcuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagagaagcguagcgucgcucuggccccccaugugggcuugggucucgaaacuagaaccgagacauggauguccucugaaggggcauggaaacagauccagaggguugagacuugggcccugcggcacccuggauucaccgugauugcuuuuuuccuggcacaugccaucggcacaucgauuacccagaagggcaucauauuuauccucuuaaugcuggucacgccaucaauggcuaugcgcugcguggggauuggaaacagagacuucguagagggucuuagcggcgccacuuggguugauguggucuuggaacacgggaguugugugacaaccauggcgaagaauaaacccacucuggacaucgagcuacucaagacagaagugaccaacccugcaguccugaggaaacuuugcauugaggccaagaucuccaauacgaccacagauucucgguguccaacucaaggagaagcuacccugguugaggagcaggacgccaacuuugugugccgccgaacauucguagauagaggcugggguaauggguguggauuguuuggcaaaggcagccuccugacuugcgcaaaguucaagugcgugaccaaauuagaagggaagauaguccaguacgagaaccugaaauauuccgugauuguuacagugcacaccggagaccagcaucaagucgguaaugaaacuacggagcacggcacaaucgcuaccauuacuccccaggccccuaccucagaaauccagcucacagauuacggggcgcuuacccuggacuguaguccaaggacuggauuggacuuuaacgagauggugcuacugacaaugaaggagaaaagcuggcucguacauaagcagugguuccuggaucuuccgcugcccuggacgucuggcgccuccaccucacaagaaacuuggaaucggcaggacuugcucguuacauuuaaaaccgcacacgcuaagaagcaggagguggucgugcuggguagccaagaaggggccaugcacacagcuuuaacuggcgccaccgagauccagacgaguggaaccacaacuauuuucgcaggccaucugaaaugccgucuaaagauggauaaacucacccugaaggggaugucuuaugucauguguacaggauccuucaaacuugaaaaggagguggccgagacucagcacgguaccguuuuggugcagguaaaguacgaaggcacggacgcuccuugcaaaauaccauuuagcacacaagaugagaagggggucacccagaacggacgccugaucacugcgaaucccauugugacagacaaagaaaagccuguuaacaucgagaccgagccacccuucggcgaaucguauauaguggucggugcaggggagaaagcccucaagcugucuugguuuaagagaggcuccucaauuggaaaaauguucgaagcuacugccaggggcgcacggcgaauggccauccuuggggauaccgcuugggacuuuggaaguaucgguggcguguucacaagcguagggaagcuggugcaucagguuuuuggaacggccuacggcgucuuguucuccggugugucuuggaccaugaaaauugggaucggcauucuccugacuugguuaggacugaauagccgcucaacaagucuauccaugaccuguauagcagugggcauggucacacucuaccuggggguuauggugcaggcggauagcggaugcgugaucaacuggaagggcagagagcuuaaaugugguucugggauuuuuguaacuaacgaaguccacaccuggacggagcaauauaaguuccaggcugacucaccgaagagguugagugccgcaaucggaaaagccugggaggaaggcgugugcgguauccggagcgcuacacgccuggagaauauuauguggaagcagauauccaacgaacucaaucauauccuguuagagaacgauaugaaauuuaccguuguggucggcgacgccaaugggauucuggcacagggaaagaaaaugaucagaccucaacccauggaacacaaguacucuuggaaaucguggggcaaggcuaagauuaucggggccgacauacagaacacuaccuucaucauugauggaccagacacaccugagugucccgauggccagagggcguggaauaucugggagguggaagacuaugguuuugggguuuucacuaccaacauuuggcuuaaauugcgugauagcuacacacagaugugcgaccaccggcucauguccgccgcuaucaaggauucaaaagcagugcaugccgacaugggauauuggauagagagugaaaagaaugagacguggaaacuggcucgagccucuuucauugaaguaaagaccuguacuuggccaaagagccacacacuaugguccaacggcguccuggagucagagaugaucauucccaaaaucuacgguggcccuauaagccaacauaauuauagaccaggguacuuuacccagacugcaggaccguggcaccucggcaagcuggaacuugauuucgacuugugcgaggggacaaccgugguggucgaugaacacugcggaaacaggggccccucucugcgcacgacuaccguuacagguaaaaucauucaugagugguguugccgguccuguaccuuaccuccacucagauuuaggggggaggacggaugcugguacggcauggaaauccgccccgugaaggagaaagaagagaaucugguacgaaguauggugagcgcggguucuggcgaagucgauuccuucucacuugggauucugugugugaguaucaugauagaggagguuaugcggagccguuggucgagaaagauguugaugacuggaacacucgccguguuucugcuacugauuaugggccagcucaccuggaacgaccugaucaggcuuugcaucauggucggggcuaaugccuccgaccgcaugggaaugggcacaacucacuuggcacugauggcuaccuucaagaugcggccuauguuugccguggguuuacucuucagaaggcugacgucucgagaaguucuucugcuaacaauugggcucagccugguggcaucagucgaguugccaaacagucuggaagaguuaggagauggccucgccaugggcaucaugaugcugaaacuucugaccgaauuucaacccuaucaguuguggacuacccuccugucccuaacauucguaaagacuacccugucucuugacuacgcuuggaaaacgacagcgauggcccucagcauugugucccuguuuccguugugucugucaaccacuagccagaagacaaccugguuaccuguucuccuggggaguuucggaugcaaaccacuuacuauguuucugauaacagagaacaagaucuggggucgcaagucuuggcccuugaaugagggcauuauggcaaucgggauuguguccauccuccugagcucgcuacugaaaaacgaugucccucuugcuggaccccucauagccggcgguaugcugaucgccuguuaugugauuucagggucuagugcugacuuguccuuagaaaaggcagccgagguaagcugggaacaggaggcggaacauucuggagcuagccacuccauccugguggagguccaagaugacggcaccaugaaaauuaaggaugaggaacgggacgauacgcucacuauccugcuuaaagccacccuguuggcaguuucaggcguguacccaaugaguauaccugccacacuauucgugugguauuucuggcagagaaagaaacagaggagcgggguccugugggacacccccucuccaccggagguggaacgugcuguucucgauaauggaauuuaccgcauccugcagcggggucuuuuaggcagaucccaaguaggggugggagucuuucaggacggcguguuccauacaauguggcacguuacuaggggugcagugcugauguaucaggggaagcgacucgagccuucaugggccagugucaagaaagauuugaucagcuacggaggcggcuggcgguuucagggguccuggaacaccggagaggaagugcaaguaauugcggucgagcccgguaagaauccaaaaaacgugcagacgacacccggcacuuucaagaccccugaaggggagguuggagcuauagcccuggacuuuaaaccaggcacaucugguucgcccaucgugaaucgcgaagggaagauugucggacucuacggcaacggcgugguuaccacuagcgggaccuaugugucagcaaucgcccaggcuaaggccucccaagagggaccucugccggagauugaagacgaggucuucaaaaagagaaaucuuacaaucauggaucugcacccagguaguggcaaaacgaggaaguacuugcccgcaauagugcgggaagcuaucaaacgaaagcuaagaacucugauucucgccccuacccgcguaguggcgucugagauggccgaagcauuaaaggggaugccaaucagguaucagacaaccgcuguuaaaagcgagcauacuggacgugagauugucgaccugaugugccacgccacauuuaccaugcggcuucugucccccgugagagugccuaacuacaauaugaucauaauggaugaagcucauuucacggacccggcaucaauugccgccaggggcuauaucucuacucgcgucgguaugggggaggcugcggcaaucuuuaugacagccacccccccaggaagcguagaagcuuucccucagaguaacgccgugauucaggaugaggaacgagacauccccgagagauccuggaauagcggcuacgauuggauaaccgacuuuccaggcaagacuguuugguucgugccuucuauuaaaucagggaacgauaucgcaaauugucuccggaagaacggaaaaagggucauucaauugucccgcaagacauucgacaccgaguaucagaagacaaaaaacaaugauugggacuacgugguuacuacggacaucagugaaaugggugccaacuuucgugcugauagagugauagacccccggaggugccugaagccagucauucucaaagauggcccggagcgcgugauccuggcggggccuaugcccguaaccguggccagcgcagcucagcgaagaggacggaucggcaggaaucagaacaaggaaggugaccaauacguuuauauggggcagccacuuaauaacgaugaggaccacgcccauuggacagaggcaaaaaugcuacuggauaauauuaacacucccgaaggcaucauuccugccuuguucgagccagaacgcgagaagucggcugccauagacggagaauacagauuaaggggcgaggcgcggaagaccuuugucgagcugaugcgucgcggggaucuccccguguggcugucuuauaaaguggcauccgaaggauuccaguacagcgaccgaagauggugcuuugauggugagaggaauaaccagguccuugaagagaauauggacguugaaaucuggacaaaggagggcgagcggaaaaagcugcgcccuagauggcucgaugccaggaccuauucagacccguuggcucugcgggaauucaaagaguuugccgcugggcgaagaagugugucuggagaccuaauucuggaaaucggcaagcucccacaacaccuuacucugcgcgcacagaacgccuuagauaauuugguaaugcugcacaacuccgagcagggugggaaagcuuacaggcaugccauggaagagcuccccgacacgaucgagacccugaugcuucuggcacucauugcgguguugacaggcggagucacucuguucuuuuuaagcggcaaggggcuaggaaagaccucaauaggucugcucugugugacagccaguagcgcucuucuguggauggccuccguugaaccucacuggaucgcagcuucuauuaucuuggaguucuuucugauggugcuccugauucccgaaccagaucggcagcguaccccucaagacaaucagcuugccuaugucguaaucggccuccuguucaugauauugacuguggcagccaacgagauggggcuguuagagacaacgaaaaaggaucuaggaaucggcuacguugcugcggaaaaccaucagcacgccaccaugcuggacguggaucuccaccccgcaagcgcuuggacucuuuacgccgucgccacaaccgugauuaccccaaugaugagacauacaaucgagaauacuacggcaaacauuucccugaccgcuaucgccaaucaagcggcuauauugaugggucuggacaaaggguggccuauuucaaagauggauaucggcgucccgcuccuggcccuuggaugcuauucucaggugaaccccuuaacacugacugcagccguucucauguugguggcucacuacgcaauuaucggcccagggcugcaggccaaagcgaccagggaagcucagaagcgcacagccgcaggaauaaugaagaauccuaccguagacggcaucguggccauugaucuagaccccgucguuuaugaugcuaaauuugagaagcaacugggucagaucaugcuccuuauucuguguacuagucagaucuugcugaugcggacgacaugggcccucugcgaaucgauaacccuggcaacugggccauuaaccacacuuugggagggaagcccuggcaaauucuggaacacuaccauugcuguguccauggccaauaucuuccgagguucuuaccuggcgggcgccgggcucgcauuuucacuaaugaagagccugggaggcgggagaaggggaacaggcgcucagggugagacguugggggaaaaauggaagcgccaacugaaccagcucuccaagagugaguucaauaccuauaaacggucuggaaucauggaagucgacagaagcgaggccaaggaaggccuuaaacguggugagacuacaaagcaugcagugucaaggggcaccgcuaaacugcggugguuuguagagcgcaacuuggugaagcccgaagggaagguuauugaccugggauguggccgagggggaugguccuacuauugcgccggccucaaaaaggugacugaggucaaagguuacacaaaggggggaccgggccacgaagagccaaucccuauggccaccuacggcuggaauuuagugaaacugcauagugggaaggaugucuucuuuaugcccccagaaaaaugugacacgcuucugugcgauauaggagagagcucucccaacccuaccauugaggaagguagaacacuaagggugcucaagaugguugagccguggcugcggggcaaucaguucuguaucaagauuuugaaccccuauaugccauccguaguggaaacucuggagcgcaugcagagaaaacacgggggaaugcucgucaggaauccucuuucacgaaacagcacccacgagauguacugggugucgugcggcacagguaauaucguuucugcggugaacaugacuagucggaugcuguuaaaccguuuuaccauggcucauagaaagcccacauaugaacgcgacgucgaucugggggcaggaaccaggcacguggccguagagccugaaguggcuaauuuggacauaaucggccaacggauugagaacaucaaaaaugaacauaaguccacuuggcacuacgaugaggacaacccauauaaaacgugggccuaccacggcagcuaugagguuaagcccucaggguccgcaucuagcauggucaauggaguggugagacuccugacaaagccuugggaugucauuccaaugguuacccagaucgccaugacugacaccacacccuucggucagcaacgcguguuuaaagaaaagguagauacgaggaccccgcgagcuaaacggggcacuacacagauuauggaggugaccgcgaaguggcuauggggguuccuuaguagaaacaaaaagccuaggaucuguacucgcgaagaguuuacacguaagguccgguccaaugccgcaauaggagcuguguucguugacgaaaaccaguggaauagcgccaaagaggcaguggaggacgaaagauuuugggaucugguccauagggagcgcgaacuccacaagcagggcaaaugcgccaccugcguguacaacaugauggguaagcgagagaaaaagcugggggaauucggaaaggcuaaaggcucucgggccauuugguacaugugguugggcgcgagauuccuggaguuugaggcacucggguucaugaaugaagaccauugguuuucaagggagaacagucuuuccggaguagaaggugagggccugcacaaguuaggguauauccugcgcgauaucagcaaaauuccaggaggcaauauguacgccgacgauacagcugguugggacacuagaauaaccgaggaugacuugcaaaacgaagccaagaucacggauauuauggagcccgaacaugcacagcucgcuaccucuaucuucaaacugacauaucagaauaagguugugcggguccagaggccugccaaaaacgggacugugauggacgugauuucgcgucgagaucaacgcggaucaggccaggucggcaccuacgggcuaaacacauuuacuaauauggagguucagcuuaucagacagauggaaagcgagggaauauuccugccauccgagcucgaaacccccaaccuggcugagcgggccuuggacugguuagaaaagaauggugcagagaggcugaagcgcauggcgaucaguggcgaugacugugugguaaaaccgauugacgauagauuugccacggcucucacagcccuuaacgacauggggaaggugcggaaagauaucccucaaugggaacccucuaagggauggaaugacuggcagcaggucccauucugcagccaccacuuucaucagcugauuaugaaagauggcagggagaucgugguuccuugucgaaaccaagacgagcuagugggucgugcaagagucucccagggggcuggauggucacugcgcgaaaccgccugccucggcaagaguuaugcacagauguggcaauugauguacuuccaccggagggaucugagacuugccgcgaaugcuauauguucugccgugcccguagacuggguuccaacuagccgcacaaccugguccauucaugcacaccaccaguggaugacuaccgaggauaugcugucaguguggaaccgggucuggaucgaagagaaucccuggauggaagacaagacacaugugagcucuugggaggagguuccuuaucucggcaaaagggaagaucaguggugcggguccuuaaucggacugacggcccgagcuaccugggccacuaacauucagguggcaauaaaucaagucagacgguugaucgguaacgagaauuaccuggacuacaugacaaguaugaagagguuuaaaaacgaaagcgacucggagggcgcucucugguga

SEQ ID NO: 13454 - RNA, 9879 nt, Artificial Sequence
  derived and/or modified CDS sequence (opt3) from DENV-1__KJ189359__SS-prME
agcgugaccaugcugcucaugcuucugcccacagucuuggccuuccacuuaacuacgagaggcggggagccucauaugaucguuuccaagcaggaaaggggaaaaucucugcuauuuaagaccucagcuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagagaagcguagcgucgcucuggccccccaugugggcuugggucucgaaacuagaaccgagacauggauguccucugaaggggcauggaaacagauccagaggguugagacuugggcccugcggcacccuggauucaccgugauugcuuuuuuccuggcacaugccaucggcacaucgauuacccagaagggcaucauauuuauccucuuaaugcuggucacgccaucaauggcuaugcgcugcguggggauuggaaacagagacuucguagagggucuuagcggcgccacuuggguugauguggucuuggaacacgggaguugugugacaaccauggcgaagaauaaacccacucuggacaucgagcuacucaagacagaagugaccaacccugcaguccugaggaaacuuugcauugaggccaagaucuccaauacgaccacagauucucgguguccaacucaaggagaagcuacccugguugaggagcaggacgccaacuuugugugccgccgaacauucguagauagaggcugggguaauggguguggauuguuuggcaaaggcagccuccugacuugcgcaaaguucaagugcgugaccaaauuagaagggaagauaguccaguacgagaaccugaaauauuccgugauuguuacagugcacaccggagaccagcaucaagucgguaaugaaacuacggagcacggcacaaucgcuaccauuacuccccaggccccuaccucagaaauccagcucacagauuacggggcgcuuacccuggacuguaguccaaggacuggauuggacuuuaacgagauggugcuacugacaaugaaggagaaaagcuggcucguacauaagcagugguuccuggaucuuccgcugcccuggacgucuggcgccuccaccucacaagaaacuuggaaucggcaggacuugcucguuacauuuaaaaccgcacacgcuaagaagcaggagguggucgugcuggguagccaagaaggggccaugcacacagcuuuaacuggcgccaccgagauccagacgaguggaaccacaacuauuuucgcaggccaucugaaaugccgucuaaagauggauaaacucacccugaaggggaugucuuaugucauguguacaggauccuucaaacuugaaaaggagguggccgagacucagcacgguaccguuuuggugcagguaaaguacgaaggcacggacgcuccuugcaaaauaccauuuagcacacaagaugagaagggggucacccagaacggacgccugaucacugcgaaucccauugugacagacaaagaaaagccuguuaacaucgagaccgagccacccuucggcgaaucguauauaguggucggugcaggggagaaagcccucaagcugucuugguuuaagagaggcuccucaauuggaaaaauguucgaagcuacugccaggggcgcacggcgaauggccauccuuggggauaccgcuugggacuuuggaaguaucgguggcguguucacaagcguagggaagcuggugcaucagguuuuuggaacggccuacggcgucuuguucuccggugugucuuggaccaugaaaauugggaucggcauucuccugacuugguuaggacugaauagccgcucaacaagucuauccaugaccuguauagcagugggcauggucacacucuaccuggggguuauggugcaggcggauagcggaugcgugaucaacuggaagggcagagagcuuaaaugugguucugggauuuuuguaacuaacgaaguccacaccuggacggagcaauauaaguuccaggcugacucaccgaagagguugagugccgcaaucggaaaagccugggaggaaggcgugugcgguauccggagcgcuacacgccuggagaauauuauguggaagcagauauccaacgaacucaaucauauccuguuagagaacgauaugaaauuuaccguuguggucggcgacgccaaugggauucuggcacagggaaagaaaaugaucagaccucaacccauggaacacaaguacucuuggaaaucguggggcaaggcuaagauuaucggggccgacauacagaacacuaccuucaucauugauggaccagacacaccugagugucccgauggccagagggcguggaauaucugggagguggaagacuaugguuuugggguuuucacuaccaacauuuggcuuaaauugcgugauagcuacacacagaugugcgaccaccggcucauguccgccgcuaucaaggauucaaaagcagugcaugccgacaugggauauuggauagagagugaaaagaaugagacguggaaacuggcucgagccucuuucauugaaguaaagaccuguacuuggccaaagagccacacacuaugguccaacggcguccuggagucagagaugaucauucccaaaaucuacgguggcccuauaagccaacauaauuauagaccaggguacuuuacccagacugcaggaccguggcaccucggcaagcuggaacuugauuucgacuugugcgaggggacaaccgugguggucgaugaacacugcggaaacaggggccccucucugcgcacgacuaccguuacagguaaaaucauucaugagugguguugccgguccuguaccuuaccuccacucagauuuaggggggaggacggaugcugguacggcauggaaauccgccccgugaaggagaaagaagagaaucugguacgaaguauggugagcgcggguucuggcgaagucgauuccuucucacuugggauucugugugugaguaucaugauagaggagguuaugcggagccguuggucgagaaagauguugaugacuggaacacucgccguguuucugcuacugauuaugggccagcucaccuggaacgaccugaucaggcuuugcaucauggucggggcuaaugccuccgaccgcaugggaaugggcacaacuuauuuggcacugauggcuaccuucaagaugcggccuauguuugccguggguuuacucuucagaaggcugacgucucgagaaguucuucugcuaacaauugggcucagccugguggcaucagucgaguugccaaacagucuggaagaguuaggagauggccucgccaugggcaucaugaugcugaaacuucugaccgaauuucaaccccaccaguuguggacuacccuccugucccuaacauucguaaagacuacccugucucuugacuacgcuuggaaaacgacagcgauggcccucagcauugugucccuguuuccguugugucugucaaccacuagccagaagacaaccugguuaccuguucuccuggggaguuucggaugcaaaccacuuacuauguuucugauaacagagaacaagaucuggggucgcaagucuuggcccuugaaugagggcauuauggcaaucgggauuguguccauccuccugagcucgcuacugaaaaacgaugucccucuugcuggaccccucauagccggcgguaugcugaucgccuguuaugugauuucagggucuagugcugacuuguccuuagaaaaggcagccgagguaagcugggaacaggaggcggaacauucuggagcuagccacuccauccugguggagguccaagaugacggcaccaugaaaauuaaggaugaggaacgggacgauacgcucacuauccugcuuaaagccacccuguuggcaguuucaggcguguacccaaugaguauaccugccacacuauucgugugguauuucuggcagagaaagaaacagaggagcgggguccugugggacacccccucuccaccggagguggaacgugcuguucucgauaauggaauuuaccgcauccugcagcggggucuuuuaggcagaucccaaguaggggugggagucuuucaggacggcguguuccauacaauguggcacguuacuaggggugcagugcugauguaucaggggaagcgacucgagccuucaugggccagugucaagaaagauuugaucagcuacggaggcggcuggcgguuucagggguccuggaacaccggagaggaagugcaaguaauugcggucgagcccgguaagaauccaaaaaacgugcagacgacacccggcacuuucaagaccccugaaggggagguuggagcuauagcccuggacuuuaaaccaggcacaucugguucgcccaucgugaaucgcgaagggaagauugucggacucuacggcaacggcgugguuaccacuagcgggaccuaugugucagcaaucgcccaggcuaaggccucccaagagggaccucugccggagauugaagacgaggucuucaaaaagagaaaucuuacaaucauggaucugcacccagguaguggcaaaacgaggcgguacuugcccgcaauagugcgagaagcuaucaagagaaaacuacgcacucugauucucgccccuaccaggguaguggcgucugagauggccgaagcauuaaaggggaugccaauccguuaucagacaaccgcuguuaagagcgagcauacuggacgggagauugucgaccugaugugccacgccacauuuaccaugagacuucugucccccgugagggugccuaacuacaauaugaucauaauggaugaagcucauuucacggacccggcaucaauugccgcccgcggcuauaucucuacucgagucgguaugggggaggcugcggcaaucuuuaugacagccacccccccaggaagcguagaagcuuucccucagaguaacgccgugauucaggaugaggaaagagacauccccgagcgguccuggaauagcggcuacgauuggauaaccgacuuuccaggcaaaacuguuugguucgugccuucuauuaagucagggaacgauaucgcaaauugucucaggaaaaacggaaagcgcgucauucaauugucccguaaaacauucgacaccgaguaucagaagacaaagaacaaugauugggacuacgugguuacuacggacaucagugaaaugggugccaacuuuagagcugaucgggugauagaccccaggcgcugccugaaaccagucauucucaaggauggcccggagcgagugauccuggcggggccuaugcccguaaccguggccagcgcagcucagagacggggaaggaucggccgcaaucagaacaaagaaggugaccaauacguuuauauggggcagccacuuaauaacgaugaggaccacgcccauuggacagaggcaaagaugcuacuggauaauauuaacacucccgaaggcaucauuccugccuuguucgagccagaaagagagaaaucggcugccauagacggagaauacagguuacggggcgaggcgcguaagaccuuugucgagcugaugcgccgaggggaucuccccguguggcugucuuauaagguggcauccgaaggauuccaguacagcgacagaagguggugcuuugauggugagcggaauaaccagguccuugaagagaauauggacguugaaaucuggacaaaagagggcgagcgcaagaaacugagaccuagguggcucgaugcccggaccuauucagacccguuggcucugcgagaauucaaggaguuugccgcugggagacgcagugugucuggagaccuaauucuggaaaucggcaaacucccacaacaccuuacucugagggcacagaacgccuuagauaauuugguaaugcugcacaacuccgagcagggugggaaggcuuaccggcaugccauggaagagcuccccgacacgaucgagacccugaugcuucuggcacucauugcgguguugacaggcggagucacucuguucuuuuuaagcggcaaagggcuaggaaagaccucaauaggucugcucugugugacagccaguagcgcucuucuguggauggccuccguugaaccucacuggaucgcagcuucuauuaucuuggaguucuuucugauggugcuccugauucccgaaccagaucgucagagaaccccucaagacaaucagcuugccuaugucguaaucggccuccuguucaugauauugacuguggcagccaacgagauggggcuguuagagacaacgaagaaagaucuaggaaucggcuacguugcugcggaaaaccaucagcacaccacuaugcuggacguggaucuccaccccgccagcgcauggacacuuuacgcugucgccaccaccgugauuacaccaaugaugaggcauacuaucgagaauacgaccgccaacauuucccugacagcaaucgcuaaucaagccgcgauauugaugggucuggacaagggguggccuauuucaaaaaucgauauuggcgucccgcuccuggcucuuggaugcuauucucaggugaaccccuuaacucugaccgccgcaguucucauguugguggcccacuacgcuaucauaggcccagggcugcaggcaaaggccacacgcgaagcgcagaaacggaccgcugccggaaucaugaagaauccuacuguagacggcauuguggcaaucgaucuagaccccgucguuuaugaugccaaguuugagaaacaacugggucagauuaugcuccuuauccuguguacgagucagauauugcugaugcgaacaaccugggcucucugcgaaucgauuacucuggccaccgggccauuaacaacucuuugggagggaagcccuggcaaguucuggaacaccacaaucgcaguguccauggcuaauaucuucagagguucuuaccuggccggcgcggggcucgccuuuucacuaaugaaaagccugggaggcgggaggcgcggaacgggcgcacagggugagaccuugggggaaaaguggaaacggcaacugaaccagcucuccaagagugaguucaauacuuauaagagaucuggaauuauggaagucgaccguagcgaggcuaaagaaggccuuaagaggggugagacaaccaaacaugccgugucacggggcacugcaaagcugcgcugguuuguagagcgaaacuuggugaaacccgaagggaagguuaucgaccugggauguggcagagggggaugguccuacuauugcgcuggccucaagaaagugacagaggucaaggguuacaccaaagggggaccgggccacgaagagccaauaccuauggccacguacggcuggaauuuagugaagcugcauagugggaaagaugucuucuuuaugcccccagaaaagugugacacccuucugugcgauauuggagagagcucucccaacccuacaaucgaggaagguaggacucuacgggugcucaaaaugguugagccguggcugcgcggcaaucaguucuguauuaagaucuugaaccccuauaugccauccguaguggaaacccuggagagaaugcagaggaagcacgggggaaugcucguccgaaauccucuuucacggaacagcacacacgagauguacugggugucgugcggcacugguaauauaguuucugccgugaacaugaccagucguaugcuguuaaacagauuuacaauggcgcaucgcaaacccaccuaugaaagggacgucgaucugggggcuggaacucggcacguggcaguagagccugaaguggccaauuuggacaucauuggccaaagaaucgagaacauuaagaaugaacauaaauccacguggcacuacgaugaggacaacccauauaagacaugggcuuaccacggcagcuaugagguuaaacccucaggguccgccucuagcauggucaauggaguggugcgccuccugaccaagccuugggaugucaucccaaugguuacucagauugcaaugaccgacacaacgcccuucggucagcaaaggguguuuaaggaaaaaguagauacccgaacuccgcgggccaagagaggcacaacccagaucauggaggugacugcuaaauggcuauggggguuccuuaguaggaacaagaaaccucgcauauguacacgugaagaguuuacccggaaggucagauccaaugcggccauuggagcaguguucguugacgaaaaccaguggaauacagcuaaggaggccguggaggacgaaagguuuugggaucugguccaucgcgagcgagaacuccacaaacagggcaagugcgcaacuugcguguacaacaugauggguaaacgggagaagaaacugggggaauucggaaaggccaagggcagcagagcuaucugguacaugugguugggcgccagguuccuggaguuugaggcgcucggguucaugaaugaagaccauugguuuucucgcgagaacucacuuaguggaguagaaggugagggccugcacaaauuaggguauauccugagagauauuuccaagauaccaggaggcaauauguacgcagacgauaccgccgguugggacacgcggaucaccgaggaugacuugcaaaacgaagcuaaaauuacagauaucauggagcccgaacaugcccuccuggcaacuagcauuuucaagcuaaccuaucagaauaaaguugugaggguccagcguccugcuaagaacgggacagugauggacgugaucucucgacgcgaucagagaggaucgggccaagucggcacuuacgggcuuaacaccuuuacgaauauggagguucagcugauacggcagauggaaucagagggaaucuuccucccaagcgagcuggaaacacccaacuuggccgagagggcuuuagacuggcuggaaaaacacggugccgagcgccucaagagaauggcaauuuccggcgaugacugugugguaaagccgaucgacgaucgguuugcgaccgcccuuacugcucugaaugacauggggaaagugaggaaggauauuccucagugggaacccaguaaaggauggaacgacuggcaacaggucccauucugcucucaccauuuucaccagcuaaucaugaaggauggccgagagauagugguuccuugucguaaucaggacgagcugguggguagagcccgcgucagccaaggggcaggauggucccuccgggaaacagcuugcuugggcaaaucauaugcccagauguggcagcugauguacuuccauaggagagaucuucgccuggcagccaacgcgauuuguagugcugugcccguagacuggguuccaaccucucggacuaccuggagcauccacgcccaccaucaauggaugacaacggaggauaugcucuccguguggaauagggucuggaucgaagagaaccccuggauggaagacaagacccacgugucaagcugggaggagguuccuuauuuaggcaagcgagaagaucaguggugcgggucucugauuggauugacugcaagagccacaugggcuaccaauauacagguggccaucaaccagguccggaggcugauugguaaugagaacuaccucgacuacaugacuuccaugaaacgcuuuaagaaugaaagugacagcgagggcgcacuuugguga

SEQ ID NO: 13455 - RNA, 9879 nt, Artificial Sequence
  derived and/or modified CDS sequence (opt3) from DENV-1__KJ189360__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagauuuuuggaacggcauacggcguguuguucuccgguguuucuuggaccaugaaaaucgggauuggcauacuccugacuugguuaggacugaauagccgcucaacaagucuauccaugaccuguaucgcggucggcauggugacacucuaccugggggugaugguccaggcugauagcggaugcguuauuaacuggaagggcagagagcuuaaaugugguucugggaucuuugugacuaacgaagugcacaccuggacggagcaauauaaguuccaggccgacucaccgaagagguugagugcagccaucggaaaagcuugggaggaaggcguaugcgguauucggagcgccacacgccuggagaauauaauguggaagcagaucuccaacgaacucaaucauauucuguuagagaacgauaugaaauuuaccgucgugguuggcgacgcaaaugggauccuggcucagggaaagaaaaugauuagaccucaacccauggaacacaaguacucuuggaaaucguggggcaaggccaagaucauaggggcggacauccagaacacuaccuucauuaucgauggaccagacacaccugagugucccgauggccagagggccuggaauauuugggagguggaagacuaugguuuuggggucuucacuaccaacaucuggcuuaaauugcgugauagcuacacacagaugugcgaccaccggcucauguccgcugcaauaaaggauucaaaagccgugcaugcugacaugggauauuggauugagagugaaaagaaugagacguggaaacuggcccgagcaucuuucaucgaaguuaagaccuguacuuggccaaagagccacacacuaugguccaacggcgugcuggagucagagaugauuauccccaaaauauacgguggcccuaucagccaacauaauuauagaccaggguacuuuacccagacugcgggaccguggcaccucggcaagcuggaacuugauuucgacuugugcgaggggacaaccguagucguggaugaacacugcggaaacaggggccccucucugcgcacgacuaccgugacagguaaaauuauccaugagugguguugccgguccuguaccuuaccuccacucagauuuaggggggaggacggaugcugguacggcauggaaauucgccccgucaaggagaaagaagagaaucugguucgaaguauggugagcgccgguucuggcgaaguagauuccuucucacuugggauccugugugugaguauaaugauugaggaggucaugcggagccguuggucgagaaagauguugaugacuggaacacucgcuguguuucugcuacugaucaugggccagcucaccuggaacgaccugaucaggcuuugcauuaugguuggggccaaugcauccgaccgcaugggaaugggcacaacuuauuuggcucugauggccaccuucaagaugcggccuauguuugcaguggguuuacucuucagaaggcugacgucucgagaaguccuucugcuaacaaucgggcucagccugguggccucaguugaguugccaaacagucuggaagaguuaggagauggccucgcuaugggcauuaugaugcugaaacuucugaccgaauuucaaccccaccaguuguggacuacccuccugucccuaacauucgugaagacuacccugucucuugacuacgcguggaaaacgacagccauggcacucagcauagucucccuguuuccguugugucugucaaccacuagccagaagacaaccugguuaccuguacuccuggggaguuucggaugcaaaccacuuacuauguuucugaucacagagaacaagauuuggggucgcaagucuuggcccuugaaugagggcaucauggcuauugggaucguguccauacuccugagcucgcuacugaaaaacgauguuccucuugccggaccccucaucgccggcgguaugcugauugcuuguuaugugaucucagggucuagugcagacuuguccuuagaaaaggccgcggaggucagcugggaacaggaggcugaacauucuggagccagccacuccauucugguggagguacaagaugacggcaccaugaaaaucaaggaugaggaacgggacgauacgcucacuauacugcuuaaagcaacccuguuggccgugucaggcgucuacccaaugaguauuccugcuacacuauucguuugguauuucuggcagaagaaaaagcagagaagcggggugcugugggacacccccucuccaccggagguggaaagggcaguccucgauaauggaaucuaccguauccugcagcgcggucuuuuaggccggucccaaguggggguuggaguauuucaggacggcguguuccauacaauguggcacgucacuagaggugccgugcugauguaucaggggaagaggcucgagccuucaugggcgaguguuaaaaaggauuugauuagcuacggaggcggcuggcgauuucagggguccuggaacaccggagaggaagugcaagucauagcuguggagcccgguaaaaauccaaagaacguacagacgacacccggcacuuucaaaaccccugaaggggaggucggagccaucgcacuggacuuuaagccaggcacaucugguucgcccauugugaaucgggaagggaagaucguuggacucuacggcaacggcguggucaccacuagcgggaccuaugugucagccauugcucaggccaaagcaucccaagagggaccucugccggagaucgaagacgagguuuucaagaaacgcaaucuuacaauaauggaucugcacccagguaguggcaagacgagaagguacuugcccgcuaucgugcgggaagccauuaaacgaaagcuaagaacucugauccucgcgccuacccgcgucguggccucugagauggcagaagcuuuaaaggggaugccaauuagguaucagacaaccgccguaaaaagcgagcauacuggacgugagaucguggaccugaugugccacgcuacauuuaccaugcggcuucugucccccguuagagucccuaacuacaauaugauaauuauggaugaagcacauuucacggacccggccucaaucgccgcuaggggcuauaucucuacucgcguggguaugggggaggcggcagccauuuuuaugacagcuacccccccaggaagcguggaagccuucccucagaguaacgcagucauccaggaugaggaacgagacauacccgagagauccuggaauagcggcuacgauuggauuaccgacuuuccaggcaagacuguaugguucgugccuucuaucaaaucagggaacgauauugccaauugucuccggaagaacggaaaaaggguuauccaauugucccgcaagacauucgacaccgaguaucagaagacaaaaaacaaugauugggacuacguggucacuacggacauaagugaaaugggugcuaacuuucgugcggauagagugauugacccccggaggugccugaagccaguuauccucaaagauggcccggagcgcgugauccuggccgggccuaugcccgucaccgcagcuagcgccgcacagcgaagaggacggauuggcaggaaucagaacaaggaaggugaccaauacguguauauggggcagccacuuaauaacgaugaggaccacgcccauuggacagaggcuaaaaugcuacuggauaauaucaacacucccgaaggcauuauaccugccuuguucgagccagaacgcgagaagucggcggcaaucgacggagaauacagauuaaggggcgaggcccggaagaccuuuguagagcugaugcgucgcggggaucuccccguguggcugucuuauaaaguugcuuccgaaggauuccaguacagcgaccgaagauggugcuuugauggugagaggaauaaccagguccuugaagagaauauggacguggaaauuuggacaaaggagggcgagcggaaaaagcugcgcccuagauggcucgaugccaggaccuauucagacccguuggcucugcgggaauucaaagaguuugcagccgggcgaagaagugugucuggagaccuaauccuggaaaucggcaagcucccacaacaccuuacucugcgcgcucagaacgccuuagauaauuuggucaugcugcacaacuccgagcagggugggaaagcauacaggcaugcgauggaagagcuccccgacacgauugagacccugaugcuucuggcccucauagcuguuuugacaggcggagugacucuguucuuuuuaagcggcaaggggcuaggaaagaccucaaucggucugcucuguguaacagccaguagcgcacuucuguggauggcuuccguggaaccucacuggauugccgcaucuaucauuuuggaguucuuucugaugguccuccugauccccgaaccagaucggcagcguaccccucaagacaaucagcuugccuaugugguuauaggccuccuguucaugaucuugacuguggcugcgaacgagauggggcuguuagagacaacgaaaaaggaucuaggaauuggcuacgucgccgcagaaaaccaucagcacgcuaccaugcuggacguagaucuccaccccgccagcgccuggacucuuuacgcaguggcuacaaccguuaucaccccaaugaugagacauacaauugagaauacuacggccaacaucucccugaccgcgauagcuaaucaagccgcaauuuugaugggucuggacaaaggguggccuaucucaaagauggauauuggcgugccgcuccuggcccuuggaugcuauucucaggucaaccccuuaacacugacugcugcagugcucauguuggucgcccacuacgcgaucauaggcccagggcugcaggcuaaagccaccagggaagcacagaagcgcacagccgcuggaaucaugaagaauccuaccguggacggcauuguugccaucgaucuagaccccgugguauaugaugcaaaauuugagaagcaacugggucagauuaugcuccuuauccuguguacuagucagauauugcugaugcggacgacaugggcucucugcgaaucgauuacccuggccacugggccauuaaccacacuuugggagggaagcccuggcaaauucuggaacacuaccaucgcgguguccauggccaauaucuuccgagguucuuaccuggcaggcgcugggcucgccuuuucacuaaugaagagccugggaggcgggagaaggggaacaggcgcacagggugagacguugggggaaaaauggaagcgccaacugaaccagcucuccaagagugaguucaauaccuauaaacggucuggaauuauggaagucgacagaagcgaggcuaaggaaggccuuaaacguggugagacuacaaagcaugccguuucaaggggcaccgccaaacugcggugguuuguggagcgcaacuuggucaagcccgaagggaaggugaucgaccugggauguggccgagggggaugguccuacuauugcgcgggccucaaaaagguaacugaggugaaagguuacacaaaggggggaccgggccacgaagagccaauaccuauggcuaccuacggcuggaauuuaguuaaacugcauagugggaaggauguguucuuuaugcccccagaaaaaugugacacgcuucugugcgauauuggagagagcucucccaacccuaccaucgaggaagguagaacacuaaggguccucaagaugguggagccguggcugcggggcaaucaguucuguauuaagaucuugaaccccuauaugccauccgucguggaaacucuggagcgcaugcagagaaaacacgggggaaugcucguuaggaauccucuuucacgaaacagcacccacgagauguacuggguaucgugcggcacagguaauauagugucugcagucaacaugacuagucggaugcuguuaaaccguuuuaccauggcccauagaaagcccacauaugaacgcgacguggaucugggggcuggaaccaggcacguugccguggagccugaagucgcaaauuuggacaucauuggccaacggaucgagaacauuaaaaaugaacauaaguccacuuggcacuacgaugaggacaacccauauaaaacgugggccuaccacggcagcuaugaggugaagcccucaggguccgcuucuagcaugguaaauggagugguuagacuccugacaaagccuugggaugucaucccaauggugacccagauugcgaugacugacaccacacccuucggucagcaacgcguguuuaaagaaaaggucgauacgaggaccccgcgagccaaacggggcacuacacagaucauggagguuaccgcaaaguggcuauggggguuccuuaguagaaacaaaaagccuaggauauguacucgcgaagaguuuacacguaaggugcgguccaaugcugccauuggagcaguauucguggacgaaaaccaguggaauagcgccaaagaggcugucgaggacgaaagauuuugggaucuggugcauagggagcgcgaacuccacaagcagggcaaaugcgccaccugcguuuacaacaugauggguaagcgagagaaaaagcugggggaauucggaaaggcgaaaggcucucgggcaaucugguacaugugguugggcgccagauuccuggaguuugaggcucucggguucaugaaugaagaccauugguuuucaagggagaacagucuuuccggaguggaaggugagggccugcacaaguuaggguauauccugcgcgauauuagcaaaauaccaggaggcaauauguacgccgacgauacagcagguugggacacuagagucaccgaggaugacuugcaaaacgaagcuaagaucacggauauuauggagcccgaacaugcccuccuggcuaccucuaucuucaaacuaacauaucagaauaaggugguacggguucagaggccugccaaaaacgggacugugauggacgucauuucgcgucgagaucagcgcggaucaggccaagugggcaccuacgggcuuaacacauuuacuaauauggaggugcagcugaucagacagauggaaagcgagggaauauuccucccauccgagcuggaaacccccaacuuggcagagcgggcguuagacuggcuggaaaagcacggugccgagaggcucaagcgcauggcuaucaguggcgaugacugugucguuaaaccgauugacgauagauuugccacggcacuuacagcucugaaugacauggggaaggugcggaaagauaucccucagugggaacccucuaagggauggaacgacuggcaacagguaccauucugcagccaccauuuucaccagcuaauuaugaaagauggcagggagaucguggucccuugucgaaaucaggacgagcuggugggucgugccagaguuucccaaggggcaggauggucacuccgcgaaaccgccugcuugggcaagaguuaugcgcagauguggcagcugauguacuuccaucggagggaucuuagacuggcugccaacgcaauauguucugccgugcccgucgacugggugccaacuagccgcacaaccugguccauucacgcucaccaucaauggaugacuaccgaggauaugcucucaguauggaaucggguuuggaucgaagagaaccccuggauggaaaauaagacacacgugagcucuugggaggaggucccuuauuuaggcaaaagggaagaccaguggugcgggucccugaucggauugacggcccgagcaaccugggcuacuaacauucagguggccauaaaucagguuagacggcugaucgguaacgagaauuaccucgauuacaugacaaguaugaagagguuuaaaaacgaaagcgacucggagggcgcgcuuugguga

SEQ ID NO: 13456 - RNA, 9879 nt, Artificial Sequence
  derived and/or modified CDS sequence (opt3) from DENV-1__KJ189361__SS-prME
agcgugaccaugcugcuaaugcuucugcccacugccauggcuuuccacuugacuacgaggggcggggagccucauaugaucgucuccaagcaggaaaggggaaagucuuuacuguuuaagaccucagccgguguuaacaugugcacacuaauugccauggaccucggcgagcugugugaagauacuaugaccuacaaaugcccacggauaaccgaggcggaaccggacgauguggacuguuggugcaaugcuaccgauacuuggguaacauaugggaccuguagucaaacgggagagcaccgccgagagaagcguagcguggcccuugcaccccaugucggccuggguuuggaaacuagaaccgagacauggauguccucugaaggggccuggaaacagauccagaggguggagacuugggcucuccggcacccuggauucaccguuauugcauuuuuccuggcccaugcuaucggcacaucgauuacccagaagggcaucauauuuauccugcucauguuagugacgccaucaauggccaugcgcugcgucgggauuggaaacagagacuucguggagggucugagcggcgcgacuuggguagauguugugcuugaacacgggaguugugucacaaccauggcaaagaauaaacccacuuuggacaucgagcugcuaaagacagaagugaccaacccugccgugcucaggaaacugugcauugaggcuaagaucuccaauacgaccacagauucucgguguccaacucaaggagaagccacccuugucgaggagcaggacgcaaacuuuguuugccgccgaacauucguggauagaggcugggguaauggguguggacuguuuggcaaaggcagcuugcucacuugcgcuaaguucaagugcguaaccaaacuggaagggaagauagugcaguacgagaacuuaaaauauuccgucauugugacaguucacaccggagaccagcaucaaguggguaaugaaacuacggagcacggcacaaucgccaccauuacuccccaggcgccuaccucagaaauccagcugacagauuacggggcccucacccuugacuguaguccaaggacuggacuggacuuuaacgagauggucuugcuaacaaugaaggagaaaagcuggcuggugcauaagcagugguuccucgaucugccgcuucccuggacgucuggcgcauccaccucacaagaaacuuggaaucggcaggaccuguugguaacauuuaaaaccgcucacgccaagaagcaggagguugugguccucgguagccaagaaggggcuaugcacacagcccugacuggcgcaaccgagauccagacgaguggaaccacaacuauuuucgccggccauuuaaaaugccgucugaagauggauaaacuaacccucaaggggaugucuuaugugauguguacaggauccuucaaacuggaaaaggaggucgcugagacucagcacgguaccgugcuuguucaggugaaguacgaaggcacggacgcgccuugcaaaauaccauuuagcacacaagaugagaaggggguaacccagaacggacgcuugaucacugcaaaucccauugucacagacaaagaaaagccugugaacaucgagaccgagccacccuucggcgaaucguauauaguugugggugccggggagaaagcucugaagcucucuugguuuaagagaggcuccucaauuggaaaaauguucgaagccacugcaaggggcgcccggcgaauggcuauccugggggauaccgccugggacuuuggaaguaucgguggcgucuucacaagcguggggaaacuuguacaucagauuuuuggaacggcauacggcgugcuguucuccgguguuucuuggaccaugaaaaucgggauuggcauauugcucacuuggcugggauuaaauagccgcucaacaagucuguccaugaccuguaucgcggucggcauggugacacuauaccucggggugaugguccaggcugauagcggaugcguuauuaacuggaagggcagagagcugaaaugugguucugggaucuuugugacuaacgaagugcacaccuggacggagcaauauaaguuccaggccgacucaccgaagaggcuuagugcagccaucggaaaggcuugggaggaaggcguaugcgguauucggagcgccacacgcuuggagaauauaauguggaagcagaucuccaacgaacugaaucauauucuccuggagaacgauaugaaauuuaccgucgugguuggcgacgcaaaugggaucuuagcucagggaaagaaaaugauuagaccucaacccauggaacacaaguacucuuggaaaucguggggcaaggccaagaucauaggggcggacauccagaacacuaccuucauuaucgauggaccagacacaccugagugucccgauggccagagggccuggaauauuugggagguggaagacuaugguuuuggggucuucacuaccaacaucuggcugaaacuucgugauagcuacacacagaugugcgaccaccgguugauguccgcugcaauaaaggauucaaaagccgugcaugcugacaugggauauuggauugagagugaaaagaaugagacguggaaacucgcccgagcaucuuucaucgaaguuaagaccuguacuuggccaaagagccacacacugugguccaacggcgugcuagagucagagaugauuauccccaaaauauacgguggcccuaucagccaacauaauuauagaccaggguacuuuacccagacugcgggaccguggcaccugggcaagcucgaacuggauuucgaccuuugcgaggggacaaccguagucguggaugaacacugcggaaacaggggccccucuuugcgcacgacuaccgugacagguaaaauuauccaugagugguguugccgguccuguacccugccuccauuaagauuuagaggggaagacggaugcugguacggcauggaaauucgccccgucaaggagaaagaagagaaucucguucgaaguauggugagcgccgguucuggcgaaguagauuccuucucacuggggauccuuugugugaguauaaugauugaggaggucaugcggagccguuggucgagaaagaugcugaugacuggaacauuggcuguguuucuccugcuaaucaugggccagcugaccuggaacgaccucaucaggcugugcauuaugguuggggccaaugcauccgaccgcaugggaaugggcacaacuuaucuugcuuugauggccaccuucaagaugcggccuauguuugcagugggucuguuauucagaaggcucacgucucgagaaguccugcuucugacaaucgggcuaagccucguggccucaguugagcugccaaacaguuuggaagaacugggagauggcuuagcuaugggcauuaugaugcucaaacugcuuaccgaauuucaaccccaccagcuguggacuaccuugcucucccugacauucgugaagacuacccuaucucuggacuacgcguggaaaacgacagccauggcacuuagcauagucucccucuuuccgcuguguuugucaaccacuagccagaagacaaccuggcugccuguauuacucgggaguuucggaugcaaaccacugacuauguuucuuaucacagagaacaagauuuggggucgcaagucuuggccccugaaugagggcaucauggcuauugggaucguguccauauugcucagcucgcugcucaagaacgauguuccucuggccggaccccuuaucgccggcgguaugcucauugcuuguuaugugaucucagggucuagugcagaccuguccuuggaaaaggccgcggaggucagcugggaacaggaggcugaacauucuggagccagccacuccauuuuaguggagguacaagaugacggcaccaugaaaaucaaggaugaggaacgggacgauacgcugacuauacuccugaaagcaacccuucuggccgugucaggcgucuacccaaugaguauuccugcuacauuguucguuugguauuucuggcagaagaaaaagcagagaagcggggugcuaugggacacccccucuccaccggagguggaaagggcaguccuggauaauggaaucuaccguauccuccagcgcggucugcuuggccggucccaaguggggguuggaguauuucaggacggcguguuccauacaauguggcacgucacuagaggugccguguuaauguaucaggggaagaggcuggagccuucaugggcgaguguuaaaaaggaucucauuagcuacggaggcggcuggcgauuucagggguccuggaacaccggagaggaagugcaagucauagcuguggagcccgguaaaaauccaaagaacguacagacgacacccggcacuuucaaaaccccugaaggggaggucggagccaucgcauuggacuuuaagccaggcacaucugguucgcccauugugaaucgggaagggaagaucguuggacuguacggcaacggcguggucaccacuagcgggaccuaugugucagccauugcucaggccaaagcaucccaagagggaccucucccggagaucgaagacgagguuuucaagaaacgcaaucugacaauaauggaucuucacccagguaguggcaagacgagaagguaccugcccgcuaucgugcgggaagccauuaaacgaaaguugagaacucuaauccuggcgccuacccgcgucguggccucugagauggcagaagcucucaaggggaugccaauuagguaucagacaaccgccguaaaaagcgagcauacuggacgugagaucguggacuuaaugugccacgcuacauuuaccaugcggcugcuuucccccguuagagucccuaacuacaauaugauaauuauggaugaagcacauuucacggacccggccucaaucgccgcuaggggcuauaucucuacucgcguggguaugggggaggcggcagccauuuuuaugacagcuacacccccaggaagcguggaagccuucccucagaguaacgcagucauccaggaugaggaacgagacauacccgagagauccuggaauagcggcuacgauuggauuaccgacuuuccaggcaagacuguaugguucgugccuucuaucaaaucagggaacgauauugccaauugucugcggaagaacggaaaaaggguuauccaacucucccgcaagacauucgacaccgaguaucagaagacuaagaacaaugauugggacuacguggucacuacggacauaagugaaaugggugcuaacuuucgugcggauagagugauugacccccggaggugcuugaagccaguuauccugaaagauggcccggagcgcgugauccucgccgggccuaugcccgucaccgcagcuagcgccgcacagcgaagaggacggauuggcaggaaucagaacaaggaaggugaccaauacguguauauggggcagccacugaauaacgaugaggaccacgcccauuggacagaggcuaaaaugcuucuagauaauaucaacacucccgaaggcauuauaccugcccuguucgagccagaacgcgagaagucggcggcaaucgacggagaauacagauugaggggcgaggcccggaagaccuuuguagaguuaaugcgucgcggggaucugcccguguggcucucuuauaaaguugcuuccgaaggauuccaguacagcgaccgaagauggugcuuugauggugagaggaauaaccagguccuggaagagaauauggacguggaaauuuggacaaaggagggcgagcggaagaaacuucgcccuagauggcuggaugccaggaccuauucagacccgcucgcuuugcgggaguucaaagaguuugcagccgggcgaagaagugugucuggagaccugauccuagaaaucggcaaacugccacaacaccucacucuucgcgcucagaacgcccuggauaauuuagucauguugcacaacuccgagcagggugggaaagcauacaggcaugcgauggaggaacugcccgacacgauugagacccucaugcugcuugcccugauagcuguucucacaggcggagugacuuuguucuuucugagcggcaagggguuaggaaagaccucaaucggucuacuguguguaacagccaguagcgcacuccuuuggauggcuuccguggaaccucacuggauugccgcaucuaucauucuggaguucuuuuugaugguccugcucauccccgaaccagaucggcagcguaccccucaagacaaucagcuggccuaugugguuauaggccuucucuucaugauccugacuguggcugcgaacgagaugggguugcuggagacaacgaaaaaggauuuaggaauuggcuacgucgccgcagaaaaccaucagcacgcuaccaugcuagacguagaucugcaccccgccagcgccuggacucucuacgcaguggcuacaaccguuaucaccccaaugaugagacauacaauugagaauacuacggccaacaucucccuuaccgcgauagcuaaucaagccgcaauucugauggguuuggacaaaggguggccuaucucaaagauggauauuggcgugccgcugcucgcccugggaugcuauucucaggucaacccccuuacauuaacugcugcagugcugaugcucgucgcccacuacgcgaucauaggcccaggguugcaggcuaaagccaccagggaagcacagaagcgcacagccgcuggaaucaugaagaauccuaccguggacggcauuguugccaucgaucuggaccccgugguauaugaugcaaaauuugagaagcaacuaggucagauuaugcugcucauccuuuguacaagucagauacuguugaugcggacgacaugggcucugugcgaaucgauuacccucgccacugggccacugaccacauuaugggagggaagcccuggcaaauucuggaacacuaccaucgcgguguccauggccaauaucuuccgagguucuuaccuugcaggcgcugggcuggccuuuucacucaugaaaagccuaggaggcgggagaaggggaacaggcgcacagggugagacgcugggggaaaaauggaagcgccaauugaaccagcuguccaagagugaguucaauaccuauaaacggucuggaauuauggaagucgacagaagcgaggcuaaggaaggccucaaacguggugagacuacaaagcaugccguuucaaggggcaccgccaaacuucggugguuuguggagcgcaaccuggucaagcccgaagggaaggugaucgacuugggauguggccgagggggaugguccuacuauugcgcgggccugaaaaagguaacugaggugaaagguuacacaaaagggggaccgggccacgaggaaccaauaccuauggcuaccuacggcuggaaucucguuaaauuacauagugggaaggauguguucuuuaugcccccagaaaaaugugacacgcugcuuugcgauauuggagagagcucucccaacccuaccaucgaggaagguagaacacugaggguccuaaagaugguggagccguggcuccggggcaaucaguucuguauuaagauccugaaccccuauaugccauccgucguggaaacuuuggagcgcaugcagagaaaacacgggggaaugcugguuaggaauccucucucacgaaacagcacccacgagauguacuggguaucgugcggcacagguaauauagugucugcagucaacaugacaagucggaugcuucugaaccguuuuaccauggcccauagaaagcccacauaugaacgcgacguggauuuaggggcuggaaccaggcacguugccguggagccugaagucgcaaaucuggacaucauuggccaacggaucgagaacauuaaaaaugaacauaaguccacuuggcacuacgaugaggacaacccauauaaaacgugggccuaccacggcagcuaugaggugaagcccucaggguccgcuucuagcaugguaaauggagugguuagauugcucacaaagccuugggaugucaucccaauggugacccagauugcgaugacugacaccacacccuucggucagcaacgcguguuuaaagaaaaggucgauacgaggaccccgcgagccaaacggggcacuacacagaucauggagguuaccgcaaaguggcuguggggguuccuaaguagaaacaaaaagccuaggauauguacucgcgaagaguuuacacguaaggugcgguccaaugcugccauuggagcaguauucguggacgaaaaccaguggaauagcgccaaagaggcugucgaggacgaaagauuuugggaucuugugcauagggagcgcgaacugcacaagcagggcaaaugcgcaaccugcguuuacaacaugauggguaagcgagagaaaaagcucggggaguucggaaaggcgaaaggcucucgggcaaucugguacauguggcugggcgccagauucuuggaguuugaggcucugggguucaugaaugaagaccauugguuuucaagggagaacagucucuccggaguggaaggugagggccuucacaagcugggguauaucuuacgcgauauuagcaaaauaccaggaggcaauauguacgccgacgauacagcagguugggacacuagagucaccgaggaugaccugcaaaacgaagcuaagaucacggauauuauggagcccgaacaugccuugcucgcuaccucuaucuucaaacugacauaucagaauaaggugguacggguucagaggccugccaaaaacgggacugugauggacgucauuucgcgucgagaucagcgcggaucaggccaagugggcaccuacgggcuaaacacauuuacuaauauggaggugcagcuuaucagacagauggaaagcgagggaauauuccugccauccgagcucgaaacccccaaccuggcagagcgggcguuggacugguuagaaaagcacggugccgagaggcugaagcgcauggcuaucaguggcgaugacugugucguuaaaccgauugacgauagauuugccacggcacucacagcucuuaaugacauggggaaggugcggaaagauaucccucagugggaacccucuaagggauggaacgacuggcaacagguaccauucugcagccaccauuuucaccagcugauuaugaaagauggcagggagaucguggucccuugucgaaaucaggacgagcuagugggucgugccagaguuucccaaggggcaggauggucacugcgcgaaaccgccugccucggcaagaguuaugcgcagauguggcaguugauguacuuccaucggagggaucugagacuugcugccaacgcaauauguucugccgugcccgucgacugggugccaacuagccgcacaaccugguccauucacgcucaccaucaauggaugacuaccgaggauaugcugucaguauggaaucggguuuggaucgaagagaaccccuggauggaagacaagacacacgugagcucuugggaggaggucccuuaucucggcaaaagggaagaucaguggugcggguccuuaaucggacugacggcccgagcaaccugggcuacuaauauucagguggccauaaaccagguuagacgguugaucgguaaugagaacuaccuggacuacaugacaaguaugaagagguuuaaaaaugaaagcgacucggagggcgcgcucugguga

SEQ ID NO: 13457 - RNA, 9879 nt, Artificial Sequence
  derived and/or modified CDS sequence (opt3) from DENV-1__KJ189362__SS-prME
agcgugaccaugcugcucaugcuucugccaacugcauuggcuuuccacuuaacuacgaggggcggggagccucauaugaucgucuccaagcaggaaaggggaaagucucugcuauuuaagaccucagccgguguuaacaugugcacucucauugccauggaccugggcgagcuuugugaagauacuaugaccuacaagugcccacggauaacagaggcggaaccggacgauguggacuguuggugcaaugcuaccgauacuuggguaaccuaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauugguggauagaggcugggguaauggguguggacucuucggcaaaggcagccuguuaacuugcgcuaaguuuaagugcguaaccaaacuggaagggaagauagugcaguacgagaaccucaaauauuccgucauugugacaguucacaccggagaccagcaucaaguggguaaugaaacuacggagcacggcacaaucgccaccauuacuccccaggcgccuaccucagaaauccagcuuacagauuacggggcccugaccuuggacuguaguccaaggacuggacuagacuucaacgagaugguccugcucacaaugaaggagaaaagcuggcuggugcauaagcagugguuucuugaucugccguugcccuggacgucuggcgcauccaccucacaagaaacuuggaaucggcaggaccuccugguaacauucaaaaccgcucacgccaagaagcaggagguuguggucuuagguagccaagaaggggcuaugcacacagcccugacuggcgcaaccgagauccagacgaguggaaccacaacuauuuuugccggccaucuaaaaugccgucucaagauggauaaacugacccuuaaggggaugucuuaugugauguguacaggauccuucaaauuggaaaaggaggucgcugagacucagcacgguaccgugcugguucaggugaaguacgaaggcacggacgcgccuugcaaaauaccauucagcacacaagaugagaaggggaugacccagaacggacgccucaucacugcaaaucccauuguaacagacaaagaaaagccugucaacaucgagaccgagccacccuuuggcgaaucguauauagugguuggugccggggagaaagcucugaaacuuucuugguucaagagaggcuccucaauuggaaaaauguuugaagccacugcaaggggcgcccggcgaauggcuauccugggggauaccgccugggacuucggaaguaucgguggcguguuuacaagcgucgggaaguuggugcaucagauuuucggaacggcauacggcguacucuuuuccggugugucuuggaccaugaaaaucgggauuggcauacuguuaacuuggcugggacuaaauagccgcucaacaagucucuccaugaccuguaucgcgguuggcauggucacacuguaccuuggggugauggugcaggcugauagcggaugcgucauuaacuggaagggcagagaguugaaaugugguucugggaucuucguuacuaacgaagugcacaccuggacggagcaauauaaguuucaggccgacucaccgaagaggcugagugcagccaucggaaaggcuugggaggaaggcgugugcgguauucggagcgccacacgccucgagaauauaauguggaagcagaucuccaacgaacugaaucauauuuuacuggagaacgauaugaaauucaccguagucgugggcgacgcaaaugggauccuugcucagggaaagaaaaugauuagaccucaacccauggaacacaaguacucuuggaaaucguggggcaaggccaagaucauaggggcggacauccagaacacuaccuuuauuaucgauggaccagacacaccugagugucccgauggccagagggccuggaauauuugggagguugaagacuaugguuucgggguguuuacuaccaacaucugguugaaacuccgugauagcuacacacagaugugcgaccaccggcugauguccgcugcaauaaaggauucaaaagccguccaugcugacaugggauauuggauugagagugaaaagaaugagacguggaaacuagcccgagcaucuuucaucgaagugaagaccuguacuuggccaaagagccacacacugugguccaacggcguucucgagucagagaugauuauccccaaaauauacgguggcccuaucagccaacauaauuauagaccaggguacuucacccagacugcgggaccguggcaccugggcaaacuugaauuggauuuugaccugugcgaggggacaaccgugguagucgaugaacacugcggaaacaggggccccucuuuacgcacgacuaccgugacagguaaaauuauccaugagugguguugccgguccuguacccucccuccacugagauucagaggggaagacggaugcugguacggcauggaaauucgccccgugaaggagaaagaagagaaucuuguccgaaguaugguuagcgccgguucuggcgaaguggauuccuuuucacuggggaucuuguguguaaguauaaugauugaggaggugaugcggagccguuggucgagaaagaugcucaugacuggaacacuggcugucuuccuacugcucaucaugggccagcugaccuggaacgaccuuaucagguugugcauuauggugggggccaaugcauccgaccgcaugggaaugggcacaacuuaucuggcuuuaauggccaccuuuaagaugcggccuauguucgcaguuggucuccuguuuagaaggcuuacgucucgagaagugcugcuacucacaaucgggcugagcuuggucgccucaguggagcugccaaacaguuuagaggaacucggagauggccuggcuaugggcauuaugaugcuuaaacuguugaccgaguuccaaccccaccagcucuggacuacccugcuaucccugacauuuguucgcacuacccuuucucucgacuacgcguggaagacgacagccauggcacugagcauaguguccuuguucccgcuguguuuaucaaccacuagccagaaaacaaccuggcucccuguccugcuugggaguuuuggaugcaagccacugacuauguucuugaucacagagaacaaaauuuggggucggaagucuuggccccucaaugagggcaucauggcuauugggaucguauccauacugcuaagcucgcugcuuaagaacgaugugccucucgccggaccccugaucgccggcgguauguugauugcuuguuauguuaucucagggucuagugcagacuuaucccuggaaaaagccgcggaggugagcugggaacaggaggcugaacauucuggagccagccacuccauucucgucgaggugcaagaugacggcaccaugaagaucaaagaugaggaaagagacgauacgcugacuauacuucugaaggcaaccuugcuagccguaucaggcguguacccaaugaguauuccugcuacacuguuugucugguauuucuggcagaaaaagaaacagaggagcgggguucucugggacacccccucuccaccggagguggaacgugcagugcuggauaauggaaucuaccgcauccuucagcgggguuuacugggcagaucccaagucggggugggaguuuuccaggacggcguauuucauacaauguggcacgugacuaggggugccguccucauguaucaggggaagcgauuggagccuucaugggcgagugugaagaaagaucugauuagcuacggaggcggcuggcgguuccagggguccuggaacaccggagaggaaguucaagugauagcugucgagcccgguaagaaucccaagaacgugcagacgacacccggcacuuuuaagaccccugaaggggagguaggagccaucgcacucgacuucaaaccaggcacaucugguucgcccauugucaaucgcgaagggaagaucgugggacuguacggcaacggcguugugaccacuagcgggaccuaugucucagccauugcucaggccaaggcaucccaagagggaccucuuccggagaucgaagacgagguguuuaaaaagagaaaucugacaauaauggauuugcacccagguaguggcaaaacgaggcgguaccuacccgcuaucguucgagaagccauuaagagaaaacugcgcacucucaucuuagcgccuaccaggguggucgccucugagauggcagaagcucugaaggggaugccaauucguuaucagacaaccgccgugaaaagcgagcauacuggacgggagaucguagaccuuaugugccacgcuacauucaccaugagacugcucucccccgugaggguuccuaacuacaauaugauaauuauggaugaagcacauuuuacggacccggccucaaucgccgcucgcggcuauaucucuacucgagucgguaugggggaggcggcagccauuuucaugacagcuacacccccaggaagcguggaagccuuuccucagaguaacgcagugauccaggaugaggaaagagacauacccgagcgguccuggaauagcggcuacgauuggauuaccgacuucccaggcaaaacugucugguuuguaccuucuaucaagucagggaacgauauugccaauuguuugaggaaaaacggaaagcgcgugauccaacugucccguaaaacauucgacaccgaguaucagaagacaaagaacaaugauugggacuacguugugacuacggacauaagugaaaugggugcuaacuucagagcggaucgggucauugaccccaggcgcugccucaaaccagugauccugaaggauggcccggagcgaguuauccuugccgggccuaugcccgugaccgcagcuagcgccgcacagagacggggaaggauuggccgcaaucagaacaaagaaggugaccaauacgucuauauggggcagccacuaaauaacgaugaggaccacgcccauuggacagaggcuaagaugcuguuggauaauaucaacacucccgaaggcauuauaccugccuuauuugagccagaaagagagaaaucggcggcaaucgacggagaauacaggcugcggggcgaggcccguaagaccuucguggagcucaugcgccgaggggaucugcccguauggcuuucuuauaagguggcuuccgaaggauuucaguacagcgacagaagguggugcuucgauggugagcggaauaaccagguucuggaagagaauauggacgucgaaauuuggacaaaagagggcgagcgcaagaaacucagaccuaggugguuggaugcccggaccuauucagacccgcuggcucuacgagaauuuaaggaguucgcagccgggagacgcagugugucuggagaccugauccucgaaaucggcaaacuuccacaacaccugacuuuaagggcucagaacgccuuggauaaucuggugaugcuccacaacuccgagcagggugggaaggcauaccggcaugcgauggaggaacugcccgacacgauugagacccuuaugcugcucgccuugauagcuguccugacaggcggaguuacuuuauuuuuccuaagcggcaaagggcugggaaagaccucaaucggucuccuuugugugacagccaguagcguacuguuguggauggcauccguggaaccucacuggauugcugccucuaucauucuggaguuuuuccucaugguccugcuuauccccgaaccagaucgucagagaaccccucaagacaaucagcucgcauaugugguuauaggccuguuguuuaugauccugacuguggccgcuaacgagaugggguuacuagagacaacgaagaaagaucugggaauuggcuacgucgcggccgaaaaccaucagcacgcaaccaugcucgacguagaucuucaccccgcuagcgccuggacucuguacgccguggcaacaaccguuaucaccccaaugaugaggcauacaauugagaauacuacggcuaacaucuccuugaccgccauagcgaaucaagcugccauucugaugggucucgacaagggguggccuaucucaaaaauggauauuggcgugccgcugcuugcauuaggaugcuauucucaggucaacccccugacacucacugccgcuguguugaugcuggucgcacacuacgccaucauaggcccagggcuacaggcgaaggcuacccgcgaagcccagaaacggacagcagccggaaucaugaagaauccuaccguggacggcauuguugcuaucgaucuggaccccgugguauaugaugccaaguucgagaaacaacucggucagauuaugcuucugaucuuguguacaagucagauacugcucaugcgaacgacaugggcacugugcgaaucgauuaccuuagcuacugggccacuuaccacacugugggagggaagcccuggcaaguuuuggaacacuaccaucgccguguccauggcgaauaucuucagagguucuuaccucgccggcgcagggcuagcuuucucacugaugaaguccuugggaggcgggaggcgcggaacaggcgcccagggugagacgcugggggaaaaguggaaacggcaacucaaccagcuuagcaagagugaguuuaauaccuauaagagaucuggaauuauggaagucgaccguagcgaggcaaaagaaggccugaagaggggugagacuacaaaacaugcuguuucacggggcaccgccaaguugcgcugguucguggagcgaaaccuggucaaacccgaagggaaggugaucgaccucggauguggcagagggggaugguccuacuauugcgccggcuuaaagaaaguaacugaggugaaggguuacacaaaagggggaccgggccacgaggaaccaauaccuauggcgaccuacggcuggaaucugguuaaacuucauagugggaaagauguguuuuucaugcccccagaaaagugugacacgcugcuaugcgauauuggagagagcucucccaacccuaccaucgaggaagguaggacacuccggguccugaaaaugguggagccgugguugcgcggcaaucaguuuuguauuaagauccugaaccccuauaugccauccgucguggaaacucucgagagaaugcagaggaagcacgggggaaugcuuguucgaaauccucugucacggaacagcacccacgagauguacuggguaucgugcggcacagguaauauagugucugcugucaacaugacaagucguauguuacugaacagauucaccauggcacaucgcaaacccacauaugaaagggacguggauuugggggccggaacccggcacguugcuguggagccugaagucgccaaucucgacaucauuggccaaagaaucgagaacauuaagaaugaacauaaauccacuuggcacuacgaugaggacaacccauauaagacgugggcauaccacggcagcuaugaggugaaacccucaggguccgccucuagcaugguaaauggagugguucgccugcuaacaaagccuugggaugucaucccaauggugacccagauugcuaugacugacaccacacccuuuggucagcaaaggguguucaaggaaaaagucgauacgcgaaccccgcgggcgaagagaggcacuacacagaucauggagguuaccgccaaauggcuuuggggguuucugaguaggaacaagaaaccucgcauauguacucgugaagaguucacacggaaggugagauccaaugcagcuauuggagccguauuuguggacgaaaaccaguggaauagcgcaaaggaggccgucgaggacgaaagguucugggaucucgugcaucgcgagcgagaacugcacaaacagggcaagugcgcuaccugcguuuacaacaugauggguaaacgggagaagaaauugggggaauuuggaaaggccaagggcucuagagcgaucugguacauguggcugggcgcaagguuccucgaguucgaggcccuuggguuuaugaaugaagaccauugguucucacgcgagaacagucuguccggaguggaaggugagggcuuacacaaacugggguauaucuugagagauauuagcaagauaccaggaggcaauauguacgcugacgauacagccgguugggacacucgggucaccgaggaugaccuccaaaacgaagcaaaaaucacggauauuauggagcccgaacaugcucugcuagccaccucuaucuuuaaacuuacauaucagaauaaagugguaaggguucagcguccugcuaagaacgggacugugauggacgucauuucgcgacgcgaucagagaggaucaggccaagugggcaccuacgggcugaacacauucacuaauauggaggugcagcucauccggcagauggaaagcgagggaauauuucugccauccgaguuggaaacccccaacuuagccgagagggcacuggacuggcucgaaaaacacggugcggagcgccuuaagagaauggccaucaguggcgaugacugugucguuaagccgauugacgaucgguucgcuacggcccugacagcacuaaaugacauggggaaagugaggaaggauaucccucagugggaacccucuaaaggauggaacgacuggcaacagguaccauuuugcagccaccauuuccaccagcugauuaugaaggauggccgagagaucguggucccuugucguaaucaggacgagcucguggguagagcucgcguuucccaaggggccggauggucauugcgggaaaccgcaugccugggcaaaaguuaugcccagauguggcagcuuauguacuuucauaggagagaucugcgccucgcggcuaacgccauauguucugcagugcccgucgacugggugccaacuagccggacaaccugguccauucacgcccaccaucaauggaugacuaccgaggauauguuaucaguauggaauaggguuuggaucgaagagaaccccuggauggaaaauaagacacacgugagcucuugggaggaggucccuuaucugggcaagcgagaagaccaguggugcggguccuugaucggacugacggcuagagccaccugggcaacuaacauucagguggcuauaaaucagguucggaggcucaucgguaacgagaauuaccuugauuacaugacaaguaugaaacgcuucaagaacgaaagcgacucggagggcgcccugugguga

SEQ ID NO: 13458 - RNA, 9879 nt, Artificial Sequence
  derived and/or modified CDS sequence (opt3) from DENV-1__KJ189363__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaugguuauugcauuuuuccuggcccaugcuaucggcaccucgauuacacagaagggcaucauauuuauccucuuaaugcuggugaccccaucaauggccaugcgcugcgucgggauuggaaacagagacuucguggagggucuuagcggcgcgacguggguagauguuguguuggaacacgggaguugugucacuacaauggcaaagaauaaacccacccuggacaucgagcuacucaagacugaagugacaaacccugccgugcugaggaaacuuugcauugaggcuaagaucuccaauaccacgaccgauucucgguguccaacacaaggagaagccacucuggucgaggagcaggacgcaaacuuuguuugccgccgaaccuucguggauagaggcugggguaauggguguggauuguuuggcaaaggcagccuccugacaugcgcuaaguucaagugcguaacuaaauuagaagggaagauagugcaguacgagaaccugaaauauuccgucauugugaccguucacacaggagaccagcaucaaguggguaaugaaaccacugagcacggcacgaucgccacaauuaccccccaggcgccuacuucagaaauccagcucaccgauuacggggcccuuacacuggacuguaguccaaggaccggauuggacuuuaacgagaugguccuacugacuaugaaggagaaaagcuggcucgugcauaagcagugguuccuggaucuuccgcugcccuggacaucuggcgcauccacgucacaagaaaccuggaaucggcaggacuugcucguaacuuuuaaaacagcucacgccaagaagcaggagguugugguccuggguagccaagaaggggcuaugcacaccgccuuaacaggcgcaacugagauccagaccaguggaacgaccacaauuuucgccggccaucugaaaugccgucuaaagauggauaaacucacucugaaggggaugucuuaugugauguguaccggauccuucaaacuugaaaaggaggucgcugagacacagcacgguacuguguugguucaggugaaguacgaaggcaccgacgcgccuugcaaaauaccauuuagcacgcaagaugagaaggggguaacacagaacggacgccugaucaccgcaaaucccauugucacugacaaagaaaagccugugaacaucgagacagagccacccuucggcgaaucguauauaguugugggugccggggagaaagcucucaagcugucuugguuuaagagaggcuccucaauuggaaaaauguucgaagccaccgcaaggggcgcccggcgaauggcuauccuuggggauacugccugggacuuuggaaguaucgguggcgucuucaccagcguggggaagcugguacaucagauuuuuggaacagcauacggcguguuguucuccgguguuucuuggacgaugaaaaucgggauuggcauacuccugaccugguuaggacugaauagccgcucaacuagucuauccaugacauguaucgcggucggcauggugacccucuaccugggggugaugguccaggcugauagcggaugcguuauuaacuggaagggcagagagcuuaaaugugguucugggaucuuugugacaaacgaagugcacacuuggaccgagcaauauaaguuccaggccgacucaccgaagagguugagugcagccaucggaaaagcuugggaggaaggcguaugcgguauucggagcgccacgcgccuggagaauauaauguggaagcagaucuccaacgaacucaaucauauucuguuagagaacgauaugaaauuuacagucgugguuggcgacgcaaaugggauccuggcucagggaaagaaaaugauuagaccucaacccauggaacacaaguacucuuggaaaucguggggcaaggccaagaucauaggggcggacauccagaacaccacuuucauuaucgauggaccagacaccccugagugucccgauggccagagggccuggaauauuugggagguggaagacuaugguuuuggggucuucacaacuaacaucuggcuuaaauugcgugauagcuacacccagaugugcgaccaccggcucauguccgcugcaauaaaggauucaaaagccgugcaugcugacaugggauauuggauugagagugaaaagaaugagacauggaaacuggcccgagcaucuuucaucgaaguuaagacguguaccuggccaaagagccacacucuaugguccaacggcgugcuggagucagagaugauuauccccaaaauauacgguggcccuaucagccaacauaauuauagaccaggguacuuuacacagaccgcgggaccguggcaccucggcaagcuggaacuugauuucgacuugugcgaggggacuacaguagucguggaugaacacugcggaaacaggggccccucucugcgcaccacgacugugaccgguaaaauuauccaugagugguguugccgguccuguacauuaccuccacucagauuuaggggggaggacggaugcugguacggcauggaaauucgccccgucaaggagaaagaagagaaucugguucgaaguauggugagcgccgguucuggcgaaguagauuccuucucacuugggauccugugugugaguauaaugauugaggaggucaugcggagccguuggucgagaaagauguugaugaccggaacucucgcuguguuucugcuacugaucaugggccagcucacauggaacgaccugaucaggcuuugcauuaugguuggggccaaugcauccgaccgcaugggaaugggcaccacauauuuggcucugauggccacuuucaagaugcggccuauguuugcaguggguuuacucuucagaaggcugaccucucgagaaguccuucugcuaacgaucgggcucagccugguggccucaguugaguugccaaacagucuggaagaguuaggagauggccucgcuaugggcauuaugaugcugaaacuucugacagaauuucaaccccaccaguuguggaccacucuccugucccuaaccuucgugaagacaacucugucucuugacuacgcguggaaaaccacggccauggcacucagcauagucucccuguuuccguugugucugucaacaaccagccagaagacuacaugguuaccuguacuccuggggaguuucggaugcaaaccacuuaccauguuucugaucacugagaacaagauuuggggucgcaagucuuggcccuugaaugagggcaucauggcuauugggaucguguccauacuccugagcucgcuacugaaaaacgauguuccucuugccggaccccucaucgccggcgguaugcugauugcuuguuaugugaucucagggucuagugcagacuuguccuuagaaaaggccgcggaggucagcugggaacaggaggcugaacauucuggagccagccacuccauucugguggagguacaagaugacggcacaaugaaaaucaaggaugaggaacgggacgauacccucacgauacugcuuaaagcaacucuguuggccgugucaggcgucuacccaaugaguauuccugcuacccuauucguuugguauuucuggcagaagaaaaagcagagaagcggggugcugugggacacacccucuccaccggagguggaaagggcaguccucgauaauggaaucuaccguauccugcagcgcggucuuuuaggccggucccaaguggggguuggaguauuucaggacggcguguuccauaccauguggcacgucacaagaggugccgugcugauguaucaggggaagaggcucgagccuucaugggcgaguguuaaaaaggauuugauuagcuacggaggcggcuggcgauuucagggguccuggaacacuggagaggaagugcaagucauagcuguggagcccgguaaaaauccaaagaacguacagaccacgcccggcacauucaaaacuccugaaggggaggucggagccaucgcacuggacuuuaagccaggcaccucugguucgcccauugugaaucgggaagggaagaucguuggacucuacggcaacggcguggucacaaccagcgggacuuaugugucagccauugcucaggccaaagcaucccaagagggaccucugccggagaucgaagacgagguuuucaagaaacgcaaucuuaccauaauggaucugcacccagguaguggcaagacaagaagguacuugcccgcuaucgugcgggaagccauuaaacgaaagcuaagaacgcugauccucgcgccuacucgcgucguggccucugagauggcagaagcuuuaaaggggaugccaauuagguaucagaccacagccguaaaaagcgagcauaccggacgugagaucguggaccugaugugccacgcuacuuuuacaaugcggcuucugucccccguuagagucccuaacuacaauaugauaauuauggaugaagcacauuucaccgacccggccucaaucgccgcuaggggcuauaucucuacgcgcguggguaugggggaggcggcagccauuuuuaugacugcuacacccccaggaagcguggaagccuucccucagaguaacgcagucauccaggaugaggaacgagacauacccgagagauccuggaauagcggcuacgauuggauuaccgacuuuccaggcaagaccguaugguucgugccuucuaucaaaucagggaacgauauugccaauugucuccggaagaacggaaaaaggguuauccaauugucccgcaagacuuucgacacagaguaucagaagaccaaaaacaaugauugggacuacguggucacaacugacauaagugaaaugggugcuaacuuucgugcggauagagugauugacccccggaggugccugaagccaguuauccucaaagauggcccggagcgcgugauccuggccgggccuaugcccgucacggcagcuagcgccgcacagcgaagaggacggauuggcaggaaucagaacaaggaaggugaccaauacguguauauggggcagccacuuaauaacgaugaggaccacgcccauuggaccgaggcuaaaaugcuacuggauaauaucaacacacccgaaggcauuauaccugccuuguucgagccagaacgcgagaagucggcggcaaucgacggagaauacagauuaaggggcgaggcccggaagacuuuuguagagcugaugcgucgcggggaucuccccguguggcugucuuauaaaguugcuuccgaaggauuccaguacagcgaccgaagauggugcuuugauggugagaggaauaaccagguccuugaagagaauauggacguggaaauuuggaccaaggagggcgagcggaaaaagcugcgcccuagauggcucgaugccaggacauauucagacccguuggcucugcgggaauucaaagaguuugcagccgggcgaagaagugugucuggagaccuaauccuggaaaucggcaagcucccacaacaccuuacccugcgcgcucagaacgccuuagauaauuuggucaugcugcacaacuccgagcagggugggaaagcauacaggcaugcgauggaagagcuccccgacacuauugagacgcugaugcuucuggcccucauagcuguuuugaccggcggagugacacuguucuuuuuaagcggcaaggggcuaggaaagacuucaaucggucugcucuguguaaccgccaguagcgcacuucuguggauggcuuccguggaaccucacuggauugccgcaucuaucauuuuggaguucuuucugaugguccuccugauccccgaaccagaucggcagcguacaccucaagacaaucagcuugccuaugugguuauaggccuccuguucaugaucuugaccguggcugcgaacgagauggggcuguuagagacuacaaaaaaggaucuaggaauuggcuacgucgccgcagaaaaccaucagcacgcuacgaugcuggacguagaucuccaccccgccagcgccuggacccuuuacgcaguggcuacuacaguuaucaccccaaugaugagacauaccauugagaauacaacugccaacaucucccugacggcgauagcuaaucaagccgcaauuuugaugggucuggacaaaggguggccuaucucaaagauggauauuggcgugccgcuccuggcccuuggaugcuauucucaggucaaccccuuaacccugacagcugcagugcucauguuggucgcccacuacgcgaucauaggcccagggcugcaggcuaaagccacuagggaagcacagaagcgcaccgccgcuggaaucaugaagaauccuacaguggacggcauuguugccaucgaucuagaccccgugguauaugaugcaaaauuugagaagcaacugggucagauuaugcuccuuauccuguguaccagucagauauugcugaugcggacuacgugggcucucugcgaaucgauuacacuggccaccgggccauuaacuacccuuugggagggaagcccuggcaaauucuggaacacaacuaucgcgguguccauggccaauaucuuccgagguucuuaccuggcaggcgcugggcucgccuuuucacuaaugaagagccugggaggcgggagaaggggaaccggcgcacagggugagacauugggggaaaaauggaagcgccaacugaaccagcucuccaagagugaguucaauacguauaaacggucuggaauuauggaagucgacagaagcgaggcuaaggaaggccuuaaacguggugagaccacuaagcaugccguuucaaggggcacagccaaacugcggugguuuguggagcgcaacuuggucaagcccgaagggaaggugaucgaccugggauguggccgagggggaugguccuacuauugcgcgggccucaaaaagguaaccgaggugaaagguuacacuaaggggggaccgggccacgaagagccaauaccuauggcuacauacggcuggaauuuaguuaaacugcauagugggaaggauguguucuuuaugcccccagaaaaaugugacacccuucugugcgauauuggagagagcucucccaacccuacgaucgaggaagguagaacccuaaggguccucaagaugguggagccguggcugcggggcaaucaguucuguauuaagaucuugaaccccuauaugccauccgucguggaaacacuggagcgcaugcagagaaaacacgggggaaugcucguuaggaauccucuuucacgaaacagcacucacgagauguacuggguaucgugcggcaccgguaauauagugucugcagucaacaugacaagucggaugcuguuaaaccguuuuacuauggcccauagaaagcccaccuaugaacgcgacguggaucugggggcuggaacaaggcacguugccguggagccugaagucgcaaauuuggacaucauuggccaacggaucgagaacauuaaaaaugaacauaaguccaccuggcacuacgaugaggacaacccauauaaaacuugggccuaccacggcagcuaugaggugaagcccucaggguccgcuucuagcaugguaaauggagugguuagacuccugacgaagccuugggaugucaucccaauggugacacagauugcgaugaccgacacuacccccuucggucagcaacgcguguuuaaagaaaaggucgauacaaggacgccgcgagccaaacggggcaccacucagaucauggagguuacagcaaaguggcuauggggguuccuuaguagaaacaaaaagccuaggauauguacccgcgaagaguuuacucguaaggugcgguccaaugcugccauuggagcaguauucguggacgaaaaccaguggaauagcgccaaagaggcugucgaggacgaaagauuuugggaucuggugcauagggagcgcgaacuccacaagcagggcaaaugcgccacaugcguuuacaacaugauggguaagcgagagaaaaagcugggggaauucggaaaggcgaaaggcucucgggcaaucugguacaugugguugggcgccagauuccuggaguuugaggcucucggguucaugaaugaagaccauugguuuucaagggagaacagucuuuccggaguggaaggugagggccugcacaaguuaggguauauccugcgcgauauuagcaaaauaccaggaggcaauauguacgccgacgauaccgcagguugggacacaagagucacugaggaugacuugcaaaacgaagcuaagaucaccgauauuauggagcccgaacaugcccuccuggcuacgucuaucuucaaacuaaccuaucagaauaaggugguacggguucagaggccugccaaaaacgggacagugauggacgucauuucgcgucgagaucagcgcggaucaggccaagugggcacuuacgggcuuaacaccuuuacaaauauggaggugcagcugaucagacagauggaaagcgagggaauauuccucccauccgagcuggaaacucccaacuuggcagagcgggcguuagacuggcuggaaaagcacggugccgagaggcucaagcgcauggcuaucaguggcgaugacugugucguuaaaccgauugacgauagauuugccaccgcacuuacggcucugaaugacauggggaaggugcggaaagauaucccucagugggaacccucuaagggauggaacgacuggcaacagguaccauucugcagccaccauuuucaccagcuaauuaugaaagauggcagggagaucguggucccuugucgaaaucaggacgagcuggugggucgugccagaguuucccaaggggcaggauggucacuccgcgaaacagccugcuugggcaagaguuaugcgcagauguggcagcugauguacuuccaucggagggaucuuagacuggcugccaacgcaauauguucugccgugcccgucgacugggugccaaccagccgcacuacaugguccauucacgcucaccaucaauggaugaccacugaggauaugcucucaguauggaaucggguuuggaucgaagagaaccccuggauggaaaauaagacccacgugagcucuugggaggaggucccuuauuuaggcaaaagggaagaccaguggugcgggucccugaucggauugacagcccgagcaacgugggcuaccaacauucagguggccauaaaucagguuagacggcugaucgguaacgagaauuaccucgauuacaugacuaguaugaagagguuuaaaaacgaaagcgacucggagggcgcgcuuugguga

SEQ ID NO: 13459 - RNA, 9879 nt, Artificial Sequence
  derived and/or modified CDS sequence (opt3) from DENV-1__KJ189364__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggaugacccagaacggacgccugaucacugcaaaucccauuguaacagacaaagaaaagccugucaacaucgagaccgagccacccuucggcgaaucguauauagugguuggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcguguucacaagcgucgggaagcuggugcaucagauuuuuggaacggcauacggcguauuguucuccggugugucuuggaccaugaaaaucgggauuggcauacuccugacuugguuaggacugaauagccgcucaacaagucuauccaugaccuguaucgcgguuggcauggucacacucuaccugggggugauggugcaggcugauagcggaugcgucauuaacuggaagggcagagagcuuaaaugugguucugggaucuuuguuacuaacgaagugcacaccuggacggagcaauauaaguuccaggccgacucaccgaagagguugagugcagccaucggaaaagcuugggaggaaggcgugugcgguauucggagcgccacacgccuggagaauauaauguggaagcagaucuccaacgaacucaaucauauucuguuagagaacgauaugaaauuuaccguagucgugggcgacgcaaaugggauccuggcucagggaaagaaaaugauuagaccucaacccauggaacacaaguacucuuggaaaucguggggcaaggccaagaucauaggggcggacauccagaacacuaccuucauuaucgauggaccagacacaccugagugucccgauggccagagggccuggaauauuugggagguugaagacuaugguuuugggguguucacuaccaacaucuggcuuaaauugcgugauagcuacacacagaugugcgaccaccggcucauguccgcugcaauaaaggauucaaaagccguccaugcugacaugggauauuggauugagagugaaaagaaugagacguggaaacuggcccgagcaucuuucaucgaagugaagaccuguacuuggccaaagagccacacacuaugguccaacggcguucuggagucagagaugauuauccccaaaauauacgguggcccuaucagccaacauaauuauagaccaggguacuuuacccagacugcgggaccguggcaccucggcaagcuggaacuugauuucgacuugugcgaggggacaaccgugguagucgaugaacacugcggaaacaggggccccucucugcgcacgacuaccgugacagguaaaauuauccaugagugguguugccgguccuguaccuuaccuccacucagauuuaggggggaggacggaugcugguacggcauggaaauucgccccgugaaggagaaagaagagaaucugguccgaaguaugguuagcgccgguucuggcgaaguggauuccuucucacuugggauccuguguguaaguauaaugauugaggaggugaugcggagccguuggucgagaaagauguugaugacuggaacacucgcugucuuucugcuacugaucaugggccagcucaccuggaacgaccugaucaggcuuugcauuauggugggggccaaugcauccgaccgcaugggaaugggcacaacuuauuuggcucugauggccaccuucaagaugcggccuauguuugcaguugguuuacucuucagaaggcugacgucucgagaagugcuucugcuaacaaucgggcucagccuggucgccucaguggaguugccaaacagucuggaagaguuaggagauggccucgcuaugggcauuaugaugcugaaacuucugaccgaauuucaaccccaccaguuguggacuacccuccugucccuaacauucguucgcacuacccugucucuugacuacgcguggaagacgacagccauggcacucagcauagugucccuguuuccguugugucugucaaccacuagccagaaaacaaccugguuaccuguccuccuggggaguuucggaugcaagccacuuacuauguuucugaucacagagaacaaaauuuggggucggaagucuuggcccuugaaugagggcaucauggcuauugggaucguauccauacuccugagcucgcuacugaagaacgaugugccucuugccggaccccucaucgccggcgguaugcugauugcuuguuauguuaucucagggucuagugcagacuuguccuuagaaaaagccgcggaggugagcugggaacaggaggcugaacauucuggagccagccacuccauucuggucgaggugcaagaugacggcaccaugaagaucaaagaugaggaaagagacgauacgcucacuauacugcuuaaggcaacccuguuggccguaucaggcguguacccaaugaguauuccugcuacacuauucgucugguauuucuggcagaaaaagaaacagaggagcgggguucugugggacacccccucuccaccggagguggaacgugcagugcucgauaauggaaucuaccgcauccugcagcggggucuuuuaggcagaucccaagucggggugggaguuuuucaggacggcguauuccauacaauguggcacgugacuaggggugccguccugauguaucaggggaagcgacucgagccuucaugggcgagugugaagaaagauuugauuagcuacggaggcggcuggcgguuucagggguccuggaacaccggagaggaaguucaagugauagcugucgagcccgguaagaauccaaaaaacgugcagacgacacccggcacuuucaagaccccugaaggggagguaggagccaucgcacuggacuuuaaaccaggcacaucugguucgcccauugucaaucgcgaagggaagaucgugggacucuacggcaacggcguugugaccacuagcgggaccuaugucucagccauugcucaggccaaggcaucccaagagggaccucugccggagaucgaagacgagguguucaaaaagagaaaucuuacaauaauggaucugcacccagguaguggcaaaacgaggcgguacuugcccgcuaucguucgagaagccauuaagagaaaacuacgcacucugauccucgcgccuaccaggguggucgccucugagauggcagaagcuuuaaaggggaugccaauucguuaucagacaaccgccgugaagagcgagcauacuggacgggagaucguagaccugaugugccacgcuacauuuaccaugagacuucugucccccgugaggguuccuaacuacaauaugauaauuauggaugaagcacauuucacggacccggccucaaucgccgcucgcggcuauaucucuacucgagucgguaugggggaggcggcagccauuuuuaugacagcuacccccccaggaagcguggaagccuucccucagaguaacgcagugauccaggaugaggaaagagacauacccgagcgguccuggaauagcggcuacgauuggauuaccgacuuuccaggcaaaacugucugguucguaccuucuaucaagucagggaacgauauugccaauugucucaggaaaaacggaaagcgcgugauccaauugucccguaaaacauucgacaccgaguaucagaagacaaagaacaaugauugggacuacguugugacuacggacauaagugaaaugggugcuaacuuuagagcggaucgggucauugaccccaggcgcugccugaaaccagugauccucaaggauggcccggagcgaguuauccuggccgggccuaugcccgugaccgcagcuagcgccgcacagagacggggaaggauuggccgcaaucagaacaaagaaggugaccaauacgucuauauggggcagccacuuaauaacgaugaggaccacgcccauuggacagaggcuaagaugcuacuggauaauaucaacacucccgaaggcauuauaccugccuuguucgagccagaaagagagaaaucggcggcaaucgacggagaauacagguuacggggcgaggcccguaagaccuuuguggagcugaugcgccgaggggaucuccccguauggcugucuuauaagguggcuuccgaaggauuccaguacagcgacagaagguggugcuuugauggugagcggaauaaccagguucuugaagagaauauggacgucgaaauuuggacaaaagagggcgagcgcaagaaacugagaccuagguggcucgaugcccggaccuauucagacccguuggcucugcgagaauucaaggaguuugcagccgggagacgcagugugucuggagaccuaauccuggaaaucggcaaacucccacaacaccuuacucugagggcucagaacgccuuagauaauuuggugaugcugcacaacuccgagcagggugggaaggcauaccggcaugcgauggaagagcuccccgacacgauugagacccugaugcuucuggcccucauagcugucuugacaggcggaguuacucuguucuuuuuaagcggcaaagggcuaggaaagaccucaaucggucugcucugugugacagccaguagcgcacuucuguggauggcuuccguagaaccucacuggauugccgcaucuaucauuuuggaguucuuucugauggugcuccugauccccgaaccagaucgucagagaaccccucaagacaaucagcuugccuaugucgugauaggccuccuguucaugaucuugacuguugcugcgaacgagauggggcuguuagagacaacgaagaaagaucuaggaauuggcuacguggccgcagaaaaccaucagcacgcuaccaugcuggacgucgaucuccaccccgccagcgccuggacucuuuacgcaguagcuacaaccgugaucaccccaaugaugaggcauacaauugagaauacuacggccaacaucucccugaccgcgauagcuaaucaagccgcaauuuugaugggucuggacaagggguggccuaucucaaaaauggauauuggcguuccgcuccuggcccuuggaugcuauucucaggugaaccccuuaacacugacugcugcaguccucauguugguggcccacuacgcgaucauaggcccagggcugcaggcuaaggccacccgcgaagcacagaaacggacagccgcuggaaucaugaagaauccuaccgucgacggcauuguggccaucgaucuagaccccguuguguaugaugcaaaguuugagaaacaacugggucagauuaugcuccuuauccuguguacuagucagauauugcugaugcgaacgacaugggcucucugcgaaucgauuacccuggccacugggccauuaaccacacuuugggagggaagcccuggcaaguucuggaacacuaccaucgcgguauccauggccaauaucuucagagguucuuaccuggcaggcgcugggcucgccuuuucacuaaugaaaagccugggaggcgggaggcgcggaacaggcgcacagggugagacguugggggaaaaguggaaacggcaacugaaccagcucuccaagagugaguucaauaccuauaagagaucuggaauuauggaaguggaccguagcgaggcuaaagaaggccuuaagaggggugagacuacaaaacaugccgucucacggggcaccgccaagcugcgcugguuuguugagcgaaacuuggugaaacccgaagggaaggucaucgaccugggauguggcagagggggaugguccuacuauugcgcgggccucaagaaagugacugagguaaaggguuacacaaaagggggaccgggccacgaagagccaauaccuauggcuaccuacggcuggaauuuagugaagcugcauagugggaaagauguuuucuuuaugcccccagaaaagugugacacgcuucugugcgauauuggagagagcucucccaacccuaccaucgaggaagguaggacacuacgggugcucaaaauggucgagccguggcugcgcggcaaucaguucuguauuaagaucuugaaccccuauaugccauccguggucgaaacucuggagagaaugcagaggaagcacgggggaaugcucgugcgaaauccucuuucacggaacagcacccacgagauguacuggguuucgugcggcacagguaauauaguaucugcagugaacaugacuagucguaugcuguuaaacagauuuaccauggcccaucgcaaacccacauaugaaagggacgucgaucugggggcuggaacccggcacguggccguugagccugaaguggcaaauuuggacaucauuggccaaagaaucgagaacauuaagaaugaacauaaauccacuuggcacuacgaugaggacaacccauauaagacgugggccuaccacggcagcuaugaggucaaacccucaggguccgcuucuagcauggugaauggaguagugcgccuccugacaaagccuugggauguuaucccaauggucacccagauugcgaugacugacaccacacccuucggucagcaaaggguguuuaaggaaaaaguggauacgcgaaccccgcgggccaagagaggcacuacacagaucauggaggucaccgcaaaauggcuauggaguuuccuuuccaggaacaagaaaccucgcauauguacucgugaagaguuuacacggaagguuagaagcaaugcugccauuggggcaguguucguagacgaaaaccaguggaauucugccaaggaggcuguggaggacgaaagguuuugggaucugguccaucgcgagcgagaacuccacaaacagggaaagugcgccaccugcguguacaacaugaugggcaaacgggagaagaaacugggugaauucgggaaggcgaagggaucaagagcaaucugguacaugugguugggcgccagguuccuggaguuugaggcucucggcuucaugaaugaagaccauugguuuagucgcgagaacucccuuagcgggguugaaggagagggucugcacaaauuaggcuauauccugagagauauuucuaagauaccagggggaaauauguacgccgacgauacagcaggcugggacacucgggugaccgaggaugacuugcaaaacgaagcuaaaaucacggauauuauggagcccgaacaugcccuccuggcuaccucgaucuucaagcuaacauaucagaauaaagucgugaggguacagcguccugccaagaacgguacuguuauggacgugauuucacgacgcgaucagagagggagcggacaagucggcaccuacggccuuaacacauuuacuaauauggaggugcagcugauccggcagauggaauccgaggggauauuccucccaagugagcuggaaacccccaacuuggcagagagggcguuagacuggcuggaaaaacacggagccgagcgccucaagagaauggcuaucucuggugaugacuguguggucaagccgauugacgaucgguuugccacggcacuuacagcucugaaugacaugggcaaaguuaggaaggauaucccucagugggaacccagcaaaggguggaacgacuggcaacaggugccauucugcucccaccauuuucaccagcuaauuaugaaggauggacgagagaucguagugccuugucguaaucaggacgagcuggucggcagagcccgcgugucacaaggugcaggguggagucuccgggaaaccgccugcuugggaaaaucuuaugcgcagauguggcagcugauguacuuccauaggagagaucuucgccuggcugccaacgcaauauguagcgccguucccguggacugggucccaacuucccggacaaccuggucaauucacgcucaccaucaauggaugacuaccgaggauaugcucagcguguggaauaggguauggaucgaagagaaccccuggauggaaaauaagacacacguuucuuccugggaggaggugccuuauuuaggcaagcgagaagaccaguggugcggcagucugaucggguugacggccagagcaaccugggcuacuaacauucaggucgccauaaaucaggugcggaggcugaucggaaacgagaauuaccucgauuacaugacaagcaugaaacgcuuuaagaacgaaucggacuccgagggugcgcuuugguga

SEQ ID NO: 13460 - RNA, 9879 nt, Artificial Sequence
  derived and/or modified CDS sequence (opt3) from DENV-1__KJ189365__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagauuuuuggaacggcauacggcguguuguucuccgguguuucuuggaccaugaaaaucgggauuggcauacuccugacuugguuaggacugaauagccgcucaacaagucuauccaugaccuguaucgucgugggcauggugacacucuaccugggggucaugguucaggcggauagcggaugcgugauuaacuggaagggcagagagcuuaaaugugguucugggaucuuugugacuaacgaaguacacaccuggacggagcaauauaaguuccaggcugacucaccgaagagguugagugccgcaaucggaaaagccugggaggaaggcgucugcgguauucggagcgcuacacgccuggagaauauaauguggaagcagaucuccaacgaacucaaucauauucuguuagagaacgauaugaaauuuaccgugguugugggcgacgccaaugggauccuggcacagggaaagaaaaugauuagaccucaacccauggaacacaaguacucuuggaaaucguggggcaaggcuaagaucauaggggccgacauccagaacacuaccuucauuaucgauggaccagacacaccugagugucccgauggccagagggcguggaauauuugggaggucgaagacuaugguuuugggguguucacuaccaacaucuggcuuaaauugcgugauagcuacacacagaugugcgaccaccggcucauguccgccgcuauaaaggauucaaaagcaguucaugccgacaugggauauuggauugagagugaaaagaaugagacguggaaacuggcucgagccucuuucaucgaagugaagaccuguacuuggccaaagagccacacacuaugguccaacggcguacuggagucagagaugauuauccccaaaauauacgguggcccuaucagccaacauaauuauagaccaggguacuuuacccagacugcaggaccguggcaccucggcaagcuggaacuugauuucgacuugugcgaggggacaaccgucgugguggaugaacacugcggaaacaggggccccucucugcgcacgacuaccgucacagguaaaauuauccaugagugguguugccgguccuguaccuuaccuccacucagauuuaggggggaggacggaugcugguacggcauggaaauucgccccguuaaggagaaagaagagaaucuggugcgaaguaugguaagcgcggguucuggcgaaguggauuccuucucacuugggauccugugugucaguauaaugauugaggaggugaugcggagccguuggucgagaaagauguugaugacuggaacacucgccguuuuucugcuacugaucaugggccagcucaccuggaacgaccugaucaggcuuugcauuauggugggggcuaaugccuccgaccgcaugggaaugggcacaacuuauuuggcacugauggcuaccuucaagaugcggccuauguuugccgucgguuuacucuucagaaggcugacgucucgagaagugcuucugcuaacaaucgggcucagccugguugcaucaguggaguugccaaacagucuggaagaguuaggagauggccucgccaugggcauuaugaugcugaaacuucugaccgaauuucaaccccaccaguuguggacuacccuccugucccuaacauucgucaagacuacccugucucuugacuacgcuuggaaaacgacagcgauggcccucagcauaguaucccuguuuccguugugucugucaaccacuagccagaagacaaccugguuaccugugcuccuggggaguuucggaugcaaaccacuuacuauguuucugaucacagagaacaagauuuggggucgcaagucuuggcccuugaaugagggcaucauggcaauugggaucguuuccauacuccugagcucgcuacugaaaaacgaugugccucuugcuggaccccucaucgccggcgguaugcugauugccuguuaugucaucucagggucuagugcugacuuguccuuagaaaaggcagccgaggugagcugggaacaggaggcggaacauucuggagcuagccacuccauucugguagaggugcaagaugacggcaccaugaaaaucaaggaugaggaacgggacgauacgcucacuauacugcuuaaagccacccuguuggcagucucaggcguuuacccaaugaguauuccugccacacuauucgugugguauuucuggcagaagaaaaagcagagaagcggggugcugugggacacccccucuccaccggaggucgaaagggcugugcucgauaauggaaucuaccguauccugcagcgcggucuuuuaggccggucccaaguugggguaggaguguuucaggacggcgucuuccauacaauguggcacgugacuagaggugcaguucugauguaucaggggaagaggcucgagccuucaugggccagugugaaaaaggauuugauuagcuacggaggcggcuggcgauuucagggguccuggaacaccggagaggaaguccaagugauagcgguagagcccgguaaaaauccaaagaacguccagacgacacccggcacuuucaaaaccccugaaggggaggugggagcuaucgcccuggacuuuaagccaggcacaucugguucgcccauuguuaaucgggaagggaagaucgugggacucuacggcaacggcgucgugaccacuagcgggaccuauguuucagcaauugcccaggcuaaagccucccaagagggaccucugccggagaucgaagacgagguguucaagaaacgcaaucuuacaauaauggaucugcacccagguaguggcaagacgagaagguacuugcccgcaaucguccgggaagcuauuaaacgaaagcuaagaacucugauccucgccccuacccgcgugguagcgucugagauggccgaagcauuaaaggggaugccaauuagguaucagacaaccgcugugaaaagcgagcauacuggacgugagaucguugaccugaugugccacgccacauuuaccaugcggcuucugucccccgucagagugccuaacuacaauaugauaauuauggaugaagcucauuucacggacccggcaucaaucgccgccaggggcuauaucucuacucgcguggguaugggggaggcugcggcaauuuuuaugacagccacccccccaggaagcgucgaagcuuucccucagaguaacgccguaauccaggaugaggaacgagacauacccgagagauccuggaauagcggcuacgauuggauuaccgacuuuccaggcaagacugugugguucguuccuucuaucaaaucagggaacgauauugcaaauugucuccggaagaacggaaaaagggugauccaauugucccgcaagacauucgacaccgaguaucagaagacaaaaaacaaugauugggacuacgucgugacuacggacauaagugaaaugggugccaacuuucgugcugauagaguuauugacccccggaggugccugaagccagugauccucaaagauggcccggagcgcgucauccuggcggggccuaugcccgugaccgccgcaagcgcugcccagcgaagaggacggauuggcaggaaucagaacaaggaaggugaccaauacguauauauggggcagccacuuaauaacgaugaggaccacgcacauuggacagaggccaaaaugcuacuggauaauaucaacacucccgaaggcauuauaccugcuuuguucgagccagaacgcgagaagucggccgcgaucgacggagaauacagauuaaggggcgaggcacggaagaccuuuguggagcugaugcgucgcggggaucuccccguuuggcugucuuauaaagucgccuccgaaggauuccaguacagcgaccgaagauggugcuuugauggugagaggaauaaccaggugcuugaagagaauauggacguggaaauuuggacaaaggagggcgagcggaaaaagcugcgcccuagauggcucgaugcuaggaccuauucagacccguuggcccugcgggaauucaaagaguuugcugcagggcgaagaagugucucuggagaccuaauccuggaaaucggcaagcucccacaacaccuuacucugcgcgcccagaacgcuuuagauaauuugguuaugcugcacaacuccgagcagggugggaaagccuacaggcaugcaauggaagagcuccccgacacgauugagacccugaugcuucuggcgcucauagccguguugacaggcggaguaacucuguucuuuuuaagcggcaaggggcuaggaaagaccucaaucggucugcucugugugacagcuaguagcgcccuucuguggauggcauccgucgaaccucacuggauugcugccucuaucauuuuggaguucuuucugauggugcuccugauccccgaaccagaucggcagcguaccccucaagacaaucagcuugcauauguugugauaggccuccuguucaugaucuugacugucgccgcuaacgagauggggcuguuagagacaacgaaaaaggaucuaggaauuggcuacguagcggccgaaaaccaucagcacgcaaccaugcuggacguggaucuccaccccgcuagcgccuggacucuuuacgccguugcaacaaccgugaucaccccaaugaugagacauacaauugagaauacuacggcuaacaucucccugaccgccauagcgaaucaagcugccauuuugaugggucuggacaaaggguggccuaucucaaagauggauauuggcgucccgcuccuggcacuuggaugcuauucucaggugaaccccuuaacacugacugccgcuguccucauguugguggcacacuacgccaucauaggcccagggcugcaggcgaaagcuaccagggaagcccagaagcgcacagcagccggaaucaugaagaauccuaccguugacggcauuguggcuaucgaucuagaccccguaguguaugaugccaaauuugagaagcaacugggucagauuaugcuccuuauccuguguacuagucagauauugcugaugcggacgacaugggcacucugcgaaucgauuacccuggcuacugggccauuaaccacacuuugggagggaagcccuggcaaauucuggaacacuaccaucgccgucuccauggcgaauaucuuccgagguucuuaccuggccggcgcagggcucgcuuuuucacuaaugaagagccugggaggcgggagaaggggaacaggcgcccagggugagacguugggggaaaaauggaagcgccaacugaaccagcucuccaagagugaguucaauaccuauaaacggucuggaauuauggaaguugacagaagcgaggcaaaggaaggccuuaaacguggugagacuacaaagcaugcugugucaaggggcaccgccaaacugcggugguuugucgagcgcaacuuggugaagcccgaagggaagguaaucgaccugggauguggccgagggggaugguccuacuauugcgccggccucaaaaaggugacugagguuaaagguuacacaaaggggggaccgggccacgaagagccaauaccuauggcgaccuacggcuggaauuuagugaaacugcauagugggaaggaugucuucuuuaugcccccagaaaaaugugacacgcuucugugcgauauuggagagagcucucccaacccuaccaucgaggaagguagaacacuaagggugcucaagauggucgagccguggcugcggggcaaucaguucuguauuaagaucuugaaccccuauaugccauccgugguugaaacucuggagcgcaugcagagaaaacacgggggaaugcucguaaggaauccucuuucacgaaacagcacccacgagauguacugggugucgugcggcacagguaauauagucucugcugugaacaugacuagucggaugcuguuaaaccguuuuaccauggcacauagaaagcccacauaugaacgcgacguugaucugggggccggaaccaggcacguggcugucgagccugaaguggccaauuuggacaucauuggccaacggaucgagaacauuaaaaaugaacauaaguccacuuggcacuacgaugaggacaacccauauaaaacgugggcauaccacggcagcuaugagguaaagcccucaggguccgccucuagcauggugaauggaguugucagacuccugacaaagccuugggaugugaucccaauggugacccagauugcuaugacugacaccacacccuucggucagcaacgcgucuuuaaagaaaagguugauacgaggaccccgcgagcgaaacggggcacuacacagaucauggaggugaccgccaaguggcuauggggguuccuuaguagaaacaaaaagccuaggauauguacucgcgaagaguuuacacguaagguacgguccaaugcagcuauuggagccguguucgucgacgaaaaccaguggaauagcgcaaaagaggccguggaggacgaaagauuuugggaucugguucauagggagcgcgaacuccacaagcagggcaaaugcgcuaccugcguguacaacaugauggguaagcgagagaaaaagcugggggaauucggaaaggccaaaggcucucgggcgaucugguacaugugguugggcgcaagauuccuggaguuugaggcccucggguucaugaaugaagaccauugguuuucaagggagaacagucuuuccggagucgaaggugagggccugcacaaguuaggguauauccugcgcgauauuagcaaaauaccaggaggcaauauguacgcugacgauacagccgguugggacacuagagugaccgaggaugacuugcaaaacgaagcaaagaucacggauauuauggagcccgaacaugcucuccuggccaccucuaucuucaaacuaacauaucagaauaagguaguucgggugcagaggccugcuaaaaacgggacugucauggacgugauuucgcgucgagaucagcgcggaucaggccaagugggcaccuacgggcuuaacacauuuacuaauauggagguccagcugaucagacagauggaaagcgagggaauauuccucccauccgagcuggaaacccccaacuuggccgagcgggcauuagacuggcuggaaaagcacggugcggagaggcucaagcgcauggccaucaguggcgaugacuguguugugaaaccgauugacgauagauuugcuacggcccuuacagcacugaaugacauggggaagguacggaaagauaucccucagugggaacccucuaagggauggaacgacuggcaacaggugccauucugcagccaccauuuucaccagcuaauuaugaaagauggcagggagaucgucgugccuugucgaaaucaggacgagcugguuggucgugcuagagugucccaaggggccggauggucacuccgcgaaaccgcaugcuugggcaagaguuaugcccagauguggcagcugauguacuuccaucggagggaucuuagacuggcggcuaacgccauauguucugcaguccccguggacuggguaccaacuagccgcacaaccugguccauucacgcccaccaucaauggaugacuaccgaggauaugcucucaguuuggaaucggguguggaucgacgaaaaccccuggauggagaauaagacacacgucagcucuugggaagaggugccuuauuuaggcaaaagggaggaucaguggugcgggucccugaucggauugacggcucgagccaccugggcaacuaacauucagguugcuauaaaucaggugagacggcugaucgguaacgaaaauuaccucgacuacaugacaaguaugaagagguuuaaaaacgagagcgacucggaaggcgcccuuugguga

SEQ ID NO: 13461 - RNA, 9879 nt, Artificial Sequence
  derived and/or modified CDS sequence (opt3) from DENV-1__KJ189366__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauagcggaggcugaaccggacgauguggacuguuggugcaaugccacagauaccuggguaacuuaugggacauguagucaaaccggagagcaccgccgagagaagcguagcguggcacuggccccccaugucggcuugggucucgaaacgagaacugagaccuggauguccucugaaggggcuuggaaacagauccagaggguggagacaugggcacugcggcacccuggauucacuguuauugccuuuuuccuggcucaugccaucggcaccucgauuacacagaagggcaucauauuuauccucuuaaugcuggugaccccaucaauggcgaugcgcugcgucgggauuggaaacagagacuucguggagggucuuagcggcgcaacguggguagauguuguguuggaacacgggaguugugucacuacaauggccaagaauaaacccacccuggacaucgagcuacucaagacugaagugacaaacccugcugugcugaggaaacuuugcauugaggccaagaucuccaauaccacgaccgauucucgguguccaacacaaggagaagcaacucuggucgaggagcaggacgcuaacuuuguuugccgccgaaccuucguggauagaggcugggguaauggguguggauuguuuggcaaaggcagccuccugacaugcgccaaguucaagugcguaacuaaauuagaagggaagauagugcaguacgagaaccugaaauauuccgucauugugaccguucacacaggagaccagcaucaaguggguaaugaaaccacugagcacggcacgaucgcgacaauuaccccccaggccccuacuucagaaauccagcucaccgauuacggggcacuuacacuggacuguaguccaaggaccggauuggacuuuaacgagaugguccuacugacuaugaaggagaaaagcuggcucgugcauaagcagugguuccuggaucuuccgcugcccuggacaucuggcgcuuccacgucacaagaaaccuggaaucggcaggacuugcucguaacuuuuaaaacagcccacgcuaagaagcaggagguugugguccuggguagccaagaaggggccaugcacaccgcauuaacaggcgccacugagauccagaccaguggaacgaccacaauuuucgcuggccaucugaaaugccgucuaaagauggauaaacucacucugaaggggaugucuuaugugauguguaccggauccuucaaacuugaaaaggaggucgcggagacacagcacgguacuguguugguucaggugaaguacgaaggcaccgacgcaccuugcaaaauaccauuuagcacgcaagaugagaaggggguaacacagaacggacgccugaucaccgccaaucccauugucacugacaaagaaaagccugugaacaucgagacagagccacccuucggcgaaucguauauaguugugggugcuggggagaaagcccucaagcugucuugguuuaagagaggcuccucaauuggaaaaauguucgaagcaaccgccaggggcgcucggcgaauggccauccuuggggauacugcaugggacuuuggaaguaucgguggcgucuucaccagcguggggaagcugguacaucagauuuuuggaacagcguacggcguguuguucuccgguguuucuuggacgaugaaaaucgggauuggcauacuccugaccugguuaggacugaauagccgcucaacuagucuauccaugacauguaucgcugucggcauggugacccucuaccugggggugaugguccaggccgauagcggaugcguuauuaacuggaagggcagagagcuuaaaugugguucugggaucuuugugacaaacgaagugcacacuuggaccgagcaauauaaguuccaggcagacucaccgaagagguugagugccgcuaucggaaaagccugggaggaaggcguaugcgguauucggagcgcaacgcgccuggagaauauaauguggaagcagaucuccaacgaacucaaucauauucuguuagagaacgauaugaaauuuacagucgugguuggcgacgcuaaugggauccuggcccagggaaagaaaaugauuagaccucaacccauggaacacaaguacucuuggaaaucguggggcaaggcgaagaucauaggggccgacauccagaacaccacuuucauuaucgauggaccagacaccccugagugucccgauggccagagggcuuggaauauuugggagguggaagacuaugguuuuggggucuucacaacuaacaucuggcuuaaauugcgugauagcuacacccagaugugcgaccaccggcucauguccgcagccauaaaggauucaaaagcugugcaugccgacaugggauauuggauugagagugaaaagaaugagacauggaaacuggcacgagcgucuuucaucgaaguuaagacguguaccuggccaaagagccacacucuaugguccaacggcgugcuggagucagagaugauuauccccaaaauauacgguggcccuaucagccaacauaauuauagaccaggguacuuuacacagaccgccggaccguggcaccucggcaagcuggaacuugauuucgacuugugcgaggggacuacaguagucguggaugaacacugcggaaacaggggccccucucugcgcaccacgacugugaccgguaaaauuauccaugagugguguugccgguccuguacauuaccuccacucagauuuaggggggaggacggaugcugguacggcauggaaauucgccccgucaaggagaaagaagagaaucugguucgaaguauggugagcgcugguucuggcgaaguagauuccuucucacuugggauccugugugugaguauaaugauugaggaggucaugcggagccguuggucgagaaagauguugaugaccggaacucucgccguguuucugcuacugaucaugggccagcucacauggaacgaccugaucaggcuuugcauuaugguuggggcaaaugcuuccgaccgcaugggaaugggcaccacauauuuggcccugauggcaacuuucaagaugcggccuauguuugccguggguuuacucuucagaaggcugaccucucgagaaguccuucugcuaacgaucgggcucagccugguggcuucaguugaguugccaaacagucuggaagaguuaggagauggccucgcgaugggcauuaugaugcugaaacuucugacagaauuucaaccccaccaguuguggaccacucuccugucccuaaccuucgugaagacaacucugucucuugacuacgccuggaaaaccacggcaauggcucucagcauagucucccuguuuccguugugucugucaacaaccagccagaagacuacaugguuaccuguacuccuggggaguuucggaugcaaaccacuuaccauguuucugaucacugagaacaagauuuggggucgcaagucuuggcccuugaaugagggcaucauggccauugggaucguguccauacuccugagcucgcuacugaaaaacgauguuccucuugccggaccccucaucgcuggcgguaugcugauugcauguuaugugaucucagggucuagugccgacuuguccuuagaaaaggcggcugaggucagcugggaacaggaggccgaacauucuggagcaagccacuccauucugguggagguacaagaugacggcacaaugaaaaucaaggaugaggaacgggacgauacccucacgauacugcuuaaagccacucuguuggcugugucaggcgucuacccaaugaguauuccugcaacccuauucguuugguauuucuggcagaagaaaaagcagagaagcggggugcugugggacacacccucuccaccggagguggaaagggccguccucgauaauggaaucuaccguauccugcagcgcggucuuuuaggccggucccaaguggggguuggaguauuucaggacggcguguuccauaccauguggcacgucacaagaggugcggugcugauguaucaggggaagaggcucgagccuucaugggcuaguguuaaaaaggauuugauuagcuacggaggcggcuggcgauuucagggguccuggaacacuggagaggaagugcaagucauagccguggagcccgguaaaaauccaaagaacguacagaccacgcccggcacauucaaaacuccugaaggggaggucggagcaaucgcccuggacuuuaagccaggcaccucugguucgcccauugugaaucgggaagggaagaucguuggacucuacggcaacggcguggucacaaccagcgggacuuaugugucagcuauugcccaggcaaaagcuucccaagagggaccucugccggagaucgaagacgagguuuucaagaaacgcaaucuuaccauaauggaucugcacccagguaguggcaagacaagaagguacuugcccgccaucgugcgggaagcgauuaaacgaaagcuaagaacgcugauccucgccccuacucgcgucguggcaucugagauggcugaagccuuaaaggggaugccaauuagguaucagaccacagcuguaaaaagcgagcauaccggacgugagaucguggaccugaugugccacgcaacuuuuacaaugcggcuucugucccccguuagagucccuaacuacaauaugauaauuauggaugaagcccauuucaccgacccggccucaaucgcugcgaggggcuauaucucuacgcgcguggguaugggggaggcagccgcuauuuuuaugacugccacacccccaggaagcguggaagcauucccucagaguaacgccgucauccaggaugaggaacgagacauacccgagagauccuggaauagcggcuacgauuggauuaccgacuuuccaggcaagaccguaugguucgugccuucuaucaaaucagggaacgauauugcuaauugucuccggaagaacggaaaaaggguuauccaauugucccgcaagacuuucgacacagaguaucagaagaccaaaaacagugauugggacuacguggucacaacugacauaagcgaaaugggugcgaauuuucgugccgauagagugauugacccccggaggugccugaagccaguuauccucaaagauggcccggagcgcgugauccuggcagggccuaugcccgucacggcugccucggcagcccagcgaagaggacggauuggcaggaaccagaauaaggaaggugaccaauacguguauauggggcagccacuuaacaaugaugaggaccacgcucauuggaccgaggccaaaaugcuacuggauaacaucaauacacccgaaggcauuauaccugcguuguucgagccagaacgcgagaagucugcagccaucgacggagaauacagauuaaggggcgaggcucggaagacuuuuguagagcugaugcgucgcggggaucuccccguguggcuguccuauaaaguugccagcgaaggauuccaguacucagaccgaagauggugcuuugauggugagaggaacaaucagguccuugaagagaacauggacguggaaauuuggaccaaggagggcgagcggaaaaagcugcgcccuagauggcucgaugcuaggacauauagugacccguuggcacugcgggaauucaaagaguuugccgcugggcgaagaucuguguccggagaccuaauccuggaaaucggcaagcucccacaacaccuuacccugcgcgcccagaaugcauuagauaacuuggucaugcugcacaauagcgagcagggugggaaagcguacaggcaugccauggaagagcuccccgacacuauugagacgcugaugcuucuggcucucauagccguuuugaccggcggagugacacuguucuuuuuaucaggcaaggggcuaggaaagacuaguaucggucugcucuguguaaccgcaagcuccgcucuucuguggauggccucuguggaaccucacuggauugcagccagcaucauuuuggaguucuuucugaugguccuccugauccccgaaccagaucggcagcguacaccucaagacaaccagcuugcuuaugugguuauaggccuccuguucaugaucuugaccguggcggccaaugagauggggcuguuagagacuacaaaaaaggaucuaggaauuggcuacgucgcagcugaaaaccaucagcacguaacgaugcuggacguggaucuccaccccgccuccgccuggacccuuuacgcaguugcuacuacagugaucaccccaaugaugagacauaccauugagaacgccacagcgaauaucucacugacugcuauagccaaccaagcagccauuuugaugggucuggacaaaggguggccuaucucuaagauggauauuggcgucccgcuccuggcucuuggaugcuauagucaggugaaucccuuaacgcugaccgcagccguccucauguugguggcgcacuacgcuaucauaggcccagggcugcaggccaaagcaacaagggaagcccagaagcgcacugcugccggaaucaugaagaacccuaccguugacggcauuguggcaaucgaucuagaccccguaguguaugaugcuaaauuugagaagcaacugggucagauuaugcuccuuauccuguguacaucgcagauauugcugaugcggaccacuugggcccucugcgaaagcauuacgcuggcgacagggccauuaaccacucuuugggagggauccccuggcaaauucuggaauaccacaaucgccgucucuauggcaaacaucuuccgagguucauaccuggcuggcgccgggcucgcauuuagccuaaugaagucccugggaggcgggagaaggggaacuggcgcucagggugagaccuugggggaaaaauggaagcgccaacugaaucagcucaguaagucugaguucaacacauauaaacggagcggaauuauggaaguugacagaucagaggccaaggaaggccuuaaacguggugagacgaccaagcaugccguguccaggggcacugcgaaacugcggugguuugucgagcgcaauuuggugaagcccgaagggaagguaaucgaccugggauguggccgagggggauggaguuacuauugcgcuggccucaaaaaggugacagagguuaaagguuacaccaaggggggaccgggccacgaagagccaauaccuauggcaacuuacggcuggaacuuagugaaacugcauagcgggaaggaugucuucuuuaugcccccagaaaaaugugacacacuucugugcgauauuggagagucuucccccaauccuaccguggaggaagguagaacgcuaaggguccucaagaugguggagccguggcugcggggcaaccaguucuguaucaagauuuugaaucccuauaugccaucaguuguagaaacccuggagcgcaugcagagaaaacacgggggaaugcucgugaggaacccucuuagccgaaauucgacacacgagauguacugggucucuugcggcacugguaacaucgugagugccguuaauaugaccucccggaugcuguuaaaccguuuuacaauggcucauagaaagcccacuuaugaacgcgacguggaucugggggccggaaccaggcacgucgcaguggagccugaaguagccaacuuggacauaaucggccaacggauugagaauaucaaaaacgaacauaagagcacauggcacuacgaugaggacaauccauauaaaaccugggcuuaccacggcucauaugaggugaagcccuccgggucugcgagcaguaugguuaacggagucgugagacuccugacuaagccuugggaugugauuccaauggucacgcagaucgccaugacagacaccacucccuucggucagcaacgcguuuuuaaagaaaagguggauaccaggacaccgcgagcaaaacggggcacgacccagauuauggagguaacugcuaaguggcuauggggguuccuuuccagaaauaaaaagccuaggaucuguacacgcgaagaguuuacccguaaggugcggagcaacgccgcagucggagccguguucguugacgaaaaucaguggaacucugcuaaagaggccguggaggacgaaagauuuugggaucugguccauagggagcgcgaacuccacaagcagggcaaaugcgcgacuugcguguacaauaugauggguaagcgagagaaaaagcugggggaauucggaaaggcaaaaggcucacgggccauaugguacaugugguugggcgcuagauuccuggaguuugaggcccucggguucaugaacgaagaccauugguuuaguagggagaauucccuuagcggaguagaaggugagggccugcacaaguuaggguauauucugcgcgauaucucuaaaaucccaggaggcaacauguacgcagacgauacagcugguugggacaccagaguuacagaggaugacuugcaaaaugaagccaagauuacugauauaauggagcccgaacaugcucuccuggccaccucgaucuucaaacuaacguaucagaacaaggugguccgggugcagaggccugcaaaaaaugggaccgugauggacgucauuucacgucgagaucagcgcggaagcggccaaguuggcacauacgggcuuaacacuuuuaccaacauggaggugcagcugaucagacagauggaauccgagggaauuuuccucccaagugagcuggaaacacccaauuuggcggagcgggccuuagacuggcuggaaaagcacggugcugagaggcucaagcgcauggccaucucuggcgaugacuguguagugaaaccgauagacgauagauuugcaacugcucuuaccgcccugaacgacauggggaagguccggaaagauaucccucagugggaacccagcaagggauggaaugacuggcaacaggugccauucugcucccaccauuuucaccagcuaauuaugaaagauggcagggagaucguugugccuugucgaaaccaggacgagcuggucggucgugcaagagugucacaaggggccggauggagucuccgcgaaacggcgugcuugggcaagucuuaugcucagauguggcagcugauguacuuccaucggagggaucuuagacuggccgcaaaugccauuuguagcgcuguacccguugacugggugccaacaucccgcaccacuuggucaauccacgcccaccaucaauggaugacaaccgaggauaugcucagcgucuggaaccggguguggauagaagagaaucccuggauggaaaacaagacucacguuucuuccugggaggaggugccuuauuuaggcaaaagggaagaccaguggugcgggagucugauuggauugaccgcacgagcuacaugggccacgaauauccaggucgcgaucaaccaggugagacggcugauugguaaugagaacuaccucgauuacaugaccagcaugaagagguuuaaaaaugaaucggacuccgagggcgcucuuugguga

SEQ ID NO: 13462 - RNA, 9879 nt, Artificial Sequence
  derived and/or modified CDS sequence (opt3) from DENV-1__JN819417__SS-prME
agcgugaccaugcugcucaugcuucugcccaccgcauuggcuuuccacuuaacuacgcggggcggggagccucauauggucguuuccaagcaggaaaggggaaaaucucuguuauuuaagaccucagccggugugaacaugugcacccucaucgcaauggaccugggcgagcuuugugaagauacuaugaccuacaaaugcccacggauuacagaggcggaaccggacgauguagacuguuggugcaaugcuaccgauacuugggugacauaugggaccuguagucaaacgggagagcaccgccgagacaagcguagcgucgcacuggcaccccaugugggcuugggucucgagacuagaaccgaaacauggauguccucugagggggccuggaaacagauacagaagguugaaacuugggcucugaggcacccuggauucaccgugaucgcacuguuucucgcccaugcuauuggcacaucgaucacccagaagggcauuaucuucauauuacugaugcuugucacgccaucaauggccaugcggugcguggggaucggaaaccgcgauuuuguagaggguuugagcggcgcgacuuggguugacgugguccuggagcacgggaguugugugacaaccauggccaagaauaagcccacucuagauauugaacuccugaaaacagaggugaccaacccugccauccuuagaaagcugugcauugaagcuaaaaucuccaauacgaccacagacucuagguguccaacucaaggagaggccaccuuggucgaggaacaggaugcaaacuucguuugccggcgcacauuuguggaccgaggcugggguaauggguguggacucuucggcaagggcagccuguuaacuugcgcuaaguuuaaaugcguaaccaagcuggaggggaaaauagugcagcacgaaaaccucaaguacuccgucauugugacaguucauaccggagaucagcaccaaguggguaaugagacuacggaacauggcacaaucgccaccauuacuccccaggcgccuaccucagagauccagcuuacagacuauggggcccugaccuuggacuguaguccaagaacuggacuagauuucaacgaaaugguccugcucacaaugaaagaaaagagcuggcuggugcacaaacagugguuucuugaccugccguugcccuggacgucuggcgcauccaccucacacgagacuuggaauaggcaagaucuccugguaacauucaagaccgcucaugccaagaaacaggaaguuguggucuuagguagccaggagggggcuaugcacacagcccugacuggcgcaaccgaaauccaaacgaguggaaccacaacuauuuuugccggccaucuaaagugccggcucaaaauggacaagcugacccuuaaagggaugucuuacgugauguguacaggauccuucaaguuggagaaggaagucgcugagacucagcacgguaccgugcugguucaggugaaauaugagggcacggaugcgccuugcaagauaccauucagcacacaggacgaaaaagggguaacccaaaacggacgucucaucacugcaaaucccauugucacagauaaggagaaaccugugaacaucgaaaccgagccacccuuuggcgagucguacauaguugugggugccggggaaaaggcucugaaacuuucuugguucaaaaagggcuccucaauuggaaaaauguuugaggccacugcacgcggcgccagaaggauggcuauccugggggacaccgccugggauuucggaaguaucgguggcgucuuuacaagcguggggaaguugguacaucagguguucggaacggcauauggcguucucuuuuccggugucucuuggaccaugaaaauugggaucggcauucuguuaacuuggcugggacuaaauagccggucaacaagucucuccaugaccuguauagcggugggcauggugacacuguaccuuggggucaugguucaggcugacagcggaugcgugaucaacuggaagggccgagaauugaagugugguucugggauuuucgugacuaacgagguacacaccuggacggaacaguacaaauuucaagccgauucaccgaagcgccugagugcagccaucggaaaggcuugggaggagggcgucugcgguaucagaagcgccacaaggcucgaaaauauuauguggaagcagauauccaacgagcugaaucacaucuuacuggaaaacgacaugaaauucaccgugguugugggcgacgcaucugggauucuugcucagggaaagaaaaugauccggccucagcccauggagcauaaguauucguggaaaagcuggggcaaagccaagauuaucggggcggauacucaaaauaccacauuuauaaucgacggaccagauacuccugaaugucccgacgaucagcgcgccuggaacauuugggaggucgaggacuacggcuucgguaucuuuaccacaaauauuugguugaaacucagagauuccuauacgcagaugugcgaccacaggcugaugucagcugcaaucaaggauaguaaagccgugcaugcugacaugggguacuggauagaaucugagaagaacgaaaccuggaagcuagcccgugccagcuucauugagguuaaaacuuguaucuggccaaagucccacacacuguggucaaauggagugcucgaaagcgagaugauuauccccaaaauauauggcgguccuaucucucagcacaacuaccggccaggcuauuucacccaaacugcggggccguggcaucugggaaaacuugaguuggauuuugaccugugcgaaggcacaaccguagucguggaugagcacugcgggaaucgaggacccuccuuaagaacgacuaccgugacaggcaaaauuauccaugaaugguguugcaggaguuguacccucccuccacugcgcuuccggggugaggacgggugcugguacggaauggagauuagacccgucaaggaaaaggaggaaaaccuuguuaggagcauggugucugccggcuccggugagguagacucauuuagucugggcaucuugugugugagcauaaugauugaagaggucaugcgcucgcgauggucccggaaaaugcucaugacugggacacuggcuguguuccuacugcucaucaugggacagcugaccuggaaugaucuuauccguuugugcauuaugguuggcgccaacgcaucugacagaauggggaugggaacaacuuaccuggcuuuaaugggcaccuuuaagaugaggccuauguucgccgugggucuccuguuucgccggcuuacgagcagagagguccugcuacucacaaucgggcugucauugguggcaaguguugaacugccaaauuccuuagaggaacucggagauggccuggccaugggcauuaugaugcuuaaacuguugaccgaguuccagccccaccaacucuggacuacccugcuaucucugacauuuauaaagacuacccuuagccucgacuaugcuuggaaaacgauggcgauggugcuguccaucgucucauuguucccgcuguguuuaagcacaaccagucagaagacuacauggcucccuguacugcuugggucuuuuggaugcaagccacugaccauguucuugauuacugaaaacaaaaucugggguaggaaguccuggccccucaacgagggcauuauggccaucgggauagugagcauccugcuaucgucacugcuuaaaaaugauguuccucucgcaggaccccugauugcuggcgguauguugaucgccuguuacgugauuucugggaguuccgccgacuuaagccuggagaaggcugcagaaaucucuugggaggaagaggccgaacauagcggaacaucccacaacauacucgucgaggugcaggaugacggcaccaugaaaauuaaggaugaggaacgagacgauacgcugacuauccuucugaaagcgaccuugcuagcuguaucaggcguguauccaaugaguaucccugccacacuguuugucugguacuucuggcagaagaagaaacaacgcagcgggguucucugggacacccccucuccaccggagguggaacgggcagugcuggaugacggaauuuauagaauacuucagagggguuuacugggccguucccaggucggggugggaguuuuccaggacggcguauuucacacaauguggcaugugacucgcggugccguccucauguaccaagggaagcgguuggagccuucaugggcuagugugaaaaaggaucugaucagcuauggaggcggcuggagauuccagggguccuggaauaccggagaggaaguucaggugauugcagucgagcccgguaaaaacccaaagaaugugcagacgacacccggcacuuuuaagaccccugaaggggagguaggagccaucgcgcucgacuucaaaccaggcacaucugguucgcccauugucaacagggaagggaagaucgugggacuguacggcaauggcguugugaccacuagcgggaccuacgucucagcuauagcccaagcaaaagccucccaggagggaccucuuccggagaucgaagaugagguguuuaagaaacgaaaccugacaauuauggacuugcacccagguaguggcaagacgcggcgcuaucuacccgcuaucguuagagaagccauuaagaggaaacugcggacucucaucuuagcaccuacccgaguggucgcuucugagauggccgaagcgcugaaggggaugccaauaagauaccagacaaccgccgugaaaagcgagcauacuggacgcgagauuguagaucuuaugugccacgcaacauucaccaugaggcugcucucccccgugcguguuccuaauuauaacaugaucaucauggacgaagcucauuuuacggauccggccucaauugcugcacggggcuacaucucuacuagagucgguaugggggaggccgccgcuauauucaugacagcgacacccccaggaagcguggaagcauuuccucaaaguaaugccgugauucaggacgaggaaagggauauccccgagcgcuccuggaacagcggcuaugacuggauuaccgauuucccaggcaagacuaucugguuugucccuucuauaaaaucagggaaugacauugcuaacuguuugcgaaagaauggaaagagaguaauccagcugucccggaaaacauucgacaccgaguaccagaagaccaagaauaacgauugggacuaugugguuacuacggauaucagugaaaugggugccaauuucagggcagaccgcgugauugauccccguagaugccucaagccagucauccugaaagacggcccggagcgggugauucuugccgggccuaugcccguuaccguggcuagcgcggcccaaaggcgcggacgaauaggcagaaaccagaauaaggaaggugaucaguacgucuacauggggcagccacuaaacaaugacgaggaucacgcacacuggacagaggcuaagaugcuguuggacaacaucaauacucccgaaggcauuaucccugccuuauuugagccagaacgggagaaaucggcagccaucgauggagaauauaggcugcgcggcgaggcuagaaagaccuucguggagcucaugaggagaggggaccugcccguauggcuuucuuacaaaguggccuccgaaggauuucaauauagcgaucgucgcuggugcuucgacggugagcgaaacaaucagguucuggaagagaacauggacgucgaaauuuggacaaaggagggcgagaggaagaagcucaggccucggugguuggaugcgcgcaccuacucagacccgcuggcacuaagagaauuuaaagaguucgccgcugggaggcggaguauaucuggagaucugauccucgaaauuggcaaacuuccacagcaucugacuuuacgagcccagaaugcuuuggacaaccuggugaugcuccacaauuccgagcaaggugggaaggcauauagacaugccauggaggaacugcccgauacgaucgagacccuuaugcugcucgcuuugauugccgugcugacaggcggagucacuuuauuuuuccuaagcggcaaagggcugggaaagaccucaaucggucuccuuuguguuauggcaaguagcgcgcuguuguggauggccaacguggaaccucacuggauagcugccuccaucauucuggaguuuuuccucaugguacugcuuauccccgaaccagaccgccagaggacaccucaggauaaucagcucgcauacguggucauuggccuguuguuuaugauccugaccguggcugccaacgagaugggguuacuagagacuaccaagaaggaccugggaauaggccacguugcagccgaaaaccaucaccaugcuacgaugcucgauguggaccuucggcccgcgucugccuggacccuguaugcagucgcuacuacaguaauuaccccaaugaugcgucacaccaucgagaauacaacugccaacauuagcuugacggccaucgcaaaucaagcugccauacugaugggucucgauaaaggguggccuaucuccaagauggacauuggcgugccgcugcuugcguuaggaugcuacucacagguuaacccccugacccucacagcugccguguugaugcuggucgcacauuacgccaucauuggcccagggcuacaggcuaaggcaacuagagaagcccaaaagagaaccgcggcuggaaucaugaagaauccuacaguggauggcauagucgccauugaccuggaccccgugguuuaugaugcaaaauucgagaagcagcucggucagaucaugcuucugaucuuguguaccucucagauucugcucaugcgcacuacgugggcccugugcgaaaguaucacauuagcuaccgggccacuuacuacccugugggagggaucgccuggcaaauuuuggaacacaacuauagccgugagcauggcaaauauuuuccgggguuccuaccucgcuggcgccgggcuagcguucucucugaugaagucauugggaggcgggcgaagaggaaccggcgcccaaggugagacacugggggaaaaguggaaaaggcagcucaaccagcuuagcaaguccgaguuuaauacguauaaacgcaguggaaucauggaaguagaccggucugaggcaaaggaaggccugaaaagaggugagaccacuaagcacgcugugagccguggcacagccaaguugaggugguucgucgagcggaaccugguuaaacccgaagggaaggugauugaucucggauguggccgcgggggauggucauacuauugcgcaggccugaaaaaggucaccgaggugaaagguuacacuaaagggggaccgggccacgaggagccaaucccuauggcuacauauggcuggaaucuaguaaaacuucauuccgggaaggacguguuuuucacacccccagaaaagugugauacgcugcuaugcgacauaggagagaguagccccaacccuaccaucgaggaaggucgaacacucagaguucugaaaaugguggagccgugguugaggggcaaucaguuuuguauuaagauccugaaccccuacaugccaucugucguggaaacucucgagcaaaugcagcggaaacacgggggaaugcuuguccgcaauccucuguccagaaacucaacccaugagauguacugggugagcugcggcacagguaauauuguuucggccguaaacaugacuucuaggauguuacugaaccgauucaccauggcccaccggaagcccacauaugaaaaagauguggacuugggggcgggaacccgucacgucgcuguggagccugaaguugcaaaucucgauaucauuggccagagaaucgagaacauaaagaaugaacauaagaguacuuggcacuacgacgaggauaacccauauaaaacgugggccuaccauggcuccuaugaggugaagcccagcgggucagcuuccucuauggucaauggagugguacgccugcuaacaaaaccuugggacgugauuccaaugguuacccagaucgccaugacugacaccacacccuuuggucaacagagggucuucaaggaaaaaguggauacgcggaccccgagagcaaagcgcggcacugcccagaucauggaggugacagcuaaguggcuuuggggguuucugagcaggaacaaaaagccucgaauuuguacccgggaagaguucacuaaaaaggucagaaguaaugcggccauaggagcaguuuuuguggacgaaaaccaauggaacuccgcuaaagaggccguagaggaugaaagguucugggaccucgugcaccgcgagcgugaacugcauaagcagggcaagugcgcaacaugcgucuacaacaugauggguaaacgggagaagaaauugggggaauuuggaaaggccaaaggcagcagagcuaucugguauauguggcugggcgccagguuccucgaguucgaggcgcuuggguuuaugaaugaagaucacugguucucucgcgagaacucacugaguggaguggaaggugagggcuuacacaagcugggguacauuuugcgagacaucuccaaaauuccaggaggcaauauguacgcagaugacaccgccgguugggauacacggaucacugaggacgaucuccagaacgaagcuaagauaaccgacaucauggagcccgaacaugcccugcuagcaacgagcauuuuuaaacuuaccuaucagaauaaaguugugagaguccaaaggccugcuaagaacgggaacgugauggauguaaucucucgcagagaccagcggggaucgggccagguuggcacauacgggcugaauacuuucaccaacauggaggugcagcucauuaggcaaauggaaucagagggaaucuuucugccaagcgaguuggaaacacccaauuuagccgagcguguccuggacuggcucgaaaaacacggugcugagcgacuuaagcgcauggccauauccggcgaugacuguguggugaaaccgauugaugacagauucgcaacugcgcugaucgcccuaaacgauauggggaagguccggaaggacaucccucagugggaacccaguaaaggauggaaugauuggcagcagguuccauuuugcucucaucacuuccaccaacugauuaugaaggacggcagggagauagugguaccuugucgcaaccaggaugagcucguggguagagcucgggucagccagggggccggaugguccuugagggaaaccgcaugccugggcaaaucauaugcucagauguggcaacuuauguacuuucaucgacgugaccugagacucgccgcaaaugccaucuguagugcggugcccguugauugggugccaacgucucgcacaaccuggagcauucacgcucaucaccaguggaugacuacagaggacauguuauccgucuggaaccggguguggaucgaagagaaucccuggauggaagacaagacccauguaucaagcugggaggagguuccuuaucugggcaaaagggaagaucaguggugcgggucuuugauuggacugacugccagagcaaccugggccacaaacauccaaguggcuauaaaucagguccgccggcucaucgguaacgagaauuaccuugacuauaugacguccaugaagagguucaagaacgaaagugauccagagggcgcccugugguga

SEQ ID NO: 13463 - RNA, 9879 nt, Artificial Sequence
  derived and/or modified CDS sequence (opt3) from DENV-1__FJ687426__SS-prME
agcgugacaaugcugcucaugcuuaugcccacagcacuggcuuuccacuugacuacgcgaggaggggagccucauaugaucgucuccaagcaggaaaggggaaaaucuuuacuguuuaagaccucagccgguguuaacaugugcacacugauugccauggaccucggagagcugugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuugcaccccaugucggacuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagccgggauuuuguggagggucuuaguggcgcgacuuggguagacguuguguuggagcacggguccugugucacaaccauggcaaaggauaaacccacucuggacaucgaacugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccuccugacuugcgcuaaguuuaagugcguaaccaaauuagaggggaagauagugcaguacgaaaaccugaaauauucagucauugugacaguucacaccggagaccagcaucaaguggguaaugagaguacugaacacggcacgacagccaccaucacuccccaggcgccuaccacagagauucagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccaucuuugccggccaucugaaaugccgucuaaagauggauaaacucacacugaaggggauguccuaugugauguguacuggcagcuucaaacuugagaaggaagucgcugagacccagcacgguacgguguugguucagauuaaguacgagggcacagacgcgccuugcaaaauaccauucucgacccaagaugaaaagggggugacucagaacggacgccugaucacagcaaaucccauuguaaccgacaaagagaagccugucaacaucgaagccgagccacccuuuggcgagucuuauauagugauuggugcuggggaaaaagcccucaagcuguccugguucaagaaaggcucaaguaucggaaagauguuugaggcaacugccagaggcgcuaggcggauggccauccuuggggauaccgcaugggacuucggaagcauugguggcguuuuuacauccguggggaaacugguccaucagaucuucggaacggcguacggcguguuguuuucugguguaagcuggaccaugaagauugggauaggcgugcuccugacuugguuaggacuaaauucacgaaguacaucccuaagcaugaccuguaucgcuguuggccucgucacacuguaccuuggggugauggugcaggccgauucuggaugcgucauuaacuggaaaggccgcgaauugaagugugguucagggaucuucguuacuaaugaggugcacaccuggacggaacaauauaaguuucaggcagacaguccgaaaagacugagcgccgcuaucggaaaggccugggaggagggcgugugcgguauuagguccgcaacacggcucgaaaacauaauguggaaacagaucucuaacgagcugaaucauauuuuacuggaaaacgacaugaaguucaccguagucgugggcgauguugcugggauccuugcccagggcaaaaagaugauucgcccucaacccauggaguacaaauauucguggaaaagcuggggcaaggcgaaaaucauaggggccgacgugcaaaauuccacuuuuaucauugauggaccaaacaccccugaaugucccgacgaucagagagcuuggaauaucugggaggucgaggacuacggcuucgguauuuuuacaacuaacaucugguugaagcucagggauucauauacccaggugugcgaccaccgucugaugagugcagccauaaaagauucuaaggcuguucacgccgacaugggguacuggauugaaagcgagaaaaaugaaacauggaagcuagcaggagcguccuucaucgaggugaagacguguauuuggccaaaaucacauacccuguggagcaacggcguacucgaaucugagaugaucauacccaagaucuaugguggcccuauuucccaacacaauuaccggccaggguacuucacucagacagccggaccguggcaucugggcaaacuugaguuggauuuugaccugugcgaagggaccacugucgugguggaugagcacugcggaaaccgaggccccaguuuaagaacaaccacggucacugguaagaucauucacgaaugguguugcaggagcuguacccucccuccacugcgcuucagaggggaagacggaugcugguauggcauggagaucagacccguuaaagaaaaggaggaaaaucuugugaagucuaugguauccgcugguucaggcgagguggacaguuuuagccugggguugcucuguauaucgauuaugaucgaagaggucaugaggucccgcuggucucgaaaaaugcugaugacaggaacccuagccguguucuuucugcucaucaugggccagcugacuuggaacgaucuuauucgguugugcaucaugguuggggcaaaugcuagcgaccguaugggaaugggcacaaccuaccuggccuuaauggcaacauucaagaugagaccuauguuugccgugggucuccuguucaggcgccuuacuucacgggagguccugcuacucaccauugggcugaguuugguggcuuccguugaacugccaaacucuuuagaggaacucggagauggccuggcgaugggcauaaugauccuuaaacuguugacggacuuucaaagccaucagcucugggccacacugcuaucccugaccuucauuaagacuacccuuucacuccacuaugcauggaaaacaauggcuauggugcugagcaucgucaguuuguuuccccuguguuuaucuacuaccucccagaagacgacauggcucccgguacugcuugggagccugggaugcaagccuuugaccauguuccucauugccgagaauaaaaucugggguagaaagucguggccacugaacgaaggcauaauggccguggggaucguuucaauucuacugucuagucuucucaaaaacgaugugccccuggcuggaccuuugaucgcaggcgguauguuaauugccuguuacgucaucuccgggagcucugcggaccugagccucgagaaggcugccgagguguccugggaagaggaagcagagcauucaggagccagucacaauauacugguagaagugcaggaugacggcacuaugaaaauuaaggaugaggagagggacgauacacuuaccauccuguugaaagcuacucuacuggcagucagcggcguuuauccccucucuaucccagccacacuguuugugugguacuucuggcaaaagaagaaacagcgauccggggugcuuugggacaccccuucacccccagaagucgagcgcgcgguguuagaugacggaauuuaucggauaaugcagagaggucugcucggcaggagucagguugggguaggaguguuccaagaaaacgucuuucauacgauguggcacgugacucguggcgcuguuuugauguaccaggguaagcgccuggagccgagcugggccuccgugaaaaaggaccucaucucuuacgggggaggcuggcggcugcagggcucguggaauaccggggaggaaguccaggugauugcaguagagccuggcaaaaaucccaagaauguccaaacagccccagguaccuucaagacacccgaaggcgaggugggggcuaucgcccuugauuuuaaaccuggaacuagcggcucaccaauuguuaacagagaagguaagaucguggggcuguauggaaauggcgucgugaccacguccggcacauacguuagugcaauagcucaggccaaagcgucucaggaggggcccuugccugagaucgaagacgagguguucaggaagcgaaaccuaacuauuauggaucugcacccgggaagcgguaaaacccggcgcuaucucccagccaucgucagagaagcaauuaagaggaaguuacggacacugauccuugcucccacccgagugguagccuccgagauggcugaagcacugaaaggcaugccuauaagauaccaaacuaccgccgugaagucagagcauacagggaaagagauuguugaccucaugugccacgccacguuuacuaugcgcuugcugucuccagucagggugcccaauuauaacaugaucaucauggaugaagcucauuucaccgacccuagcaguauugcggcacguggauacaucuccacacgggugggcaugggugaggccgcugccauauuuaugaccgcaacuccgcccgggagcgucgaagccuucccacagucuaaugcuguaauucaggaugaggaaagagacaucccugagaggucauggaacuccggauaugaguggauuacagauuuucccggcaagaccgugugguucguuccaaguaucaaagcgggcaaugacauagccaacugucuccgcaagaaugggaagcgagugauucagcugagcagaaaaacguuugauacugaauaccaaaagaccaaaaacaacgacugggacuacgucgugaccaccgauaucucggagaugggagcaaauuuccgggcugacaggguuaucgauccucgccguugccuuaagcccgugauucuaaaagacgguccagaaagagucauccuggccggcccgaugccugugacuguagcaucugccgcucagcggagggggcgcauuggacgaaaccacaauaaggagggcgaucaguauauauacaugggucagcccuugaacaaugacgaggaucaugcccacuggacagaagcgaagauguuacuggacaacaucaauaccccagaggggauuauccccgcacucuucgaaccugagagagaaaaauccgccgcuaucgauggcgaguaucggcugaggggagaggcccgcaagacauuuguggaacuuaugagaaggggcgaccugccaguuuggcucagcuacaaagucgcuucagagggguuccaauauagugaucggcguuggugcuuugacggagaacgcaacaaucagguguuggaggaaaacauggauguggagauuuggacuaaggagggugaaagaaagaagcugagacccagguggcuagacgcacggacguacucugacccucuggcccuccgcgaguucaaagaauuugcugccggcagaagguccgucagcggggaucuuauacuggagaucggaaaguuaccgcagcacuugacccagcgggcacaaaaugcgcuggacaaccucguuaugcugcauaauucagaacagggcggucgagccuauagacacgcuauggaggagcuuccagauacaauugaaacucugaugcucuuggcccugaucgcaguguuaaccgggggcguaacacuauucuuucugaguggaaagggccucgggaaaaccagcauuggacuucugugugugauggcuuccucugucuugcuguggauggccagcguggagccccauuggaucgcagccuccauaauccucgaguucuuucugaugguucuucucauuccugagcccgaccgccagaggacuccacaggauaaccaacuggcuuacguggucaucgguuugcuguucaugauuuuaacgguagcggccaaugagaugggccuacuggaaaccacaaagaaagaccucgggaucggacacguggcaguugagaaccaccaucacgcugccaugcuugauguggaccugcauccugccucagcauggacuuuguacgcugucgccaccacaauaauuacccccaugaugcggcacacuaucgaaaacacaacggcgaauauuucucugaccgcuaucgccaaccaggcagccauacucaugggccuggauaaggguuggccaaucaguaaaauggacauuggggugccucuuuuagcucugggcugcuauucgcaggucaauccgcucacuuugacagcagccgugcugaugcuaguugcgcauuacgcuaucauuggacccggccugcaagccaaggcaacccgugaggcccagaagagaaccgcugccgggaucaugaaaaacccaacaauagauggaauuguggcaaucgaccucgauccuguaguguaugacgcuaaguuugaaaaacagcuuggccagaucaugcuguugauucuguguacuagccaaauccuccugaugaggacgaccugggccuuaugcgaguccauaacacuugcgacugguccccugaccacacucugggaggggucuccaggaaaguucuggaauaccacuauugccgucucaauggcaaacaucuuucgcggcagcuaccuagcuggugccggccuggcauucuccuugaugaaaagucuagggggaggccggcgagggacgggagcucagggcgaaacacucggugagaaguggaagagacagcuuaaucagcugucuaaaagcgaguucaacaccuauaagaggucagggauuauggaaguugaccgcuccgaagccaaagagggauugaagcggggcgagacuaccaaacacgccgugaguagagguacagcgaagcugcguugguuugucgaaaggaaucucgugaagccugagggcaaaguaaucgauuuaggguguggacggggcggguggagcuacuauugcgcuggacugaagaaagugacugaaguuaagggcuacaccaaaggugggcccggacacgaggaaccgauaccaauggcaacauacggcuggaaccuugugaagcugcauucuggcaaagacgucuucuuuaucccucccgagaagugugauacgcuacucugcgacauuggggaguccucaccaaaucccaccaucgaagagggacgcacucugcgaguguugaagauggucgaaccuuggcugagagguaaccaauucuguauuaaaauccucaauccguauaugcccagcgugguugagacacuugagcagaugcagaggaagcacggcgggaugcugguacggaacccauuaucgcgcaauucuacccaugaaauguacugggugaguugcggaacuggcaacauugucuccgccgugaauaugacaagcagaaugcuguugaacagguuuaccauggcucaccgaaaaccuacguaugagcgggauguugaccucggugccgggacccgucacguggcagucgaacccgagguggccaaccuggauaucauaggacagagaauugaaaauaucaagcaugagcacaaaucaacauggcauuacgacgaggauaacccuuauaagacuugggcuuaccacggcuccuaugaaguaaagccaucuggcagcgcgaguuccauggugaaugggguugucaaacuacuuaccaagcccugggacgugaucccuauggugacacaaauugccaugacugauaccacaccauucggacagcagcgcgucuuuaaagagaagguugacaccaggacucccaaagcaaagcgggguacggcucaaauaauggaagugacagccaaguggcuguggggcuuccucagcagaaacaaaaagccgcgcaucuguaccagggaggaauuuacucgaaaaguacggucuaaugcagccauuggggcuguguucgucgacgagaaccaguggaacucagccaaggaggcgguggaagaugacagauuuugggaucugguucauagggagcgcgaauugcacaaacagggaaagugcgcaaccugcguguacaacaugaugggcaagcgugagaaaaagcugggugaguucgggaaagccaagggaagucgggcuaucugguacauguggcucggcgccagauuucuugaguucgaggcacugggcuucaugaaugaagaccacugguuuuccagggagaacagcuuaucuggggucgaaggagagggucugcauaaauugggcuauauucuccgcgauaucucgaagauaccugggggaaauauguacgcugacgauacagccggcugggacacgcgaaucaccgaggaugaccugcagaacgaagcuaaaauuacugauaucauggagccagaacacgcccuacuugcaaagucaauuuucaagcugacauaucaaaauaaagugguacggguucagagacccgcgaagaacgguaccgugauggacgucaucagcaggcgcgaucagagaggguccggacaggugggcacuuacggccucaauacauuuaccaacauggaggcccaacugauacggcagauggaaagugaggggauuuucucuccuaacgaguuggaaacaccaaauuuagcugagagggugcuggacuggcucgaaaaauauggagucgagcgucuuaagcgaauggccaucagcggugacgauuguguugugaaacccaucgacgaucgcuuugcaacugcucugaccgcccuaaacgacaugggcaagguaagaaaggauauuccgcagugggaaccuuccaaaggguggaaugacuggcagcaagugcccuucugcucacaucacuuucaccagcugauaaugaaggauggacgggagaucgucgugccauguaggaaccaggacgagcucguuggccgcgcaagagugagucagggugccggguggucuuugcgggaaacggcgugccugggaaaaagcuacgcucaaauguggcagcuuauguauuuccauaggcgagaucugcgucucgccgcaaaugccauuuguuccgcugucccuguggacuggguacccaccucaagaacaacuuggagcauccacgcccaucaccaguggaugaccacagaggauauguuaucuguuuggaaccgcguguggauugaagagaauccauggauggaagacaagacucggaucuccaguugggaggacguccccuaccugggcaaaagggaggaucaauggugcggcagcuugauagggcugaccgcaagagcuacgugggccacaaacauccagguggcgauuaaucagguucgccggcucaucggaaacgaaaauuacucggacuauaugaccuccaugaagagguuuaagaacgagucugaaccugagggugcucuuugguga

SEQ ID NO: 13464 - RNA, 9879 nt, Artificial Sequence
  derived and/or modified CDS sequence (opt3) from DENV-1__FJ687428__SS-prME
agcgugacaaugcugcucaugcuuaugcccacagcacuggcuuuccacuugacuacgcgaggaggggagccucauaugaucgucuccaagcaggaaaggggaaaaucuuuacuguuuaagaccucagccgguguuaacaugugcacacugauugccauggaccucggagagcugugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuugcaccccaugucggacuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagccgggauuuuguggagggucuuaguggcgcgacuuggguagacguuguguuggagcacggguccugugucacaaccauggcaaaggauaaacccacucuggacaucgaacugcucaagacagaggugaccaacccugccgugcugaggaaacuuugcauugaagcuaagaucucuaauacgaccacagauagccgguguccaacucaaggagaggccacccuggucgaggaacaggacgcaaacuucguuugccgccgaacauuuguggauagaggcugggguaauggguguggauuguucggcaaaggcucccuccugacuugcgcuaaguuuaagugcguaaccaaauuagaggggaagauagugcaguacgaaaaccugaaauauucagucauugugacaguucacaccggagaccagcaucaaguggguaaugagaguacugaacacggcacgacagccaccaucacuccccaggcgccuaccacagagauucagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccaucuuugccggccaucugaaaugccgucuaaagauggauaaacucacacugaaggggauguccuaugugauguguacuggcagcuucaaacuugagaaggaagucgcugagacccagcacgguacgguguugguucagauuaaguacgagggcacagacgcgccuugcaaaauaccauucucgacccaagaugaaaagggggugacucagaacggacgccugaucacagcaaaucccauuguaaccgacaaagagaagccugucaacaucgaagccgagccacccuuuggcgagucuuauauagugauuggugcuggggaaaaagcccucaagcuguccugguucaagaaaggcucaaguaucggaaagauguuugaggcaacugccagaggcgcuaggcggauggccauccuuggggauaccgcaugggacuucggaagcauugguggcguuuuuacauccguggggaaacugguccaucagaucuucggaacggcguacggcguguuguuuucugguguaagcuggaccaugaagauugggauaggcgugcuccugacuugguuaggacuaaauucacgaaguacaucccuaagcaugaccuguaucgcuguuggccucgucacacuguaccuuggggugauggugcaggccgauucuggaugcgucauuaacuggaaaggccgcgaauugaagugugguucagggaucuucguuacuaaugaggugcacaccuggacggaacaauauaaguuucaggcagacaguccgaaaagacugagcgccgcuaucggaaaggccugggaggagggcgugugcgguauuagguccgcaacacggcucgaaaacauaauguggaaacagaucucuaacgagcugaaucauauuuuacuggaaaacgacaugaaguucaccguagucgugggcgauguugcugggauccuugcccagggcaaaaagaugauucgcccucaacccauggaguacaaauauucguggaaaagcuggggcaaggcgaaaaucauaggggccgacgugcaaaauuccacuuuuaucauugauggaccaaacaccccugaaugucccgacgaucagagagcuuggaauaucugggaggucgaggacuacggcuucgguauuuuuacaacuaacaucugguugaagcucagggauucauauacccaggugugcgaccaccgucugaugagugcagccauaaaagauucuaaggcuguucacgccgacaugggguacuggauugaaagcgagaaaaaugaaacauggaagcuagcaggagcguccuucaucgaggugaagacguguauuuggccaaaaucacauacccuguggagcaacggcguacucgaaucugagaugaucauacccaagaucuaugguggcccuauuucccaacacaauuaccggccaggguacuucacucagacagccggaccguggcaucugggcaaacuugaguuggauuuugaccugugcgaagggaccacugucgugguggaugagcacugcggaaaccgaggccccaguuuaagaacaaccacggucacugguaagaucauucacgaaugguguugcaggagcuguacccucccuccacugcgcuucagaggggaagacggaugcugguauggcauggagaucagacccguuaaagaaaaggaggaaaaucuugugaagucuaugguauccgcugguucaggcgagguggacaguuuuagccugggguugcucuguauaucgauuaugaucgaagaggucaugaggucccgcuggucucgaaaaaugcugaugacaggaacccuagccguguucuuucugcucaucaugggccagcugacuuggaacgaucuuauucgguugugcaucaugguuggggcaaaugcuagcgaccguaugggaaugggcacaaccuaccuggccuuaauggcaacauucaagaugagaccuauguuugccgugggucuccuguucaggcgccuuacuucacgggagguccugcuacucaccauugggcugaguuugguggcuuccguugaacugccaaacucuuuagaggaacucggagauggccuggcgaugggcauaaugauccuuaaacuguugacggacuuucaaagccaucagcucugggccacacugcuaucccugaccuucauuaagacuacccuuucacuccacuaugcauggaaaacaauggcuauggugcugagcaucgucaguuuguuuccccuguguuuaucuacuaccucccagaagacgacauggcucccgguacugcuugggagccugggaugcaagccuuugaccauguuccucauugccgagaauaaaaucugggguagaaagucguggccacugaacgaaggcauaauggccguggggaucguuucaauucuacugucuagucuucucaaaaacgaugugccccuggcuggaccuuugaucgcaggcgguauguuaauugccuguuacgucaucuccgggagcucugcggaccugagccucgagaaggcugccgagguguccugggaagaggaagcagagcauucaggagccagucacaauauacugguagaagugcaggaugacggcacuaugaaaauuaaggaugaggagagggacgauacacuuaccauccuguugaaagcuacucuacuggcagucagcggcguuuauccccucucuaucccagccacacuguuugugugguacuucuggcaaaagaagaaacagcgauccggggugcuuugggacaccccuucacccccagaagucgagcgcgcgguguuagaugacggaauuuaucggauaaugcagagaggucugcucggcaggagucagguugggguaggaguguuccaagaaaacgucuuucauacgauguggcacgugacucguggcgcuguuuugauguaccaggguaagcgccuggagccgagcugggccuccgugaaaaaggaccucaucucuuacgggggaggcuggcggcugcagggcucguggaauaccggggaggaaguccaggugauugcaguagagccuggcaaaaaccccaagaauguccaaacagccccagguaccuucaagacacccgaaggcgaggugggggcuaucgcccuugauuuuaaaccuggaacuagcggcucaccaauuguuaacagagaagguaagaucguggggcuguauggaaauggcgucgugaccacguccggcacauacguuagugcaauagcucaggccaaagcgucucaggaggggcccuugccugagaucgaagacgagguguucaggaagcgaaaccuaacuauuauggaucugcacccgggaagcgguaaaacccggcgcuaucucccagccaucgucagagaagcaauuaagaggaaguuacggacacugauccuugcucccacccgagugguagccuccgagauggcugaagcacugaaaggcaugccuauaagauaccaaacuaccgccgugaagucagagcauacagggaaagagauuguugaccucaugugccacgccacguuuacuaugcgcuugcugucuccagucagggugcccaauuauaacaugaucaucauggaugaagcucauuucaccgacccuagcaguauugcggcacguggauacaucuccacacgggugggcaugggugaggccgcugccauauuuaugaccgcaacuccgcccgggagcgucgaagccuucccacagucuaaugcuguaauucaggaugaggaaagagacaucccugagaggucauggaacuccggauaugaguggauuacagauuuucccggcaagaccgugugguucguuccaaguaucaaagcgggcaaugacauagccaacugucuccgcaagaaugggaagcgagugauucagcugagcagaaaaacguuugauacugaauaccaaaagaccaaaaacaacgacugggacuacgucgugaccaccgauaucucggagaugggagcaaauuuccgggcugacaggguuaucgauccucgccguugccuuaagcccgugauucuaaaagacgguccagaaagagucauccuggccggcccgaugccugugacuguagcaucugccgcucagcggagggggcgcauuggacgaaaccacaauaaggagggcgaucaguauauauacaugggucagcccuugaacaaugacgaggaucaugcccacuggacagaagcgaagauguuacuggacaacaucaauaccccagaggggauuauccccgcacucuucgaaccugagagagaaaaauccgccgcuaucgauggcgaguaucggcugaggggagaggcccgcaagacauuuguggaacuuaugagaaggggcgaccugccaguuuggcucagcuacaaagucgcuucagagggguuccaauauagugaucggcguuggugcuuugacggagaacgcaacaaucagguguuggaggaaaacauggauguggagauuuggacuaaggagggugaaagaaagaagcugagacccagguggcuagacgcacggacguacucugacccucuggcccuccgcgaguucaaagaauuugcugccggcagaagguccgucagcggggaucuuauacuggagaucggaaaguuaccgcagcacuugacccagcgggcacaaaaugcgcuggacaaccucguuaugcugcauaauucagaacagggcggucgagccuauagacacgcuauggaggagcuuccagauacaauugaaacucugaugcucuuggcccugaucgcaguguuaaccgggggcguaacacuauucuuucugaguggaaagggccucgggaaaaccagcauuggacuucugugugugauggcuuccucugucuugcuguggauggccagcguggagccccauuggaucgcagccuccauaauccucgaguucuuucugaugguucuucucauuccugagcccgaccgccagaggacuccacaggauaaccaacuggcuuacguggucaucgguuugcuguucaugauuuuaacgguagcggccaaugagaugggccuacuggaaaccacaaagaaagaccucgggaucggacacguggcaguugagaaccaccaucacgcugccaugcuugauguggaccugcauccugccucagcauggacuuuguacgcugucgccaccacaauaauuacccccaugaugcggcacacuaucgaaaacacaacggcgaauauuucucugaccgcuaucgccaaccaggcagccauacucaugggccuggauaaggguuggccaaucaguaaaauggacauuggggugccucuuuuagcucugggcugcuauucgcaggucaauccgcucacuuugacagcagccgugcugaugcuaguugcgcauuacgcuaucauuggacccggccugcaagccaaggcaacccgugaggcccagaagagaaccgcugccgggaucaugaaaaacccaacaauagauggaauuguggcaaucgaccucgauccuguaguguaugacgcuaaguuugaaaaacagcuuggccagaucaugcuguugauucuguguacuagccaaauccuccugaugaggacgaccugggccuuaugcgaguccauaacacuugcgacugguccccugaccacacucugggaggggucuccaggaaaguucuggaauaccacuauugccgucucaauggcaaacaucuuucgcggcagcuaccuagcuggugccggccuggcauucuccuugaugaaaagucuagggggaggccggcgagggacgggagcucagggcgaaacacucggugagaaguggaagagacagcuuaaucagcugucuaaaagcgaguucaacaccuauaagaggucagggauuauggaaguugaccgcuccgaagccaaagagggauugaagcggggcgagacuaccaaacacgccgugaguagagguacagcgaagcugcguugguuugucgaaaggaaucucgugaagccugagggcaaaguaaucgauuuaggguguggacggggcggguggagcuacuauugcgcuggacugaagaaagugacugaaguuaagggcuacaccaaaggugggcccggacacgaggaaccgauaccaauggcaacauacggcuggaaccuugugaagcugcauucuggcaaagacgucuucuuuaucccucccgagaagugugauacgcuacucugcgacauuggggaguccucaccaaaucccaccaucgaagagggacgcacucugcgaguguugaagauggucgaaccuuggcugagagguaaccaauucuguauuaaaauccucaauccguauaugcccagcgugguugagacacuugagcagaugcagaggaagcacggcgggaugcugguacggaacccauuaucgcgcaauucuacccaugaaauguacugggugaguugcggaacuggcaacauugucuccgccgugaauaugacaagcagaaugcuguugaacagguuuaccauggcucaccgaaaaccuacguaugagcgggauguugaccucggugccgggacccgucacguggcagucgaacccgagguggccaaccuggauaucauaggacagagaauugaaucaaucaagcaugagcacaaauccacauggcauuacgacgaggauaauccuuauaagacuugggcuuaccacggcucuuaugaaguaaagccaagcggcagugcguccagcauggugaacgggguugucaaacuacuuaccaagcccugggacgugaucccuauggugacacaaauugccaugacugauaccacaccauucggacagcagcgcgucuuuaaagagaagguugacaccaggacucccaaagcaaagcgggguacggcucaaauaauggaagugacagccaaguggcuguggggcuuccucucuagaaauaaaaagccgcgcaucuguaccagggaggaauuuacucgaaaaguacggucaaacgcagccauuggggcuguguucgucgacgagaaucaguggaacagugccaaggaggcgguggaagaugacagauuuugggaucugguucauagggagcgcgaauugcacaaacagggaaagugcgcaaccugcguguacaauaugaugggcaagcgugagaaaaagcugggugaguucgggaaagccaagggaucccgggcuaucugguacauguggcucggcgccagauuucuugaguucgaggcacugggcuucaugaacgaagaccacugguuuagcagggaaaauucuuuaucgggggucgaaggagagggucugcauaaauugggcuauauucuccgcgauaucucaaagauaccugggggaaacauguacgcugacgauacagccggcugggacacgcgaaucaccgaggaugaccugcagaaugaagcuaaaauuacugauaucauggagccagaacacgcccuacuugcaaagagcauuuucaagcugacauaucaaaacaaagugguacggguucagagacccgcgaagaaugguaccgugauggacgucaucuccaggcgcgaucagagagggaguggacaggugggcacuuacggccucaacacauuuaccaauauggaggcccaacugauacggcagauggaaucugaggggauuuucagcccuaacgaguuggaaacaccaaacuuagcugagagggugcuggacuggcucgaaaaauauggagucgagcgucuuaagcgaauggccaucuccggugacgauuguguugugaaacccaucgacgaucgcuuugcaacugcucugaccgcccuaaaugacaugggcaagguaagaaaggauauuccgcagugggaaccuucaaaaggguggaacgacuggcagcaagugcccuucugcagucaucacuuucaccagcugauaaugaaggauggacgggagaucgucgugccauguaggaaucaggacgagcucguuggccgcgcaagagugucucagggugccggguggagcuugcgggaaacggcgugccugggaaaauccuacgcucaaauguggcagcuuauguauuuccauaggcgagaucugcgucucgccgcaaacgccauuuguucagcugucccuguggacuggguacccaccagcagaacaacuuggucuauccacgcccaucaccaguggaugaccacagaggauauguuauccguuuggaaucgcguguggauugaagagaacccauggauggaagacaagacucggaucaguagcugggaggacguccccuaccugggcaaaagggaggaucaauggugcggcucguugauagggcugaccgcaagagcuacgugggccacaaauauccagguggcgauuaaccagguucgccggcucaucggaaaugaaaacuacuccgacuauaugaccucuaugaagagguuuaagaaugagucagaaccugagggugcucuuugguga

SEQ ID NO: 13465 - RNA, 9879 nt, Artificial Sequence
  derived and/or modified CDS sequence (opt3) from DENV-1__FJ687429__SS-prME
agcgugacaaugcugcucaugcuuaugcccacagcacuggcuuuccacuugacuacgagaggaggggaaccucauaugaucgucuccaagcaggaaagagggaaaucuuuacuguuuaagaccucagccgguguuaacaugugcacacugauugccauggaccucggagagcugugugaagauacuaugaccuacaaaugcccacggauaacagaggcggaaccggacgauguggacuguuggugcaaugcuaccgauacuuggguaacauaugggaccuguagucagacgggggagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggaucgacguuguuuuggagcacggguccuguauuacaaccauggcaaaggauaaacccacucuggacaucgaacuacucaagacagaggugaccaacccugccguccugaggaaacuuugcauagaagcuaagauuucuaauacgaccacagauagccgguguccaacucaaggagaggccacccugguggaagaacaggacgcaaacuucgugugccgccgaacauuugucgauagaggcugggguaauggguguggauuguucggcaaaggcucccuccugacuugcgcuaaguuuaagugcguuaccaaauuagaggggaagaucgugcaguacgaaaaccugaaauauucaguaauugugacaguccacaccggagaccagcaucaaguggguaaugagaguacugaacacggcacgacagccaccaucacuccccaggcgccuaccacagagauccagcucaccgacuacggggcccuuacucuggauuguagcccaaggacaggauuggacuucaacgaaaugguucuacugacgaugaaggagaaaucuuggcucgugcauaagcagugguuucuggaucuuccgcugcccuggaccuccggcgcaucaacuagccaagagacauggaaucggcaggacuugcucgucaccuucaaaacagcucacgccaagaagcaggaagugguaguucuggguagucaagagggggcuaugcacacugccuuaaccggcgcaacggaaauucagaccucuggaacaacuaccauauuugccggccaucugaaaugccgucuaaagauggauaaacucacacugaaggggauguccuaugugauguguacuggcagcuucaaacuugagaaggaagucgcugagacccagcacgguacgguguugguccagaucaaguacgagggcacagacgcgccuugcaaaauuccauucucgacccaagaugaaaagggggugacucagaacggacgccugaucacagcaaaucccauaguuaccgacaaagagaagccugugaacauugaagccgagccacccuuuggcgagucuuauaucguaaucggugcuggggaaaaagcccucaagcuguccugguucaagaaaggcucaaguauuggaaagauguuugaggcaacugccagaggcgcuaggcggauggccauccuuggggauaccgcaugggacuucggaagcauugguggcgucuuuacauccguggggaaacugguucaucagauauucggaacggcguacggcguguuguuuucuggugucagcuggaccaugaagaucgggauuggcgugcuccugacuugguuaggacuaaauucacgaaguacaucccuaagcaugaccuguaucgcuguaggccucgugacacuguaccuugggguuaugguccaggccgauucuggaugcgugaucaacuggaaaggccgcgaauugaagugugguucagggauuuucgugacuaaugagguccacaccuggacggaacaauauaaguuucaggcagacaguccgaaaagacugagcgccgcuauaggaaaggccugggaggagggcguuugcgguaucagguccgcaacacggcucgaaaacauuauguggaaacagaucucuaacgagcugaaucauauuuuacuggaaaacgacaugaaguucaccguggugguaggcgaugucgcugggauccuugcccagggcaagaagaugauacgcccucaacccauggaguacaaauauucguggaaaagcuggggcaaggcgaagaucauuggggccgacgugcaaaauuccacuuuuaucauugauggaccaaacaccccugaaugucccgacgaucagagagcuuggaauaucugggagguugaggacuacggcuucgguauauuuacaacuaacauuugguugaagcucagggauucauauacccaggugugcgaccaccgucugaugagugcagccaucaaagauucuaaggcuguccacgccgacaugggguacuggauugaaagcgagaaaaaugaaacauggaagcuagcacgggcguccuucaucgaggugaagacguguauauggccaaaaucacauacccuguggagcaacggaguucucgaaucugagaugaucauucccaagaucuauggcgguccuauuucccaacacaauuaccgaccaggcuacuucacucagacagccgggccguggcaucugggaaaacuugaguuggauuuugaccugugcgaaggcaccacugugguagucgaugagcacugcgggaacagaggacccaguuuaaggacaaccacggugacuggcaagaucauacacgaaugguguugccgcagcuguacccucccuccacugcgguucagaggugaggacgggugcugguauggaauggagauuaggcccgugaaagaaaaggaggaaaaucuugucaagucuaugguuuccgcuggcucaggugagguggacaguuuuagccugggcuugcucuguaucucgaucaugauugaagagguaaugcgcucccgauggucucggaaaaugcugaugacagggacccuagccguguucuuucugcucaucaugggacagcugacuuggaacgaucuuauucguuugugcauaauggucggcgcaaaugcuagcgacagaauggggaugggaacaaccuaccuggccuuaauggcaacauucaagaugaggccuauguuugccgugggccuccuguuccgccggcuuacuucaagagagguucugcuacucaccaucggucugaguuugguggcuuccgucgaacugccaaacucuuuagaggaacucggggauggacuggcgaugggcauuaugauccuuaaacuguugacggacuuucaaagccaucagcucugggccacacugcuaucccugaccuucauuaagacuaccuuuucacuucacuaugcauggaaaacaauggcuauggugcucagcaucguuagucuguuccccuugugucugucuacuaccucccagaagacgacaugguuaccggugcuccugggcagccuugggugcaagccucugaccauguuuuugauagccgagaauaaaaucuggggaaggaagucguggccacucaacgaagguauuauggccgucggcaucguaucaauucugcuaucuagucugcuuaaaaacgaugugccccucgcugggccucugaucgcaggaggcauguugauagccuguuacguuauuuccgguagcucugcggacuuaagccuggagaaggcugccgagguguccugggaagaggaagcagagcauucaggggccagucacaauauccucgucgaagugcaggaugacggaacuaugaaaaucaaggaugaggagcgagacgauacacugaccauucuucugaaagcuacuuugcuagcaguaagcggcguguauccccugucuauaccagccacacucuucgucugguacuucuggcaaaagaagaaacagcgcuccggcguucugugggacaccccuucacccccagaaguggagcgggcggugcuugaugacgggaucuauagaauuaugcagaggggauuacugggucguagucaggucggcguggggguuuuucaagaaaacguauuccauacgauguggcacgugacucgcggagcuguccucauguaccagggcaagcgguuggagccgagcugggccuccgugaaaaaggaccugaucucuuacggugggggauggagacuccagggcucguggaauaccggcgaggaaguucaggugauugcagucgagccugggaaaaaccccaagaaugugcaaacagccccaggaaccuuuaagacacccgaaggugagguaggcgcuaucgcccuggauuucaaaccugggacuagcggaucaccaauagucaacagggaaggcaagaucgugggucuuuaugggaauggaguugugaccacguccggcacauacgucagugcaauugcucaggccaaagcgucucaggagggcccccugccugagaucgaagacgagguguuucgaaagcggaacuugacuauuauggaucuacacccggggagcggaaaaacccgcagauaucugccagccaucguuagggaagcaauaaagcggaagcuccgaacauuaauucuggcucccaccagaguggucgccuccgagauggcugaagcacuuaaagguaugccuauccgcuaccaaacuaccgccgugaagucagagcauacaggcaaagagaucguagaccugaugugccacgccacguucacuaugaggcucuugucuccagugcguguucccaauuauaacaugauuaucauggaugaagcucauuuuaccgacccuagcaguauagcggcacggggguacauuuccacaagagucggaaugggcgaggccgcugccaucuucaugaccgcaacuccgcccgguagcguggaagccuuuccacagucuaaugcugugauucaggaugaggaaagggacaucccugagcgcucauggaacuccggguaugaguggauaacagauuuccccggaaagaccgucugguuuguaccaaguauuaaagcgggcaaugacaucgccaacugucugcgaaagaauggcaagagagugauccagcucagccggaaaacguucgauacugaauaccaaaagaccaagaauaacgacugggacuacguugugaccaccgauauuucggagaugggggcaaauuucagggcugaccgcgucaucgauccucguagaugccugaagcccgugauucuuaaagacggaccagaacggguuauacuagccgguccgaugccugugacugucgcaucugccgcucagaggcgcggccgaaucgggagaaaccacaauaaggagggagaucaguauauuuacaugggccagccccugaacaaugacgaggaucaugcccacuggacagaagcgaagauguuguuagacaacaucaauaccccagaggguaucauucccgcacuguuugaaccugagcgggaaaaauccgccgcuauagauggggaguauaggcuccgcggcgaggccagaaagacauucguggaacugaugaggcggggagaccuuccaguauggcugagcuacaaaguggcuucagagggcuuucaauauagugaucgucgcuggugcuucgacggggaacgaaacaaucagguucucgaggaaaacauggaugucgagaucuggacuaaggagggagaaaggaaaaaguugaggccccgguggcuggacgcacgcacguacucugacccucuagcccugagagaguuuaaagaguucgcugccgguaggcgguccgugagcggcgaucucauucuugagaucgggaagcugccgcagcacuuaacccagcgagcacaaaaugcguuggacaaccuggugaugcuccauaauucagaacagggaggcagagccuaucgccacgcuauggaggagcugccagauacaauugaaacucuuaugcugcucgccuugaucgcaguccugaccggugggguuacauuauuuuuccuaaguggcaagggacugggcaaaaccagcauagggcuccuuugugugauggcuuccucuguacuguuguggauggccagcguggagccccauuggaucgcagccuccauuauccuggaauuuuuccucaugguccugcuuauuccugagcccgacaggcagcggacuccacaggauaaccaacucgcuuacgugguuaucggacuguuguuuaugauacugacgguggcggccaaugagauggguuuacuagaaaccacaaagaaagaccugggcauugggcacgucgcaguagagaaccaccaucacgcugccaugcucgauguggaccuucauccugccucagcauggacucuguacgcuguugccaccacaaucauuacccccaugaugcgucacacuaucgaaaacacaacggcgaauauaucuuugaccgcuaucgccaaccaggcagccauucugaugggacucgauaagggcuggccaaucaguaaaauggacauuggugugccucugcuugcuuuagggugcuauucgcaggucaauccgcugacucucacagcagccguguugaugcuggucgcgcauuacgcuaucauaggccccggacuacaagccaaggcaaccagagaggcccagaagaggaccgcugccggcauuaugaaaaacccaacaaucgaugggaucguggcaauugaccuggauccuguuguguaugacgcuaaguucgaaaaacagcucggacagaucaugcuucugauauuguguacuagccaaauucugcucaugcgcacgaccugggcccugugcgaguccaucacauuagcgacuggcccccuuaccacacugugggaggguucuccagggaaguuuuggaauaccacuauugccguaucaauggcaaacaucuuccggggaagcuaccucgcuggcgccggucuagcauucucccugaugaaaaguuugggcgggggacgaagaggcacgggggcucagggagaaacacugggcgagaaguggaagaggcagcucaaucagcuuucuaaaagcgaauuuaacaccuauaagcgcucagguauaauggagguggaccgguccgaagccaaagaggggcugaagagaggagagacuaccaaacacgccgucagucguggcacagcgaaguugaggugguucguugaacggaaucuggugaagccugaggguaaagucaucgaucucggcugugggcgcggaggcuggagcuacuauugcgcuggguuaaagaaagugacugaaguaaagggauacaccaaaggcggucccgggcacgaggaaccgauuccaauggcaacauacggauggaaccuggugaaacuucauucuggcaaagacguauuuuucaucccucccgagaagugugauacgcugcuaugcgacauuggcgaguccucaccaaaucccaccaucgaagaggggcgaacucucagagugcugaagauggucgaaccuugguugaggggaaaccaauuuuguauuaaaauccugaauccguauaugcccagcguggucgagacacucgagcagaugcagcggaagcacgguggcaugcuugugcgcaacccacugucgagaaauucuacccaugaaauguacuggguuaguugcgggacuggaaacauaguauccgccgugaauaugacaagcaggauguuacugaaccgauucaccauggcucaccggaaaccuacguaugagcgugaugucgacuugggcgccgguaccagacacguggcaguugaacccgagguggccaaccucgauauuaucgggcagcgcaucgaaaauauuaagcaugagcacaaaucaacauggcauuacgacgaggauaacccuuauaagacuugggcuuaccacggauccuaugaagucaagccaucuggcagcgcgaguuccauggugaauggcguagugaaacugcuaaccaagcccugggacguuauaccuauggucacacaaaucgccaugacugauaccacaccauuugggcagcagaggguguucaaagagaagguggacacccggacucccaaagcaaagagaggaacggcucaaauuauggaagucacagcccgcuggcuuugggguuuucugagcaggaacaagaaaccgcgaaucuguacccgggaggaguucacuagaaagguuaggucuaaugcagccauuggcgcuguguuuguagacgagaaccaguggaacucagccaaagaggcgguggaagaugaccgcuucugggaucucguccaucgugagcgggaacugcacaagcaggggaaaugcgcaaccugcguguacaacaugaugggaaagagagagaagaaauugggcgaauuugguaaggccaaagggaguagggcuaucugguacauguggcugggagcccgcuuccucgaguucgaggcacuuggcuuuaugaaugaagaccacugguucucccgagagaacagccugucuggcguugaaggggagggauuacauaagcuggguuauauauugcgggauaucucgaaaauuccuggcgggaauauguacgcugacgauacagccggaugggacacgagaaucaccgaggaugaccuccagaacgaagcuaagauuacugauaucauggagccagaacacgcccugcuagcaaaaucaauauuuaaacuuacauaucaaaauaagguggucagggugcagcgccccgcgaaaaacggcaccguaauggacguuauuagcagacgggaucagagggguuccggacaggugggaacuuacggccugaauacauucaccaacauggaggcccaacucauccgucagauggaaagugagggcaucuuuucuccuaacgagcuggaaacaccaaauuuggcugagcgagucuuagacuggcuggaaaaguaugggguggagcgccucaaaagaauggccauuagcggagacgauuguguggucaagcccauagacgaucgguucgcaacugcucuuaccgcccugaacgacauggguaaaguuaggaaggauaucccgcagugggaaccuuccaagggcuggaaugacuggcagcaagugcccuuuugcucacaucacuuccaccagcuaauuaugaaagaugggcgcgagaucguagugccauguagaaaccaggacgagcuggucggacgggcaagggugagucagggcgccgguuggucucuccgagaaacggcgugcuugggaaagagcuacgcucaaauguggcagcugauguauuuucaucguagagaucuucgccuggccgcaaaugccauuuguuccgcuguuccuguggacuggguccccaccucacggacaacuuggagcauccacgcccaucaccaguggaugaccacagaggauaugcucucuguguggaacaggguauggauagaagagaauccauggauggaagacaaaacuagaaucuccaguugggaggacguucccuacuuaggaaagcgcgaggaucaauggugcggcagccugauuggcuugaccgcacgggcuacgugggccacaaacauccagguggcgauuaaucaggucaggcgacugaucgggaacgaaaauuacucggacuauaugaccuccaugaaaagauucaagaacgagucugaaccugagggagcucucugguga

SEQ ID NO: 13466 - RNA, 9879 nt, Artificial Sequence
  derived and/or modified CDS sequence (opt3) from DENV-1__FJ850068__SS-prME
agcgugacaaugcugcucaugcuuaugcccacagcacuggcuuuccacuugacuacgcgaggaggggagccucauaugaucgucuccaagcaggaaaggggaaaaucuuuacuguuuaagaccucagccgguguuaacaugugcacauugauugccauggaccucggagagcugugugaagauacuaugaccuacaaaugcccacggauuacagaggcggaaccggacgauguggacuguuggugcaaugcuaccgauacuuggguaacauaugggaccuguagucagacgggagagcaccgccgagacaagcguagcguggcccuugcaccccaugucggacuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagccgggauuuuguggagggucuuaguggcgcgacuuggguagacguuguguuggagcacggguccugugucacaaccauggcaaaggauaaacccacucuggacaucgaacugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccuccugacuugcgcuaaguuuaagugcguaaccaaauuagaggggaagauagugcaguacgaaaaccugaaauauucagucauugugacaguucacaccggagaccagcaucaaguggguaaugagaguacugaacacggcacgacagccaccaucacuccccaggcgccuaccacagagauucagcucaccgacuacggggcccuuacucuggauuguagcccaaggacaggauuggacuucaacgaaaugguccuacugacgaugaaggagaaaucuuggcucgugcauaagcagugguuucuggaucuuccgcugcccuggaccuccggcgcaucaacuagccaagagacauggaaucggcaggacuugcucguaaccuucaaaacagcucacgccaagaagcaggaaguugugguccuggguagucaagagggggcuaugcacacugccuuaaccggcgcaacggaaauccagaccucuggaacaacuaccaucuuugccggccaucugaaaugccgucuaaagauggauaaacucacacugaaggggauguccuaugugauguguacuggcagcuucaaacuugagaaggaagucgcugagacccagcacgguacgguguugguucagauuaaguacgagggcacagacgcgccuugcaaaauaccauucucgacccaagaugaaaagggggugacucagaacggacgccugaucacagcaaaucccauuguaaccgacaaagagaagccugucaacaucgaagccgagccacccuuuggcgagucuuauauagugauuggugcuggggaaaaagcccucaagcuguccugguucaagaaaggcucaaguaucggaaagauguuugaggcaacugccagaggcgcuaggcggauggccauccuuggggauaccgcaugggacuucggaagcauugguggcguuuuuacauccguggggaaacugguccaucagaucuucggaacggcguacggcguguuguuuucugguguaagcuggaccaugaagauugggauaggcgugcuccugacuugguuaggacuaaauucacgaaguacaucccuaagcaugaccuguaucgcuguuggccucgucacacuguaccuuggggugauggugcaggccgauucuggaugcgucauuaacuggaaaggccgcgaauugaagugugguucagggaucuucguuacuaaugaggugcacaccuggacggaacaauauaaguuucaggcagacaguccgaaaagacugagcgccgcuaucggaaaggccugggaggagggcgugugcgguauuagguccgcaacacggcucgaaaacauaauguggaaacagaucucuaacgagcugaaucauauuuuacuggaaaacgacaugaaguucaccguagucgugggcgauguugcugggauccuugcccagggcaagaagaugauucgcccucaacccauggaguacaaauauucguggaaaagcuggggcaaggcgaaaaucauaggggccgacgugcaaaauuccacuuuuaucauugauggaccaaacaccccugaaugucccgacgaucagagagcuuggaauaucugggaggucgaggacuacggcuucgguauuuuuacaacuaacaucugguugaagcucagggauucauauacccaggugugcgaccaccgucugaugagugcagccauaaaagauucuaaggcuguucacgccgacaugggguacuggauugaaagcgagaaaaaugaaacauggaagcuagcaggagcguccuucaucgaggugaagacguguauuuggccaaaaucacauacccuguggagcaacggcguacucgaaucugagaugaucauacccaagaucuaugguggcccuauuucccaacacaauuaccggccaggguacuucacucagacagccggaccguggcaucugggcaaacuugaguuggauuuugaccugugcgaagggaccacugucgugguggaugagcacugcggaaaccgaggccccaguuuaagaacaaccacggucacugguaagaucauucacgaaugguguugcaggagcuguacccucccuccacugcgcuucagaggggaagacggaugcugguauggcauggagaucagacccguuaaagaaaaggaggaaaaucuugugaagucuaugguauccgcugguucaggcgagguggacaguuuuagccugggguugcucuguauaucgauuaugaucgaagaggucaugaggucccgcuggucucgaaaaaugcugaugacaggaacccuagccguguucuuucugcucaucaugggccagcugacuuggaacgaucuuauucgguugugcaucaugguuggggcaaaugcuagcgaccguaugggaaugggcacaaccuaccuggccuuaauggcaacauucaagaugagaccuauguuugccgugggucuccuguucaggcgccuuacuucacgggagguccugcuacucaccauugggcugaguuugguggcuuccguugaacugccaaacucuuuagaggaacucggagauggccuggcgaugggcauaaugauccuuaaacuguugacggacuuucaaagccaucagcucugggccacacugcuaucccugaccuucauuaagacuaccuuuucacuucacuaugcauggaaaacaauggcuauggugcucagcaucgucagucuguuccccuugugucugucuacuaccucccagaagacgacaugguuaccgguacuccuggggagccuuggaugcaagccucugaccauguuuuugauugccgagaauaaaaucugggguagaaagucguggccacucaacgaaggcauaauggccguggggaucguuucaauucugcuaucuagucugcuuaaaaacgaugugccccucgcuggaccucugaucgcaggcgguauguugauugccuguuacgucaucuccgggagcucugcggacuuaagccuggagaaggcugccgagguguccugggaagaggaagcagagcauucaggagccagucacaauauacucguagaagugcaggaugacggcacuaugaaaauuaaggaugaggagagggacgauacacugaccauccuucugaaagcuacuuugcuagcagucagcggcguuuauccccugucuaucccagccacacucuucgugugguacuucuggcaaaagaagaaacagcgauccggggugcugugggacaccccuucacccccagaagucgagcgcgcggugcuugaugacggaauuuaucggauaaugcagagagguuuacugggcaggagucagguugggguaggaguguuucaagaaaacgucuuccauacgauguggcacgugacucguggcgcuguucucauguaccaggguaagcgcuuggagccgagcugggccuccgugaaaaaggaccugaucucuuacgggggaggcuggcggcuccagggcucguggaauaccggggaggaaguccaggugauugcaguagagccuggcaagaaucccaagaauguccaaacagccccagguaccuuuaagacacccgaaggcgaggugggggcuaucgcccuggauuucaaaccuggaacuagcggcucaccaauuguuaacagagaagguaagaucguggggcuuuauggaaauggcgucgugaccacguccggcacauacguuagugcaauagcucaggccaaagcgucucaggaggggccccugccugagaucgaagacgagguguuuaggaagcgaaacuugacuauuauggaucuacacccgggaagcgguaaaacccggcgcuaucugccagccaucgucagagaagcaauuaagaggaagcuccggacauuaauccuggcucccacccgagugguagccuccgagauggcugaagcacuuaaaggcaugccuauaagauaccaaacuaccgccgugaagucagagcauacagggaaagagauuguugaccugaugugccacgccacguucacuaugcgccucuugucuccagucagggugcccaauuauaacaugaucaucauggaugaagcucauuuuaccgacccuagcaguauugcggcacguggauacaucuccacacgggugggcaugggugaggccgcugccauauucaugaccgcaacuccgcccgggagcgucgaagccuuuccacagucuaaugcuguaauucaggaugaggaaagagacaucccugagaggucauggaacuccggauaugaguggauuacagauuuccccggcaagaccgugugguuuguuccaaguaucaaagcgggcaaugacauagccaacugucugcgcaagaaugggaagcgagugauucagcucagcagaaaaacguucgauacugaauaccaaaagaccaaaaacaacgacugggacuacgucgugaccaccgauaucucggagaugggagcaaauuuccgggcugacaggguuaucgauccucgccguugccugaagcccgugauucuuaaagacgguccagaaagagucauccuagccggcccgaugccugugacuguagcaucugccgcucagcggagggggcgcauuggacgaaaccacaauaaggagggcgaucaguauauauacaugggucagccccugaacaaugacgaggaucaugcccacuggacagaagcgaagauguuguuagacaacaucaauaccccagaggggauuauccccgcacuguuugaaccugagagagaaaaauccgccgcuaucgauggcgaguaucggcucaggggagaggcccgcaagacauucguggaacugaugagaaggggcgaccuuccaguuuggcugagcuacaaagucgcuucagagggguuucaauauagugaucggcguuggugcuucgacggagaacgcaacaaucaggugcucgaggaaaacauggauguggagauuuggacuaaggagggugaaagaaagaaguugagacccagguggcuggacgcacggacguacucugacccucuagcccugcgcgaguuuaaagaguucgcugccggcagaagguccgucagcggggaucucauacuugagaucggaaagcugccgcagcacuuaacccagcgggcacaaaaugcguuggacaaccugguuaugcuccauaauucagaacagggcggucgagccuauagacacgcuauggaggagcugccagauacaauugaaacucuuaugcugcucgccuugaucgcagugcugaccgggggcguaacauuauuuuuccuaaguggaaagggccuggggaaaaccagcauuggacuccuuugugugauggcuuccucuguccuguuguggauggccagcguggagccccauuggaucgcagccuccauaauccuggaauuuuuccucaugguucugcuuauuccugagcccgaccgccagaggacuccacaggauaaccaacucgcuuacguggucaucggucuguuguuuaugauucugacgguagcggccaaugagaugggcuuacuagaaaccacaaagaaagaccuggggaucggacacguggcaguugagaaccaccaucacgcugccaugcucgauguggaccuucauccugccucagcauggacucuguacgcugucgccaccacaauaauuacccccaugaugcggcacacuaucgaaaacacaacggcgaauauuucuuugaccgcuaucgccaaccaggcagccauacugaugggccucgauaaggguuggccaaucaguaaaauggacauuggggugccucugcuugcuuuaggcugcuauucgcaggucaauccgcugacucucacagcagccguguugaugcugguugcgcauuacgcuaucauuggacccggccuacaagccaaggcaacccgugaggcccagaagagaaccgcugccgggaucaugaaaaacccaacaauagauggaauuguggcaaucgaccuggauccuguaguguaugacgcuaaguucgaaaaacagcucggccagaucaugcuucugauuuuguguacuagccaaauccugcucaugaggacgaccugggcccugugcgaguccauaacauuagcgacugguccccuuaccacacugugggaggggucuccaggaaaguuuuggaauaccacuauugccgucucaauggcaaacaucuuccgcggcagcuaccucgcuggugccggccuagcauucucccugaugaaaagucuagggggaggccggcgagggacgggagcucagggcgaaacacugggugagaaguggaagagacagcucaaucagcuuucuaaaagcgaauuuaacaccuauaagaggucagggauuauggagguugaccgcuccgaagccaaagagggacugaagcggggcgagacuaccaaacacgccgugaguagagguacagcgaaguugcguugguucgucgaaaggaaucuggugaagccugagggcaaaguaaucgaucucggguguggacggggcggguggagcuacuauugcgcuggauuaaagaaagugacugaaguuaagggcuacaccaaaggugggcccggacacgaggaaccgauaccaauggcaacauacggcuggaaccuggugaaacuucauucuggcaaagacgucuuuuucaucccucccgagaagugugauacgcugcuaugcgacauuggggaguccucaccaaaucccaccaucgaagagggacgcacucuccgagugcugaagauggucgaaccuugguugagagguaaccaauuuuguauuaaaauccugaauccguauaugcccagcgugguugagacacucgagcagaugcagaggaagcacggcgggaugcuuguacggaacccacugucgcgcaauucuacccaugaaauguacugggugaguugcggaacuggcaacauugucuccgccgugaauaugacaagcagaauguuacugaacagguucaccauggcucaccgaaaaccuacguaugagcgggauguugacuugggugccgggacccgucacguggcagucgaacccgagguggccaaccucgauaucauaggacagagaauugaaaauaucaagcaugagcacaaaucaacauggcauuacgacgaggauaacccuuauaagacuugggcuuaccacggcuccuaugaaguaaagccaucuggcagcgcgaguuccauggugaaugggguugucaaacugcuaaccaagcccugggacgugaucccuauggugacacaaauugccaugacugauaccacaccauuuggacagcagcgcgucuucaaagagaagguugacaccaggacucccaaagcaaagcgggguacggcucaaauaauggaagugacagccagauggcuuuggggcuuucugagccgcaacaagaaaccgaggaucuguacccgagaggaguucacucggaagguaagaucuaaugcagccauuggggcuguguuugucgacgagaaccaguggaacucagccaaagaggcgguggaagaugacagguucugggaucucguucaucgcgagcgugaacugcacaagcagggaaaaugcgcaaccugcguguacaacaugaugggcaagcgggagaagaaauugggugaauuugggaaggccaaaggaaguagagcuaucugguacauguggcugggcgccagguuccucgaguucgaggcacuuggcuuuaugaaugaagaccacugguucucccgcgagaacagccugucuggggucgaaggagaggguuuacauaagcugggcuauauuuugcgagauaucucgaaaauaccugggggaaauauguacgcugacgauacagccggcugggacacgcggaucaccgaggaugaccuccagaacgaagcuaagauuacugauaucauggagccagaacacgcccugcuagcaaaaucaauuuuuaaacuuacauaucaaaauaaggugguaagaguucagaggcccgcgaaaaacgguaccgugauggacgucaucagccgcagagaucagcggggguccggacaggugggcacuuacggccugaauacauucaccaacauggaggcccaacucauaaggcagauggaaagugaggggauauuuucuccuaacgagcuggaaacaccaaauuuggcugagcguguguuagacuggcuggaaaaguauggagucgagcgacucaaacgcauggccaucagcggugacgauuguguugugaagcccaucgacgauagauucgcaacugcucuuaccgcccugaacgacaugggcaaaguacggaaggauauuccgcagugggaaccuuccaagggguggaaugacuggcagcaagugcccuuuugcucacaucacuuccaccagcuaauaaugaaagauggaagggagaucgucgugccaugucgcaaccaggacgagcugguuggcagagcacgggugagucagggugccggguggucucucagggaaacggcgugcuugggaaagagcuacgcucaaauguggcagcugauguauuuucaucgacgugaucuuagacuggccgcaaaugccauuuguuccgcugucccuguggacuggguacccaccucacgcacaacuuggagcauccacgcccaucaccaguggaugaccacagaggauaugcucucuguuuggaaccggguguggauugaagagaauccauggauggaagacaaaacuaggaucuccaguugggaggacguccccuacuuaggcaagagagaggaucaauggugcggcagccugauaggguugaccgcacgcgcuacgugggccacaaacauccagguggcgauuaaucagguucggaggcugaucggaaacgaaaauuacucggacuauaugaccuccaugaaacgauucaagaacgagucugaaccugagggugcucucugguga

SEQ ID NO: 13467 - RNA, 9879 nt, Artificial Sequence
  derived and/or modified CDS sequence (opt3) from DENV-1__FJ687430__SS-prME
agcgugaccaugcugcucaugcuuaugcccacagcccuggcuuuccacuugacuacgagaggcggggaaccucauaugaucgucuccaagcaggaaaggggaaaaucuuuacuguuuaagaccucaacagguguuaacaugugcacuuuaauugccauggaccucggcgaacugugugaagauaccaugacauacaaaugcccacggauaaccgaggccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaagguggaaaccugggcccucaggcacccuggauucacaguuauugcucuguuucuggcacaugccaucggcaccucgauuacgcagaagggcaucauauucauccucuuaaugcuggugacuccaucaauggcuaugcggugcgucgggauuggaagccgcgauuuuguggagggucuuaguggcgccacauggguagacguuguguuggagcacggguccugugucaccacuauggcgaaagauaagcccacacuggacaucgaacuacucaaaaccgaggugacgaacccugcagugcugagaaaacuuugcauugaagccaaaaucucuaauaccacaacugauuccagguguccaacccaaggagaggcuacacuggucgaagaacaggacgccaacuucguuugccggcgcacuuuuguggaucgaggcugggguaauggguguggauuguucggcaagggcagccucauaaccugcgcaaaguuuaaaugcguaacaaagcuggaggggaaaauugugcaguacgaaaacuuaaaguauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaagaacgggacuggacuucaacgaaauggucuugcuaaccaugaaagagaagucuuggcuggugcauaaacagugguuucucgaucugccgcuucccuggacuuccggcgccucaacaagccaagagaccuggaauaggcaggaccuguugguaacauucaagacugcacacgcuaagaaacaggaaguugugguccucgguagucaagagggggccaugcacaccgcucugacgggcgccaccgaaauccagacaucuggaacuaccacaauuuuugcaggccauuuaaagugccggcugaaaauggauaagcuaacucucaaagggauguccuaugugauguguaccggguccuucaagcuggagaaggaagucgccgagacgcagcacgguacaauacuugugcagaucaaauacgagggcaccgacgcuccuugcaagauuccauucucgacucaagaugaaaaagggguuacacagaacggacguuugaucaccgcgaaucccauagugacugacaaggagaaaccuguaaacauugaagcagagccacccuuuggcgagucuuauaucgucaucggugccggggaaaaggcucugaagcucuccugguucaaaaagggcucaaguauuggaaaaauguuugaggccaccgcacgcggcgccagaaggauggcuauccugggggauacagccugggacuucggaagcauugguggcguguuuacguccguugggaaacuugugcaucagauauucggaaccgcauacggcguccuguuuucuggugugagcuggacuaugaaaaucgggauuggcguauugcucacauggcugggauuaaauucacggaguaccucccugagcaugacauguaucgcggugggccuaguuacucucuaccugggggucauggugcaggcugauucuggaugcgugaucaacuggaagggccgagaacuuaagugugguucagggauuuucgucaccaaugagguucacacguggacagaacaauauaaauuucaggccgacaguccgaagcgcuugagcgcagccauaggaaaggcuugggaggagggcgugugcgguaucagauccgccaccaggcuggaaaacauuauguggaagcagaucucuaacgagcucaaucauauucuguuagaaaacgacaugaaauucacugugguagucggcgauguggcagggauccuggcucagggaaagaaaaugauacggccucaacccauggaguacaaguauucguggaaaagcuggggcaaggccaagaucauuggggcggacguucagaaugccaccuuuaucauugauggaccaaacacaccugaaugucccgacgaucagcgcgcuuggaauaucugggagguggaggacuacggcuucgguauauuuacuaccaacauuuggcuuaaauugagagauuccuauacacaggucugcgaccacaggcucaugucagcagccaucaaggauaguaaagcugugcacgccgacaugggguacuggauugaaucugagaagaaugaaacguggaagcuggcacgugcgagcuucaucgagguuaaaaccuguauauggccaaagucccauacucuauggucaaacggagugcuggaaagcgagaugaucauucccaaaaucuauggcgguccuauuucucaacacaauuaccggccaggcuacuucacacagaccgccgggccguggcaucucggaaagcuggagcuugauuuugacuugugcgaaggcacuacaguagucguggaugagcacugcgggaaccgaggacccucccugagaaccacgacugugaccggcaaaaucauacacgaaugguguugcaggaguuguacauuaccuccacuccgcuuccggggugaggacgggugcugguauggaauggagauuagacccgucaaggaaaaggaggaaaaucugguuaaaagcauggugucugcuggcuccggugagguagacucauuuagucuuggccuguuguguaucagcaucaugauugaagaggugaugaggucgcgcuggucccgaaagaugcucaugaccgggacucuggccgucuucuuucuacugaucaugggacagcucacauggaacgaucugauucggcuuugcauaauggugggcgcaaaugcuucugacaaaauggggaugggaaccacauacuuggcccugauggcaacuuucaagaugcguccuauguuugccguuggcuuacucuucagaaggcugaccagccgcgaggugcuucugcuaacgaucggucucucacuggucgcuaguguggaauugccaaacucccuggaggaauuaggggauggacucgcgaugggcauuaugauccugaaacuucugacagacuuucaaucucaucaguugugggccacccuccugagccuaacuuucauuaagaccacauuuucccugcacuaugcauggaagacuauggcuaugguucuuucaaucgugagccucuucccccuguguuugaguaccacgucucagaaaacaaccuggcugccggucuuacucggcucccuggggugcaagccucuuacuauguuucugauagccgagaauaaaaucuggggaagaaagagcuggccauugaacgaagguauuauggccguaggcaucgugucgauucuccugucaucucuacugaaaaacgauguuccccuugcugggccucucaucgcaggaggcaugcugauagccuguuacgugauuagugguuccagcgcggacuugucuuuagagaaggcugccgaggucagcugggaagaggaagcagagcauuccggggccucacacaauauccugguggaaguacaggaugacggaacaaugaaaaucaaggaugaggagagagacgauacccucacuauucugcuuaaggcuacacuguuggcagugaguggcgucuauccccuaagcauaccagccacccuguucguuugguacuucuggcagaagaagaaacagaggucuggcgugcucugggacacgccuucacccccagaaguggagcgagcgguccuggaugacgggaucuaucgcauuaugcagcggggacuuuuagguagaagccaggugggcguugggguauuucaagaaaacguguuccauacuauguggcacgucaccaggggagcugugcugauguaccagggcaagcgucucgagccgaguugggccagcguuaaaaaggacuugaucuccuacggugggggauggcgccugcagggcucuuggaauacaggcgaggaagugcaggucauugcaguggagccugggaagaaccccaaaaauguacaaaccgccccaggaacauuuaagacucccgaaggugaggucggcgcuaucgcccucgauuucaaaccugggaccucgggaagcccaauagugaaccgggaaggcaagaucguuggucuguaugggaauggaguggucacgacaucaggcacuuacguguccgcaauugcucaggccaaagcgagucaggagggcccccuuccugagaucgaagacgagguuuuuagaaagaggaaccugaccauuauggauuugcacccggggucuggaaagacacgacgguaucuaccagccaucgugcgcgaagcaauaaaaagaaagcugaggacccucauuuuagcucccacucgggucguggccagcgagauggcugaagcacugaaagguaugccuauccgauaccaaaccacagccguaaaguccgagcauacgggcaaagagaucguggaccuuaugugccacgccacuuucaccaugagacugcucucaccaguucgcguccccaauuauaacaugauuaucauggaugaagcucauuuuacagacccuucuagcauagcggcaaggggguacauuaguacccgugugggaaugggcgaggccgcugccaucuucaugacugcaacaccgcccgguuccguggaagccuuuccacagagcaaugcugucauucaggaugaggaacgggacaucccugagagaucuuggaacucaggguaugaguggauaaccgauuuccccggaaagacgguaugguuugugccauccauuaagaguggcaaugacaucgcgaacuguuugaggaaaaauggcaagcgcguuauccagcugagccgaaaaacuuucgauacagaauaccaaaagaccaaaaacaacgacugggacuacguggucaccacugauauuucggagaugggggccaauuucagagcagaccgggugaucgauccuaggcgcugccucaagcccguuauucugaaggacggaccagaacgugugauacuugcugguccgaugccugucacaguggccucugcagcccagagacggggcaggaucgggcgcaaccacaauaaagagggagaucaguauauuuacaugggccagccccuaaacaaugacgaggaucaugcucacuggaccgaagccaagaugcuguuggacaacaucaauacaccagaggguaucauucccgcguuauuugaaccugagcgagaaaaauccgcagccauagauggggaguauagacugcggggcgaggcuaggaagacuuucguagaacucaugcgcagaggagaccugccaguguggcuuagcuacaaaguugccucagagggcuuucaauauagugauaggcgguggugcuucgacggggaacguaacaaucagguccuggaggaaaacauggauguggagaucuggacgaaggagggagaacgcaaaaagcuccgacccagaugguuggacgcuaggaccuacucugacccucuggcacuacgggaguuuaaggaguucgccgcuggucgcagauccgugagcggcgaucugauucucgagaucgggaaacuuccgcagcaccugacacagagggcccaaaaugcauuagacaacuuggucaugcugcauaauucagaacagggaggccgggcguaucgacacgcccucgaggagcugccagauacuauugaaacccuuaugcugcucgcuuugaucgccguucugacagguggggugaccuuauuuuuccuaaguggcagaggacugggcaagacuagcauagggcuccuuuguguaauggcauccucugugcuguuguggauggcuagcgucgagccccauuggaucgccgcauccauuauccuggaauuuuuccucauggugcugcuuauuccugagcccgaccgccagaggacgccacaggauaaccaacucgccuacguugugaucggacuguuguuuaugauacugaccgucgcugcgaaugagauggguuuacuagaaacaacuaaaaaggaccugggcauugggcacguagccguggagaaccaccaucacgcaucaaugcucgauguugaccuucauccugcuucugccuggacccuguacgccguggcaacaaccaucauuacucccaugaugcggcacacaaucgaaaacacgaccgcuaauauaaguuugacugccaucgcgaaccaggcugccauucugaugggacucgauaaaggcuggccaaucucgaagauggacauuggugucccucugcuugcauuagggugcuauagccaggugaauccgcugacacucaccgccgcugucuugaugcugguggcacauuacgccaucauaggccccggacuacaagcgaaggcuacccgugaggcccagaaaagaacagcagccggcauuaugaagaacccaacuguugaugggaucguggcuaucgaccuggauccuguaguguaugacgccaaauucgaaaagcagcucggacagauuaugcuucugaucuuguguacgucccaaauacugcucaugaggaccacaugggcacugugcgagucuauuacuuuagcuaccggcccccuuacaacccugugggaggguucaccagggaaauuuuggaauacuacgaucgccgucagcauggcgaacauuuuccgcggauccuaccucgccggcgcaggucuagcuuucagucugaugaagucuuugggcgggggacggcgaggcacaggggcccagggagaaacccugggcgagaaguggaaaagacagcucaaucagcuuagcaagucagaauuuaacacuuauaaaagguccgguaucauggagguugaccgcagugaagcaaaggaggggcugaaacggggagagaccacaaagcacgcugugagcagaggcacugccaaguugcguugguucgucgaaaggaaucuggugaaaccugaggguaagguaauagaucucggcugugggcggggaggcuggucuuacuauugcgccgggcuaaagaaggugaccgaaguuaaaggauacacaaagggcggucccgggcacgaggaaccgaucccaauggcgacguacggauggaaccuggugaaacuucauuccggcaaggacgucuuuuucauuccucccgagaagugugauacccugcuaugcgacaucggcgagucaagcccaaaucccacuauugaagaggggcgcacacuccgagugcugaaaauggucgaaccuugguugagaggaaaccaauuuuguaucaagauucugaauccguauaugcccucggugguugagacccucgagcagaugcagaggaaacacgguggcaugcuuguacggaacccacugucucgcaauaguacucaugaaauguacuggguguccugcgggacaggaaacaucgucagcgcugugaauaugaccucaagaauguuacugaacagguucacgauggcacaccgaaagccuaccuaugagcgggauguugacuugggcgccgguacacgucacguggcugucgaacccgagguggccaaccucgauauaauugggcagagaaucgaaaauaucaaacaugagcacaaguccacuuggcauuacgacgaggauaacccuuauaagaccugggcauaccacggaucuuaugaaguaaaaccaagcggcagugccuccagcauggugaauggcguugucaagcugcuaacaaaacccugggacgugauuccuauggugacucaaaccgcuaugacagauaccacuccauuugggcagcagcgcgucuucaaggagaaaguugacacgaggacacccaaggcgaagcggggaaccgcccaaauaauggaagugacugcaagauggcuuugggguuuucugucucgcaacaaaaagccgaggaucuguacccgagaggaguucacacggaaaguaagaucaaaugcugccauuggcgcaguguuugucgacgagaaccaguggaauagugccaaggaggcuguggaagaugagagguucugggaccucguucaucgcgaacgugagcugcacaaacaggggaagugcgccacgugcguguacaacaugaugggaaagcgggagaaaaaguugggcgaguuugguaaagcgaagggguccagagcaaucugguacauguggcugggagccagguuccucgaguucgaagcucuuggcuuuaugaaugaggaucacugguucagccgcgaaaacucucugucgggcgucgagggggagggauuacauaaacuggguuauauuuugcgagacaucucaaagauaccuggcgggaauauguacgccgaugacaccgcaggaugggauacucggaucacagaagacgaucuccagaacgaggcuaaaauuaccgacaucauggaaccagagcacgcccugcuagcuaagagcauuuuuaaacuuacuuaucaaaauaaagugguaagaguucagaggcccgccaagaacggcacagugauggaugucaucucccgcagagaccagcgggguaguggacaggugggaaccuacggccugaauacauucacuaacauggaagcacaacucauaaggcagauggagucugagggcauuuuuagcccuuccgaacuggagaccccaaacuuggcggaacguguguuagauuggcuggagaaauauggggucgaacgacucaagcgcauggccaucucaggagacgacuguguugugaaacccaucgaugacagauucgcuacggcccuuaccgcacugaaugauauggguaagguacggaaggacauuccgcagugggagccuaguaaaggcuggaacgauuggcagcaagugcccuuuugcucucaucacuuccaccagcuaauaaugaaggacgggagggagaucgucgugccaugucgcaaucaggaugaacugguuggacgggcucgggugagccagggcgccgguuggucccucagggagacagcaugcuuggggaaaucauacgcccaaauguggcagcugauguauuuucaucgacgugaccuuagacuggcggcuaacgccauuuguagcgcagucccuguggauuggguacccacuucucgcaccacaugguccauccacgcccaucaccaguggaugacuaccgaagacaugcucaguguuuggaaucggguguggauugaggaaaacccauggauggaggauaagacgcauaucagcucgugggaggacguccccuacuuaggaaaaagggaagaccaauggugcggcucccugauaggcuugacagcuagagccaccugggcaacuaauauccagguggcuauuaaccagguucgccggcugaucgggaaugagaacuaccucgauuauaugacaucuaugaagagguucaagaaugaaucagacccugagggagcccuuugguga

SEQ ID NO: 13468 - RNA, 9879 nt, Artificial Sequence
  derived and/or modified CDS sequence (opt3) from DENV-1__FJ687432__SS-prME
agcgugaccaugcugcucaugcuuaugcccaccgcccuggcuuuccacuugacuacgagaggcggggaaccucauaugaucgucuccaagcaggaaaggggaaagucuuuacuguuuaagaccucaacagguguuaacaugugcacucuaauugccauggaccucggcgagcugugugaagauaccaugacauacaagugcccacggauaaccgaggccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaagcagauccagaagguggaaaccugggcccucaggcacccuggauucacaguuauugcucuguuucuggcacaugccaucggcaccucgauuacgcagaagggcaucauauucauccucuuaaugcuggugacuccaucaauggcuaugcggugcgucgggauuggaagccgcgauuuuguggagggucuuaguggcgccacauggguagacguuguguuggagcacggguccugugucaccacuauggcgaaggauaagcccacacuggacaucgaacuacucaaaaccgaggugacgaacccugcagugcugagaaaacuuugcauugaagccaaaaucucuaauaccacaacugauuccagguguccaacccaaggagaggcuacacuggucgaagaacaagacgccaacuucguuugccggcgcacuuuuguggaucgaggcugggguaauggguguggauuguucggcaagggcagccucauaaccugcgcaaaguuuaaaugcguaacaaagcuggaggggaaaauugugcaguacgaaaacuuaaaguauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaagaacgggacuggacuucaacgaaauggucuugcuaaccaugaaagagaagucuuggcuggugcauaaacagugguuucucgaucugccgcuucccuggacuuccggcgccucaacaagccaagagaccuggaauaggcaggaccuguugguaacauucaagacugcacacgcuaagaaacaggaaguugugguccucgguagucaagagggggccaugcacaccgcucugacgggcgccaccgaaauccagacaucuggaacuaccacaauuuuugcaggccauuuaaagugccggcugaaaauggauaagcuaacucucaaagggauguccuaugugauguguaccggguccuucaagcuggagaaggaagucgccgagacgcagcacgguacaauacuugugcagaucaaauacgagggcaccgacgcuccuugcaagauuccauucucgacucaagaugaaaaagggguuacacagaacggacguuugaucaccgcgaaucccauagugacugacaaggagaaaccuguaaacauugaagcagagccacccuuuggcgagucuuauaucgucaucggugccggggaaaaggcucugaagcucuccugguucaaaaagggcucaaguauuggaaaaauguuugaggccaccgcacgcggcgccagaaggauggcuauccugggggauacagccugggacuucggaagcauugguggcguguuuacguccguugggaaacuugugcaucagauauucggaaccgcauacggcguccuguuuucuggugugagcuggacuaugaaaaucgggauuggcguauugcucacauggcugggauuaaauucacggaguaccucccugagcaugacauguaucgcggugggccuaguuacucucuaccugggggucauggugcaggcugauucuggaugcgugaucaacuggaagggccgagaacuuaagugugguucagggauuuucgucaccaaugagguucacacguggacagaacaauauaaauuucaggccgacaguccgaagcgcuugagcgcagccauaggaaaggcuugggaggagggcgugugcgguaucagauccgccaccaggcuggaaaacauuauguggaagcagaucucuaacgagcucaaucauauucuguuagaaaacgacaugaaauucacugugguagucggcgauguggcagggauccuggcucagggaaagaaaaugauacggccucaacccauggaguacaaguauucguggaaaagcuggggcaaggccaagaucauuggggcggacguucagaaugccaccuuuaucauugauggaccaaacacaccugaaugucccgacgaucagcgcgcuuggaauaucugggagguggaggacuacggcuucgguauauuuacuaccaacauuuggcuuaaauugagagauuccuauacacaggucugcgaccacaggcucaugucagcagccaucaaggauaguaaagcugugcacgccgacaugggguacuggauugaaucugagaagaaugaaacguggaagcuggcacgugcgagcuucaucgagguuaaaaccuguauauggccaaagucccauacucuauggucaaacggagugcuggaaagcgagaugaucauucccaaaaucuauggcgguccuauuucucaacacaauuaccggccaggcuacuucacacagaccgccgggccguggcaucucggaaagcuggagcuugauuuugacuugugcgaaggcacuacaguagucguggaugagcacugcgggaaccgaggacccucccugagaaccacgacugugaccggcaaaaucauacacgaaugguguugcaggaguuguacauuaccuccacuccgcuuccggggugaggacgggugcugguauggaauggagauuagacccgucaaggaaaaggaggaaaaucugguuaaaagcauggugucugcuggcuccggugagguagacucauuuagucuuggccuguuguguaucagcaucaugauugaagaggugaugaggucgcgcuggucccgaaagaugcucaugaccgggacucuggccgucuucuuucuacugaucaugggacagcucacauggaacgaucugauucggcuuugcauaauggugggcgcaaaugcuucugaccguauggggaugggaaccacauacuuggcccugauggcaacuuucaaaaugagaccuauguuugccguuggcuuacucuucaggcgccugaccagccgggaggugcuucugcuaacgaucggucucucacuggucgcuaguguggaauugccaaacucccuggaggaauuaggggauggacucgcgaugggcauuaugauccugaaacuucugacagacuuucaaucucaucaguugugggccacccuccugagccuaacuuucauuaaaaccacauuuucccugcacuaugcauggaagacuauggcuaugguucuuucaaucgugagccucuucccccuguguuugaguaccacgucucagaagacaaccuggcugccggucuuacucggcucccuggggugcaaaccucuuacuauguuucugauagccgagaauaagaucuggggaagaaaaagcuggccauugaacgaagguauuauggccguaggcaucgugucgauucuccugucaucucuacugaagaacgauguuccccuugcugggccucucaucgcaggaggcaugcugauagccuguuacgugauuagugguuccagcgcggacuugucuuuagagaaagcugccgaggucagcugggaagaggaagcagagcauuccggggccucacacaauauccugguggaaguacaggaugacggaacaaugaagaucaaagaugaggagagggacgauacccucacuauucugcuuaaggcuacacuguuggcagugaguggcgucuauccccuaagcauaccagccacccuguucguuugguacuucuggcaaaagaaaaagcagcgaucuggcgugcucugggacacgccuucacccccagaaguggagcgcgcgguccuggaugacgggaucuaucggauuaugcagagaggacuuuuagguaggagccaggugggcguugggguauuucaagaaaacguguuccauacuauguggcacgucacccguggagcugugcugauguaccagggcaaacgccucgagccgaguugggccagcguuaagaaagacuugaucuccuacggugggggauggcggcugcagggcucuuggaauacaggcgaggaagugcaggucauugcaguggagccugggaagaaccccaagaauguacaaaccgccccaggaacauuuaaaacucccgaaggugaggucggcgcuaucgcccucgauuucaagccugggaccucgggaagcccaauagugaacagagaaggcaaaaucguuggucuguaugggaauggaguggucacgacaucaggcacuuacguguccgcaauugcucaggccaaggcgagucaggagggcccccuuccugagaucgaagacgagguuuuuaggaaacgaaaccugaccauuauggauuugcacccggggucuggaaagacacggcgcuaucuaccagccaucgugagagaagcaauaaagaggaaacugcggacccucauuuuagcucccacucgagucguggccagcgagauggcugaagcacugaaggguaugccuaucagauaccaaaccacagccguaaaauccgagcauacgggcaaggagaucguggaccuuaugugccacgccacuuucaccaugcgccugcucucaccaguuaggguccccaauuauaacaugauuaucauggaugaagcucauuuuacagacccuucuagcauagcggcacguggguacauuaguacccgggugggaaugggcgaggccgcugccaucuucaugacugcaacaccgcccgguuccguggaagccuuuccacagagcaaugcugucauucaggaugaggaaagagacaucccugagaggucuuggaacucaggguaugaguggauaaccgauuuccccggaaaaacgguaugguuugugccauccauuaagaguggcaaugacaucgcgaacuguuugcgcaagaauggcaaacgaguuauccagcugagcagaaagacuuucgauacagaauaccagaagaccaagaacaacgacugggacuacguggucaccacugauauuucggagaugggggccaauuuccgggcagacagggugaucgauccucgccguugccucaaacccguuauucugaaggacggaccagaaagagugauacuugcugguccgaugccugucacaguggccucugcagcccagcggaggggccgcaucgggcgaaaccacaauaaggagggagaucaguauauuuacaugggccagccccuaaacaaugacgaggaucaugcucacuggaccgaagccaaaaugcuguuggacaacaucaauacaccagaggguaucauucccgcguuauuugaaccugagagagaaaaguccgcagccauagauggggaguaucggcugaggggcgaggcucgcaaaacuuucguagaacucaugagaaggggagaccugccaguguggcuuagcuacaagguugccucagagggcuuucaauauagugaucggcguuggugcuucgacggggaacgcaacaaucagguccuggaggaaaacauggauguggagaucuggacgaaagagggagaacgaaagaaacucagacccaggugguuggacgcucggaccuacucugacccucuggcacuacgcgaguuuaaggaguucgccgcugguagaagguccgugagcggcgaucugauucucgagaucgggaaacuuccgcagcaccugacacagcgggcccaaaaugcauuagacaacuuggucaugcugcauaauucagaacagggaggccgagcguauagacacgcccucgaggagcugccagauacuauugaaacccuuaugcugcucgcuuugaucgccguucugacagguggggugaccuuauuuuuccuaaguggccgcggacugggcaaaacuagcauagggcuccuuuguguaauggcauccucugugcuguuguggauggcuagcgucgagccccauuggaucgccgcauccauuauccuggaauuuuuccucauggugcugcuuauuccugagcccgacaggcagcggacgccacaggauaaccaacucgccuacguugugaucggacuguuguuuaugauacugaccgucgcugcgaaugagauggguuuacuagaaacaacuaagaaagaccugggcauugggcacguagccguggagaaccaccaucacgcaucaaugcucgauguugaccuucauccugcuucugccuggacccuguacgccguggcaacaaccaucauuacucccaugaugcgucacacaaucgaaaacacgaccgcuaauauaaguuugacugccaucgcgaaccaggcugccauucugaugggacucgauaagggcuggccaaucucgaaaauggacauuggugucccucugcuugcauuagggugcuauagccaggugaauccgcugacacucaccgccgcugucuugaugcugguggcacauuacgccaucauaggccccggacuacaagcgaaggcuaccagagaggcccagaagaggacagcagccggcauuaugaaaaacccaacuguugaugggaucguggcuaucgaccuggauccuguaguguaugacgccaaguucgaaaaacagcucggacagauuaugcuucugaucuuguguacgucccaaauacugcucaugcgcaccacaugggcacugugcgagucuauuacuuuagcuaccggcccccuuacaacccugugggaggguucaccagggaaguuuuggaauacuacgaucgccgucagcauggcgaacauuuuccggggauccuaccucgccggcgcaggucuagcuuucagucugaugaaaucuuugggcgggggacgaagaggcacaggggcccagggagaaacccugggcgagaaguggaagaggcagcucaaucagcuuagcaaaucagaauuuaacacuuauaagcgcuccgguaucauggagguugaccggagugaagcaaaagaggggcugaagagaggagagaccacaaaacacgcugugagccguggcacugccaaguugaggugguucgucgaacggaaucuggugaagccugaggguaaaguaauagaucucggcugugggcgcggaggcuggucuuacuauugcgccggguuaaagaaagugaccgaaguuaagggauacacaaaaggcggucccgggcacgaggaaccgaucccaauggcgacguacggauggaaccuggugaaacuucauuccggcaaagacgucuuuuucauuccucccgagaagugugauacccugcuaugcgacaucggcgagucaagcccaaaucccacuauugaagaggggcgaacacucagagugcugaagauggucgaaccuugguugaggggaaaccaauuuuguaucaaaauucugaauccguauaugcccucggugguugagacccucgagcagaugcagcggaagcacgguggcaugcuuguacgcaacccacugucuagaaauaguacucaugaaauguacuggguguccugcgggacaggaaacaucgucagcgcugugaauaugaccucaaggauguuacugaaccgauucacgauggcacaccggaaaccuaccuaugagcgugauguugacuugggcgccgguacaagacacguggcugucgaacccgagguggccaaccucgauauaauugggcagcgcaucgaaaauaucaagcaugagcacaaauccacuuggcauuacgacgaggauaacccuuauaagaccugggcauaccacggaucuuaugaaguaaagccaagcggcagugccuccagcauggugaauggcguugucaaacugcuaacaaagcccugggacgugauuccuauggugacucaaaccgcuaugacagauaccacuccauuugggcagcagagggucuucaaagagaagguugacacgcggacacccaaagcgaagagaggaaccgcccaaauaauggaagugacugcacgcuggcuuugggguuuucugucuaggaacaagaaaccgcgaaucuguacccgggaggaguucacaagaaagguaaggucaaaugcugccauuggcgcaguguuugucgacgagaaccaguggaauagugccaaagaggcuguggaagaugagcgcuucugggaccucguucaucgugaacgggagcugcacaagcaggggaaaugcgccacgugcguguacaacaugaugggaaagagagaaaagaaauugggcgaguuugguaaggcgaaaggguccagggcaaucugguacauguggcugggagcccgcuuccucgaguucgaagcucuuggcuuuaugaaugaggaucacugguucagccgagaaaacucucugucgggcgucgagggggagggauuacauaagcuggguuauauuuugcgggacaucucaaaaauaccuggcgggaauauguacgccgaugacaccgcaggaugggauacuagaaucacagaagacgaucuccagaacgaggcuaagauuaccgacaucauggaaccagagcacgcccugcuagcuaaaagcauuuuuaaacuuacuuaucaaaauaaggugguaaggguucagcgccccgccaaaaacggcacagugauggaugucaucuccagacgggaccagagggguaguggacaggugggaaccuacggccugaauacauucacuaacauggaagcacaacucauacgucagauggagucugagggcauuuuuagcccuuccgaacuggagaccccaaacuuggcggaacgaguguuagauuggcuggagaaguauggggucgaacgccucaaaagaauggccaucucaggagacgacuguguugugaagcccaucgaugaccgguucgcuacggcccuuaccgcacugaaugauauggguaaaguaaggaaggacauuccgcagugggagccuaguaagggcuggaacgauuggcagcaagugcccuuuugcucucaucacuuccaccagcuaauaaugaaagacgggcgcgagaucgucgugccauguagaaaucaggaugaacugguuggacgggcuagggugagccagggcgccgguuggucccuccgagagacagcaugcuuggggaagucauacgcccaaauguggcagcugauguauuuucaucguagagaccuucgccuggcggcuaacgccauuuguagcgcagucccuguggauuggguacccacuucucggaccacaugguccauccacgcccaucaccaguggaugacuaccgaagacaugcucaguguuuggaauaggguguggauugaggaaaacccauggauggaggauaaaacgcauaucagcucgugggaggacguccccuacuuaggaaagagagaagaccaauggugcggcucccugauaggcuugacagcucgcgccaccugggcaacuaauauccagguggcuauuaaccagguucggaggcugaucgggaaugagaacuaccucgauuauaugacaucuaugaaacgauucaagaaugaaucagacccugagggagcccuuugguga

SEQ ID NO: 13469 - RNA, 9879 nt, Artificial Sequence
  derived and/or modified CDS sequence (opt3) from DENV-1__JQ922547__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagagccgaaaccuggauguccucugagggggcuuggaaacagauccagaagguggaaacaugggcacugaggcacccuggauucacuguuauugcccuguuucucgcucaugccaucggcaccucgauuacacagaagggcaucauauucaucuuacugaugcuugugaccccaucaauggcgaugcggugcgucgggauuggaaaccgcgauuuuguggaggguuugagcggcgcacccuggguagacguugugcuggagcacgggaguugugucacgacuauggccaaaaauaagccuacacuagauaucgaacuccugaaaaccgaggugacuaacccagcugugcuuagaaagcugugcauugaagccaaaaucuccaauacaaccacggacucuaggugucccacccaaggagaggcaacauuggucgaagagcaggaugcuaacugcguuugucggcgcacuuucguggaccgaggcugggguaaugggugcggacucuuuggcaagggcagccugauaaccugcgccaaguucaaauguguaacaaaguuagaggggaaaauugugcaguacgaaaaccugaaguauuccgucaucgugacuguucacaccggagaucagcaucaaguggguaaugagacaaccacucacggcacgacagcgaccauuacuccucaggccccaaccucagaaauccagcucacagacuacggggcacuuacccuggacugcaguccgagaacuggauuggauuuuaacgagaugguccuacugacaaugaaagaaaagagcuggcucgugcauaaacagugguuccuggaccuuccccugccuuggacgucuggcgcuuccaccucacaagagacuuggaauaggcaggauuugcucguaacauuuaagaccgcccacgcuaagaaacaggagguugugguccuggguagccaagaaggggccaugcacacagcauuaacuggcgccaccgagauccagacgaguggaaccacaacuauuuucgcuggccaucugaagugucggcuaaaaauggacaagcucacccugaaagggaugucuuaugugaugugcacaggauccuuuaagcuugaaaaggaggucgcggaaacucagcacgguaccguguugguucaggugaaauacgagggcacggaugcaccauguaagauacccuucagcacacaagacgagaaaggggccacccagaacggacgucugaucacugcuaauccuauuguaacagauaaggaaaaaccagucaacaucgaggccgaacccccguucggcgagucguauauagugguuggugcaggggagaaggcccucaagcugucuugguuuaaaaagggcuccucaauuggaaaaaugcuugaagcuaccgcccgcggcgcaagaaggauggcgauccugggggacacugcuugggauuucggaaguaucgguggcguguuuaccagcauggggaaguugguccaucagguguucggaacagccuacggcguacucuuuuccggugugucuuggacgaugaaaauugggaucggcauucuguuaaccuggcugggacuaaauagccggaacacuucacucaguaugaugugcauagcaguuggcauggucacacuguaccuuggggugauggugcaggccgacuccggaugugucaucaacuggaagggccgagaguugcugugcgguaccgggauuuucguuacaaaugaagugcacacuuggaccgauccuuauaaguuucaagcugaccccagcaaccgccucucuccaaucaucggaaaagccugugugauuagaguaugcggcauaaggucagcaacgcggcuggagaauaucauguggaagcagauuaguaacgaauuaaaucauauccugcuugagaacgacaugaaauucacagucgugguuggugaugugagcggcauuuuggcucagggggagaagaugauccgcccucagcccauggaacacaaauacuccuggaagucuuggggaaaagccaagauaaucggcgcggacguccaaaauaccacuuuuauuaucgaugggccaaacacccccgaguguccugacaaucagagagccuggaacauuugggaaguggaggauuauggauucggcaucuuuacaacuaauauauggcucaagcugagggacucguacacccagguuugcgaucaccgucuaaugagcgcugcaauuaaagacuccaaggccgugcaugcugauauggguuauuggaucgaaucagagaaaaacgagacauggaagcuggcccgggcaaguuucauugaaguaaaaacgugcaccuggccaaagucucacacucucuggagcaaugggguccuggaguccgaaaugaucauaccgaagaucuacggaggccccauuucacagcauaacuaucgaccugguuacuuuacacaaaccgcgggcccauggcaccuugggaaauuggagcuggacuucgauuucugugaaggaacuacagugguggucgacgagcacugcggcaauagagggcccagcuuaaggaccacgacuguuaccggaaagaucauucaugagugguguugccgcucuuguacacucccuccacugcgguuuaaaggcgaagaugguugcugguacgggauggagaucagacccgugaaggacaaagaagagaaccuuguaaaguccauggugagugccggaagcggcgaggucgacucuuucucccuggguuugcucuguauaucaauuaugaucgaagaggugaugaggagucgcuggagcaagaaaaugcugaugguuggcacccuagcuguguuucugcuccugaucauggggcagcuuacuuggucggauuugauucgacugugcaucauggucggagccaacgcauccgaccggaugggcauggggacaaccuauuuagcucucauggccacauucaagaugcguccgauguuugcagugggacugcuuuucccuaaacugacuucuagagaaguucuacuccugaccauuggcuugagccugguggccucagucgaguuaccaaguucccucgaagagcugggugaugggcuugcuaagggaauaaugaugcugaaauugcucacggacuuucagucucaccaacugugggcgacacuacugagccuuaccuucaucaagacuaccuuuucccuccauuacgccuggaagacaauggcaaugguacugucaauugugagcuuguucccccuguguuuaaguacuaccucucagaaaacgacauggcucccuguucugcuuggcucccugggcugcaagcccuugccaauguuucucaucaccgagaauaaaauuugggggaggaagagcuggccucugaacgaaggaaucauggcuguggguauagucucgauccuacugucaucucuucucaaaaaugaugugccccuggccggcccauugauugccgggggaauguuaguagcuuguuaugugaucaguggcuccagcgcagaccugucucucgagaaggccgcggaagucagcugggaggaagaggcugagcacuccggugccucacauaacauucugguugaagugcaggaugacgggacucgcaaaaucaaggaugaggaacgggacgauacacuuaccauacuguugaaggcaacucuacuggccgugaguggagucuacccgaugagcauuccugcuacacucuucgugugguauuuuuggcagaaaaagaaucaaagaucuggcguuggccugaucacccccuccccacccgagguagaaagggcagugcuugacgaugggaucuaccgaauuuuacagcgcggacugcucggucggucacaggucggcguggggguuuuccaggagggaguguuccacacgauguggcacgucacuagaggcgccguguugauguaucaagguaaaaggcuggagccuaguugggcgagcguaaagaaagaccucauauccuacgggggaggcuggcguuuucagggcucuuggaacaccggggaagagguccaggugaucgcuguugaaccaggacgcaaucccaagaacgugcagacagccccugguaccuucaagacaccggagggcgaggucggggcaauuccacuggacuuuaaacccggaacuucgggcagcccuaucgugaaucgggaagguaagauuguugggcuuuacggaaacggcguggucaccacgucaggcacauauguguccgccaucgcuagagccaaagcaagucaagaggggccacugcccgaaauagaggaugaaguauucaggaagcgaaauuugacuaucauggaccuacauccuggaucugguaaaacccggcgcuaccugccggcuauugugagagaggccaucaagaggaagcuccggacauuaauucuggcgcccacccgaguugucgccagcgagauggcagaagcucuuaaaggcgugccaaucagauaucagacuaccgccgugaaguccgagcacacagggaaagaaauagucgaucugaugugccaugcuacguuuacuaugcgccucuugucaccuguaagggugcccaacuacaauaugauuaucauggacgaggcacacuucaccgauccagccucuaucgccgcucguggauauauuagcacacggguuggcaugggugaagcggcagccaucuuuaugaccgcuacuccuacagggaguguggaggccuucccccaguccaacgcaauaauucaagacgaggaaagagauaucccagagaggagcuggaauucuggauacgacuggauuaccgauuuuccgggcaagacggucugguucgugccuucaaucaaauccggcaacgacauagccaacugccugaagaagaaugggaaacgcguuauucagcucagucgaaagacuuuugauacagaauaucagaaaaccaagaacaaugacugggacuacguggucaccacugauaucagcgagaugggagcuaacuucagagcggaccgggugaucgaucccaggcgcugucugaaaccaguaauucuuaaggacggucccgaacgugugauccuagccggcccuaugccaguuacagucgcaucggcugcccagagacgggggaggauuggacgcaaucaaaacaaggagggcgaucaguacauauauaugggucagcccucuaauaacgacgaggaucaugcacacuggaccgaagccaaaaugcuguuggacaauaucaacacaccugaggggauuaucccggcuuuauucgaaccagagcgagagaaguccgccgcgaucgauggcgaauacagacugcggggagaggcaaggaaaacuuuuguggaacucaugcgcagaggcgaccugcccguguggcuuagcuauaaggucgccucagagggguuccaguacagugauaggcgguggugcuuugacggagaacguaauaaccaaguucuggaggagaauaaagauguggaaauuuggacgaaggagggugaacgcaaaaagcuccgaaccuguugguuggacgcuagaacauauucugacccucuggcccuaagggaguucaaggaauuugcugcaggccggcgcuccguaagcggggaucugauacucgagaucggaaaacuuccccagcaccugacucagaaggcccagaaagcuuuagacaacuuggugaugcugcauaauucagagcaaggcgguaaggccuacagacacgcaauggaagagcucccagauaccauugaaacacugaugcuucuggcgcucaucgccgucuugaccgggggcgugacucuguucuuuuuaaguggaaggggccuagggaaaacgagcauuggacugcucugcguuauggcuuccucugugcuucuguggauggccagcgucgagccucauuggaucgcagcuuccauaaucuuggaauucuuucugaugguacuccugauucccgagccagaccggcagcgaaccccucaggauaaccagcuugccuaugugguuaucggucuccuguucaugauuuugacaguggcagccaacgagaugggccuguuagaaacuaccaagaaggaccuagggaucggacacgucgcugcggagaaucaccaucacgccacaaugcuggauguggaccucagaccggcaucagcuuggacccuuuacgccgucgccacuacaauaauuacgcccaugaugcgccauaccaucgaaaacacuacagcaaauauuucucugaccgcuaucgccaaccaagcggcuauauugaugggccuggauaaagguuggccaaucaguaagauggacauuggggugccucuccuggcccuuggcuguuacucgcagguuaaucccuuaacccugacagcagccgugcucauguugguagcucacuaugcaaucauuggaccaggccugcaggccaaagcgacuagggaggcucaaaagcggacggccgcagggaucaugaaaaacccuaccguggauggaauagucgccauugaccuagaucccguuguguacgacgcuaaguuugagaagcagcugggccagaucaugcuccuuauccugugcacaagccagauuuugcugaugcguacuaccugggcccucugugaauccaucacacuggcaaccgguccguuaacuacgcuuugggaggggucuccaggaagauucuggaauacaaccauagcugucucaauggccaacauuuuuaggggcagcuaucuggcgggugccggccucgcauucucccuaaugaaaagucuggggggaggccgccgggggacuggagcucaaggcgaaaccuugggugagaaguggaaacgacagcugaaucagcucucuaagagcgaauucaacacauacaaaagaucagggaucauggagguggacagguccgaggccaaggaaggacuuaagcgcggcgagacuaccaaacaugcaguaagucgggguacagcuaagcugagaugguuuguggaacguaauuugguuaaaccugagggcaaggugauugaucuggggugcggaaggggcggguggagcuauuacugugccggacucaaaaaggucacggaagugaaaggcuauaccaagggugggcccggacacgaggagccaauccccauggccacuuacggcuggaacuuagucaagcugcacucuggcaaagacguguucuuuauaccuccggaaaagugcgauacacuucugugugacaucggggaguccucacccaauccaaccauugaagagggacggacucuacgcguucucaaaaugguagaaccuuggcugcgagguaaccaguucugcaucaagauuuugaaucccuacaugccuagcguggucgagacacuggagcaaaugcagagaaaacauggcgggaugcucgugaggaacccacuuucgcggaauucuacccacgaaauguauuggguuaguugcggaacgggcaacaucguguccgcggucaacaugaccagccgcaugcuguuaaauagauuuacaauggcucauaggaagcccacuuacgagcgagauguggaccugggugcagggacccggcacguagccguggaaccugagguugcuaacuuggauauuaucggacagcguauagagaauauuaagaacgaacacaaaucaacauggcauuaugacgaggauaauccauacaagacuugggccuaucacggcuccuacgaagucaaacccucuggcagcgcaaguuccauggugaacgggguggucagacuccugaccaagccgugggacguuaucccuauggugacacagaucgccaugaccgauacuacgccauucggacaacagcgcguauuuaaagagaagguggacacaaggacccccaaggcuaaacgggguacugcgcagauuauggaagucaccgccagauggcuauggggcuuccuuagccgcaauaagaaaccuaggauauguacacgagaggaguuuacgcggaaggugagaucuaacgcagcuaucggggccguuuucguggacgaaaaucaauggaacucagcaaaagaggccgucgaagaugagagguuuugggaccuggugcaucgcgaacgugagcuccacaagcagggaaagugcgcuaccuguguauauaauaaaaugggcaagcgggagaaaaagcugggugaauucgggaaagccaagggaaguagagcgauuugguacaugugguugggcgcaagguuucuggaguucgaagcccucggcuucaugaacgaggaucauugguuuucccgcgaaaauagccuuucugggguugagggagagggucugcacaaauuaggcuacauccugcgagacauuucgcggaucccagggggaaacauguaugcugaugacacugccggcugggauacaagaauaaccgaagacgauuugcagaaugaggcaaagaucacugacauuauggaacccgagcacgcucuccuggccacaucaaucuucaagcuaaccuaccagaacaaaguggucagggugcaacgcccggcuaagaacgguacagugauggaugccauuagcagacgggaccagaggggguccggacaggucggcacuuauggccuuaauaccuuucugcauaaagaggcacagcucauccgucaaauggaauucgaggggauauuucugccuagugaauuggagacgcccaacuuagcgggacgaguucuggauuggcucgaacaguacgguguggagcgccuuaagagaauggccauuucuggcgacgacugcguagugaaaccaaucgaugaccgguucgcuaccgcccugacagcacuaaaugauauggggaaggucaggaaggacaucccucagugggagcccagcaaaggauggggcgauuggcagcaagugccauuuuguucccaccauuuccaccagcugauuaugaaggacguucgcgaaauagugguccccugcagaaaccaggaugagcucgugggucgggcuaggguaucacagggggccggauggaguuugcgagaaacugcaugucugggcaaaucuuaugcccaaauguggcagcuuauguacuuucaccguagagaccugcgccucgcggcuaaugccaucugcagcgcaguuccuguggauugggucccaaccucccggacaacuuggucaauucaugcccaccaucaguggaugaccacggaggacauguuaagcguguggaacaggguuuggaucgaagagaauccguggauggaggauaagacacacgugucuuccugggaagacguccccuaucugggcaaaagagaggaccaauggugugggaguuugauuggacugaccgcucgcgccacuugggcaacaaacauccagguggcuauaaaucagguacggaggcucaucgguaacgaaaauuaccuugauuacaugaccagcaugaagcgauucaagaacgagucggacccugaaggcgcccugugguga

SEQ ID NO: 13470 - RNA, 9879 nt, Artificial Sequence
  derived and/or modified CDS sequence (opt3) from DENV-1__EU482567__SS-prME
agcgugaccaugcugcucaugcuucugcccacagccuuggcuuuccacuuaacuacgagaggaggggagccucauaugaucgucuccaagcaggaaaggggaaagucucuguuguuuaagaccucagcagguauuaacaugugcacacucauagccauggaccugggcgagcuuugugaagauacuaugaccuacaaaugcccacggaucacagaggcggaaccggacgauguugacuguuggugcaaugcuaccgauacuugggugacauaugggaccuguagucaaacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcacuguuucucgcccaugcuaucggcaccucgauuacgcagaagggcaucauauucaucuuacugauucuuguuacuccaucaauggccaugcggugcguggggaucggaaaccgcgauuuugucgaggguuugagcggcgcgacauggguggacguuguucuggagcacgggaguugugugaccacuauggcaaaagauaagcccacacuagacauugaacuccugaaaaccgaggucacgaauccugccgugcuuagaaagcugugcaucgaagcuaaaauauccaacaccacaacugauucuagguguccaacccaaggagaggccacauugguggaggaacaggacagcaauuucgucugccggcgcacuuuuguugaucgaggcugggguaacggguguggacucuucggcaagggcucccuguuaaccugcgcaaaguuuaaaugcgugacaaagcuggaggggaaaauuguacaguacgaaaaucucaaguauucagugaucgucaccgugcacacuggagaccagcaucaaguugguaacgagacgacagaacacggcaccauugcuacuaucacaccccaggccccuacaagugagauccagcuuaccgacuacggggcgcugacuuuggauuguagcccaagaacaggacuagacuucaaugaaauggugcugcucacgaugaaagagaagucuuggcugguccauaaacagugguuucuugaucugccguugcccuggaccuccggcgccucaacuagccaagagacauggaacaggcaggaccuccuggugaccuucaagacagcacacgcuaagaaacaggaaguaguuguguuagguagucaagagggggccaugcacacugcucugaccggcgccacggaaauucagaccucuggaacaacuaccauauuugcaggccaucuaaagugccggcucaaaauggauaagcugacacuuaaagggauguccuaugucauguguacuggcagcuucaaguuggagaaggaaguggccgagacccagcacgguacgguccuggugcagguuaaauacgagggcacagacgcuccuugcaagaucccauucucggcgcaagaugaaaaaggggugacccagaauggacgucucauuacugcaaaccccaucguaacagacaaggagaaaccugucaauauagaaaccgagccacccuuuggcgagucuuauauugugguuggugccggggaaaaggcucugaaacuuuccugguucaaaaagggcucaaguaucggaaaaauguuugaggccacugcacgcggcgccagaaggauggcuauccugggggauaccgccugggacuucggaagcauugguggcguguuuacauccgcagggaaguugguccaucagguguucggagcggcuuacggcguacucuuuucuggugugagcuggacgaugaaaaucgggauuggcauacuguuaaccuggcugggacuaaacucacggaguacuucccucagcaugacauguaucgccguuggcauggucacccuguaccuugggguggugguccaggcagauucuggaugcguuauuaauuggaagggccgagaauugaagugugguucagggaucuucgugacaaacgaggugcacacuuggaccgaacaauauaaauuucaggccgacaguccgaagcgccugagcgcugccaucggaaaagcaugggaggagggcguaugcgguauuagauccgcuacgaggcucgaaaacauaauguggaagcagaucucuaaugagcugaaccauauuuuacuggaaaaugacaugaaauucacagucgugguuggcgaugccaacgggauccuugcgcagggaaagaaaaugauucggccucaacccauggagcaccgcuacucguggaaaagcuggggcaaggccaagaucauaggggcugacauccagaaugcaaccuuuauuaucgauggaccagacacuccugaaugucccgaugaccagagagccuggaacauuugggagguggaggauuauggcuucgguaucuuuaccacaaauauaugguugaagcucagggacuccuacacucagaugugcgaucaccgucugaugucagcugccauuaaagacaguaaggcaguccaugcggauaugggguauuggaucgaaucugagaaaaacgaaaccuggaagcuagcccgggcuagcuucauugaggugaagacauguaucuggccaaaaucccacacgcuguggucaaauggaguucucgaaagcgagaugauaauccccaagauuuacggcgguccuaucucucaacauaacuaucgaccaggcuacuucacccagacugccgggccguggcaccugggaaaacuugaguuggacuuugaucugugcgaaggcacaaccgugguagucgacgagcacugcgggaauagaggacccuccuuaaggacuacaaccgugacgggcaagauuauccaugaaugguguugccgcaguuguacucucccuccacugcgguucagaggugaggacgggugcugguacggaauggagauaaggcccgugaaagaaaaggaggaaaaccuuguccgcagcaugguuucugcaggcuccggugagguggauucauuuagucugggcauuuuguguguaagcaucaugaucgaagaggugaugcgaucgcgguggucccguaagaugcucaugaccgggacacuggcugucuuccuacugcucauuaugggacagcugaccuggaaagaccuuaucagauugugcauuauggugggcgccaaugcaucugauaggauggggaugggaacuacauaucuggccuuaauggcuaccuuuaagaugcgcccuauguucgcgguuggccuccuguuucggagacuuacaagcagggaggugcugcuacucacuauaggucugucauuggucgccaguguggaacugccaaacuccuuagaggaacucggggacggacuggcaaugggcaucaugaugcuuaaacuguugaccgaguuccaaccccaccagcucuggacgacacugcuaucucugaccuuuauuaauacuacccuuagccucgauuacgcuuggcgaacaauggccaugguucuguccaucauuucauuguucccgcuguguuuaagcacuaccagucagaagacgacauggcucccugugcugcuuggcucuuuugggugcaaaccacugaccauguucuugaucacugaaaacaagauauggggacgcaaguccuggccccucaacgaggguaucauggccauuggcaucgucagcauucugcuaucgucacugcuuaaaaaugacguaccucucgcugggccccugaucgcaggaggcauguugauagccuguuaugugauuucugguaguuccgcggauuuaagccuggagaaggcugccgaaguuucuugggaggaagaggcagaacauagcgggacaucccacaacauccucguggagguccaggacgauggaaccaugaaaaucaaggacgaggaacgggaugacacucugacaauucuucugaaagccaccuugcuagcugugucaggcguauacccaaugaguauaccugcaacgcuguuugugugguauuucuggcaaaagaaaaagcagagaagcggcguccucugggauacucccucuccaccggagguugaaagggccgugcuggacgacgggaucuaccguauucuucagcgcggauuacugggucggucccaggugggcgucgggguguuccaagauggaguuuuucauaccauguggcacguaacaagaggcgcggugcucauguaucaggguaagagguuggagccuucaugggcuagugucaaaaaggaccugaucagcuacgggggaggcuggcgauuccagggcuccuggaauaccggggaggaagugcagguuauugccguggagcccggcaagaauccaaagaauguccaaacaacucccgguaccuuuaaaacgccugaaggcgaggugggggcaaucgcccucgauuucaagccaggaacaucuggcucgcccauaguaaaccgggaagguaagaucgucgggcuguacggaaauggcgugguuacuaccagcggcacauaugugucagcuauugcccaggcaaaaaccucccaggaggggccucuuccggagaucgaagacgaggucuuuaagaaacgcaaccugacuauuauggauuugcacccaggaagugguaagaccagaagguaccuacccgcuaucgugcgggaagccauaaaacgaaagcugagaacacucauuuuagcgccuacgcgcguuguggccucugagauggcagaagcucugaagggcaugccaaucagguaucaaacuaccgccgucaaaagcgagcauacagggcgugagaucguggaccuuaugugccacgcuaccuucacuaugcggcugcucucccccguaagagugccuaauuacaacaugauuaucauggaugaagcacauuuuacagacccggccucaauagccgcuaggggauauauuucuacccgcguuggcaugggugaggcggcagccaucuucaugacggcuacucccccagggagcgucgaagccuuuccucagaguaaugcagugauucaggaugaggaacgagacauccccgagagauccuggaacagcggauacgauuggauaacagacuucccaggcaagaccgugugguuugucccuucuauuaaaucaggcaaugacaucgccaacuguuugcggaagaaugggaaaaggguaauccagcugucccgcaagaccuucgauacugaguaucaaaagaccaagaacaacgacugggauuacgugguuaccacagacauuagugaaaugggagcuaauuuccgugcggauagagugaucgacccccggaggugccucaagccagucauucugaaagaugguccggagcgcgugauacuugccggcccuaugcccguuacuguggcaagcgcugcccagcgaagagggcggaucggaaggaaccagaauaaggaaggcgaccaguacgucuauaugggucaaccacuaaacaaugaugaggaccacgcacauuggacggaggccaaaaugcuguuggauaacauuaauacccccgaagggaucaucccugcuuuauuugagccagaacgcgagaagucggccgcgauugacggcgaauacagacugaggggagaggcacggaagacauucguggagcucaugcgucgcggcgaucugcccguauggcuuucuuauaaaguggccuccgaaggguuucaguacagcgaccgaagauggugcuucgacggagagaggaacaaucagguucuggaagagaacauggaugucgaaauauggacuaaggagggugagcggaaaaagcuccgcccuagaugguuggacgcuaggaccuauucagauccgcuggcccuacgggaauuuaaagaguucgcugcaggccgaagaagugugucuggggaccugauccucgaaauuggaaaacuuccacagcaccugacauuacgcgcccaaaaugcuuuggauaaccuggugaugcuccacaauuccgagcagggcgguaaagccuacaggcaugcaauggaggaacugcccgacaccaucgagacucuuaugcugcucgcguugauugccguccugaccgggggaguuacguuauuuuuccuaagcggaaagggccuggggaagacaucaaucggacuccuuugugugauggcuaguagcgcccuguuguggauggcaaacguagaaccucacuggauagcugccuccaucauucuggaguuuuuccucauggugcugcuuauccccgaaccagaucggcagcguacuccucaggacaaucaacucgcauaugucgugauuggucuguuguuuaugauccugaccguugccgcuaacgagaugggcuuacuagagacaaccaaaaaggaucuggggauaggacauguggcggccgaaaaccaccaccaugcaacuaugcucgacgucgaucuuagacccgcuucugccuggacacuguacgccguagcaacgaccgugauuacuccaaugaugaggcacacaaucgagaauaccaccgcuaacauuagcuugacagccaucgcgaaucaggcugccauacugaugggccucgacaaagguuggccuaucuccaagauggauauugggguuccgcugcuugcauuaggcugcuacucacaggugaacccccugacucucacggccgcugucuugaugcugguggcacauuaugccaucauuggaccaggccuacaagcgaaagcuacccgcgaagcccagaagcggacagcagccgggaucaugaagaauccuacugucgacggaauaguggcuauugaccuggaucccguuguguacgacgccaaauucgagaagcagcucggccagaucaugcuucugaucuuguguaccucucaaauucugcucaugcgaacaaccugggcacugugcgaaaguaucacuuuagcuacggguccacuuacaacccugugggaggggucgccuggaaaauuuuggaacacuaccauagccguaagcauggcgaauauuuucagaggcuccuaucucgccggugcaggccuagcuuucucucugaugaagucacuagggggaggcaggcgcgggacaggagcccagggcgagacucugggugaaaaauggaagcggcagcucaaccagcuuagcaaguccgaguuuaauaccuacaaaagaagugggaucauggaaguggaucguucugaggcaagggaaggacugaagcggggcgagacaacgaaacacgcugucagccgcgguaccgccaaguugcgaugguucguugagagaaaccuggugaaacccgaaggcaaggucauugaccucggguguggaaggggcggguggucauauuacugcgccggauuaaagaaagugacugagguaaagggcuauacaaaaggugggccgggacaugaggagccaaucccuauggcgaccuacggcuggaaucuggugaaacuuuacuccggcaaagauguauuuuucauacccccagaaaagugugacacucugcuaugcgauaucggggagaguagccccaacccuacaauugaggaaggacggacccuccgcgugcugaaaauggucgagccgugguugagagguaaucaauuuuguaucaagauucugaaccccuauaugccaucuguggucgaaacgcucgagcagaugcagaggaagcacggcgggaugcuugugcgaaauccucugucccggaacucaacccacgagauguacuggguuagcugcggaacaggcaauaucguaucggcugugaacaugacuucucguauguuacugaacagauucaccauggcacaucgcaaacccacauaugaaagggacgucgauuugggugccgggacucggcacguggcuguugagccugaaguggccaaucucgacauuaucggacagagaauagagaacauuaagaaugaacauaaaaguaccuggcacuacgaugaggacaacccauauaagacaugggcauaccacggcuccuaugaggucaaacccagcggcucagccuccucuauggugaaugggguagugcgccugcuaaccaagccuugggacguuaucccaauggucacucaaaucgcuaugacggauacaacccccuuuggacagcagaggguguucaaggaaaaaguggacacucgaaccccgcgggcgaagagagguacagcccaaauuauggaggucacggcaaaauggcuuuggggcuuucugagcaggaacaagaaaccucgcauauguacccgugaagaguucacucggaagguuagaaguaaugcugccaucggggcaguguuuguagaugaaaaccaguggaacuccgccaaggaggcuguggaggacgaaagguucuggaaccucguccaucgcgagcgagaacugcacaaacagggaaagugcgccacaugcguguacaauaugaugggcaaacgggagaagaaauugggugaauuugggaaggcgaagggaagcagagcaauuugguacauguggcugggcgccagguuccucgaguucgaggcucuuggcuuuaugaacgaagaucauugguucucucgcgaaaauucauuuagugggguugaaggagagggucugcacaaauuaggcuauauccugagagacauuuccaagaucccagggggaaacauguacgccgaugacaccgcaggcugggauacucggauaacagaggacgauuugcagaaugaagcuaaaaucaccgacauuauggagcccgaacaugcccuccuggcuacaagcaucuucaagcuaacuuaucaaaacaaaguggucagggugcagcguccugccaagaacgguaccguaauggauguuauuucucgacgcgaccagagagggucgggacaggugggcacguacggccuuaauaccuuuacaaacauggagguccaacugauccggcagauggaaucagaggggauauuccucccaagcgagcuggaaacucccaauuuggcagagaggguguuagacuggcuggaaaaacacggaaccgagcgccucaagagaauggcgauuuccggugaugacuguguggucaagccgguugaugaacgguuugccacagcucuuaucgcccugaacgacaugggcaaagugaggaaggauaucccucagugggagcccaguaaaggguggaaugacuggcagcaaguaccauucugcucucaccauuuucaccagcuaauuaugaaggauggacgagagauaguggucccuugucguaaccaggacgaacuggugggcagagcacgcguuagccagggugcuggguggucccuccgggagacugccugcuugggaaaaucauaugcacaaauguggcagcugauguacuuccauaggagagaucuucgccuggccgcgaaugcuaucuguagugccgugcccgucgacugggugccaaccucucggacgacauggagcauucacgcacaccaucaguggaugaccacugaagauaugcucuccguauggaacaggguuuggaucgaggaaaaucccuggauggaggacaagacacacgugucaagcugggaggaagucccuuauuuaggcaagcgagaggaccaauggugcggcucucugauuggguugaccgccagagcuacuugggccaccaacauccagguggcaauaaaucagguucggaggcugaucggaaacgaaaauuaccucgauuacaugacauccaugaaacgcuuuaagaacgagagugacccagagggugcucuuugguga

SEQ ID NO: 13471 - RNA, 9879 nt, Artificial Sequence
  derived and/or modified CDS sequence (opt3) from DENV-1__FJ390378__SS-prME
agcgugaccaugcugcucaugcuucugcccaccgccuuggcuuuccacuuaacuacgagaggaggggagccucauaugaucgucuccaagcaggaaaggggaaaaucucuguuguuuaagaccucagcagguauuaacaugugcacacucauagccauggaccugggcgagcuuugugaagauacuaugaccuacaaaugcccacggaucacagaggcggaaccggacgauguugacuguuggugcaaugcuaccgauacuugggugacauaugggaccuguagucagacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcacuguuucucgcccaugcuaucggcaccucgauuacgcagaagggcaucauauucaucuuacugaugcuuguuacuccaucaauggccaugcggugcguggggauuggaaaccgcgauuuugucgaggguuugagcggcgcgacauggguggacguaguucuggagcacgggaguugugugaccacuauggcaaaagauaagcccacacuagacaucgaacuccugaaaaccgaggucacgaauccugccgugcuuagaaagcugugcauugaagcuaaaaucuccaacaccacaacugauucuagguguccaacccaaggagaggccacauugguggaagaacaggacagcaauuucgucugccggcgcacuuuuguugaucgaggcugggguaacggguguggacucuucggcaagggcucccuguuaaccugcgcaaaguuuaaaugcgugacaaagcuggaggggaaaauaguacaguacgaaaaucucaaguauucagugauugucaccgugcacacuggagaccagcaucaaguugguaacgagacgacagaacacggcaccaucgcuacuauuacaccccaggccccuacaagugagauccagcuuaccgacuacggggcgcugacuuuggauuguagcccaagaacaggacuagacuucaaugaaauggugcugcucacgaugaaagagaagucuuggcugguccauaaacagugguuucuugaucugccguugcccuggaccuccggcgccucaacuagccaagagacauggaacaggcaggaccuccuggugaccuucaagacagcacacgcuaagaaacaggaaguaguuguguuagguagucaagagggggccaugcacacugcucugaccggcgccacggaaauccagaccucuggaacaacuaccauuuuugcaggccaucuaaagugccggcucaaaauggauaagcugacacuuaaagggauguccuaugucauguguacuggcagcuucaaguuggagaaggaaguggccgagacccagcacgguacgguccuggugcagguuaaauacgagggcacagacgcuccuugcaagauaccauucucggcgcaagaugaaaaaggggugacccagaauggacgucucaucacugcaaaccccauuguaacagacaaggagaaaccugucaauaucgaaaccgagccacccuuuggcgagucuuauauagugguuggugccggggaaaaggcucugaaacuuuccugguucaaaaagggcucaaguauuggaaaaauguuugaggccacugcacgcggcgccagaaggauggcuauccugggggauaccgccugggacuucggaagcaucgguggcguguuuacauccgucgggaaguuggugcaucagguauucggagcagcguacggcgugcucuuuucugguguuagcuggacgaugaaaauugggaucggcauucuguuaaccuggcugggacuaaacucacggaguacuucccucagcaugacauguauagcugucggcauggugacccuguaccuuggggugaugguccaggccgauucuggaugcguuaucaauuggaagggccgagaauugaagugugguucagggauuuucgugacaaacgaggugcacacuuggaccgaacaauauaaauuucaggcagacaguccgaagcgccugagcgccgcuaucggaaaagccugggaggagggcguaugcgguaucagauccgcaacgaggcucgaaaacauuauguggaagcagauaucuaaugagcugaaccauaucuuacuggaaaaugacaugaaauucacagucgugguuggcgaugcuaacgggauucuugcccagggaaagaaaaugauccggccucaacccauggagcaccgcuacucguggaaaagcuggggcaaggcgaagauuaucggggccgacauacaaaauuccaccuuuaucauugauggaccagacacuccugaaugucccgaugaccagagagcuuggaacaucugggagguggaggauuauggcuucgguauuuuuaccacaaauaucugguugaagcucagggacucauacacucagaugugcgaucaccgucugaugagugcagccauaaaagacucuaaggcuguccaugccgauaugggguauuggauugaaagcgagaaaaacgaaaccuggaagcuagcacgggcguccuucaucgaggugaagacauguauuuggccaaaaucacacacgcuguggagcaauggaguucucgaaucugagaugaucauacccaagaucuacggcgguccuauuucccaacauaacuaucgaccaggcuacuucacccagacugccgggccguggcaccugggaaaacuugaguuggacuuugaucugugcgaaggcacaaccgugguagucgacgagcacugcgggaauagaggacccaguuuaaggacuacaaccgugacgggcaagaucauucaugaaugguguugccgcagcuguacucucccuccacugcgguucagaggugaggacgggugcugguacggaauggagaucaggcccgugaaagaaaaggaggaaaaccuuguccgcucuaugguuuccgcuggcucaggugagguggauaguuuuagccugggcauauuguguguaucgauuaugaucgaagaggugaugcgaucccgguggucucguaagaugcucaugaccgggacacuggccgucuuccuacugcucaucaugggacagcugaccuggaaugaccuuauuagauugugcaucauggugggcgcaaacgcuagcgauaggauggggaugggaacuacauaucuggccuuaauggcaaccuuuaaaaugcgcccuauguucgccguuggccuccuguuucggagacuuacaucaagggaggugcugcuacucacuauuggucugaguuuggucgcuuccguggaacugccaaauucuuuagaggaacucggggacggacuggcgaugggcauaaugaugcuuaagcuguugaccgaguuccaaccccaccagcucuggacgacacugcuaagccugaccuuuaucaaaacuacccuuucccucgauuacgccuggcgaacaauggcaaugguucugucaauugugagcuuguucccgcuguguuuaaguacuaccucucagaagacgacauggcucccuguccugcuuggcuccuuugggugcaaaccacugaccauguucuugaucacugaaaacaagauuuggggacgcaagagcuggccccucaacgaggguaucauggcuauaggcaucguaucgauucugcuaucaucucugcuuaaaaaugacgugccucucgccgggccccugaucgccggaggcauguugauugcuuguuauguuaucagugguuccagcgcagauuuaucucuggagaaggccgcggaagugagcugggaggaagaggcugaacauuccgggacaucacacaacauacucgucgaggugcaggacgauggaaccaugaaaauuaaggacgaggaacgggaugacacucugacaauccuucugaaagccaccuugcuagcaguaaguggcguguacccaaugagcaucccugccacgcuguuugucugguauuucuggcaaaagaaaaagcagagaucuggcguucucugggauacucccuccccaccggagguggaaagggcugugcuggacgacgggauuuaccguauacuucagcgcggauuacugggucggucacaggucggcguggggguuuuccaagauggaguauuucauaccauguggcacgugacaagaggcgcaguccucauguaucaggguaagagguuggagccuaguugggccagcgugaaaaaggaccugaucuccuacgggggaggcuggcgauuccagggcucuuggaauaccggggaggaaguucaggugauugcggucgagcccggcaagaacccaaagaaugugcaaacaacucccgguaccuuuaaaacgccugaaggcgagguaggggcuaucgcccucgauuucaagccaggaacaucgggcagccccauugucaaccgggaagguaagaucguggggcuguacggaaauggcguugugacuaccucaggcacauaugucuccgcaauagcccaggcuaaaaccagucaggaggggccucuuccggagaucgaagaggaaguguuuaagaaacgcaaccugacuauuauggacuugcacccaggaucugguaagaccagaagguaccuacccgccaucguucgggaggcaauuaaacgaaagcugagaacacucaucuuagcuccuacgcgcguggucgccagcgaaauggcggaggcccugaagggcaugccaauaagguaucaaacuaccgcagugaaauccgagcauacagggcgugaaauuguagaucuuaugugccacgcuaccuucacuaugcggcugcucucacccgugagaguuccuaauuacaacaugaucaucauggacgaggcccauuuuacagauccggcuucuauugcagccaggggauauaucagcacccgcgucggcaugggugaagccgcugcgauauucaugacggcaacucccccagggaguguggaggccuuuccucaguccaaugcugugauucaggacgaagaacgagauauccccgagagaagcuggaacucuggauacgacuggauuacagauuucccaggcaagaccgucugguuuguaccuucaaucaaauccggcaaugacauagccaacuguuugcggaagaaugggaaaagggugauucagcugagucgcaagaccuucgacacugaauaucaaaagacacguaacaacgauugggacuacguugugaccacagauaucagcgagaugggagcaaauuucagagccgaccgggucaucgaucccaggcgcugccucaaaccagugauucugaaggacgguccggaacgaguuauccuugcuggcccuaugcccgugacugucgcgucggccgcacagagacgggggaggauuggacgcaaccagaauaaagagggcgaucaguacguguauaugggucaaccacuaaacaaugacgaggaucacgcucauuggacggaagccaagaugcuguuggacaacauaaauacccccgaggggaucauuccugcauuauuugaaccagagagagaaaaaucugccgcuaucgauggcgaguacaggcugcggggagaggcccguaagacauucguagaacucaugcgccgaggcgaccugcccguguggcuuuccuauaagguugcgagcgagggguuucaguacucagauagaagguggugcuucgacggagaacggaacaaucagguccuggaggaaaacauggacguggagaucuggacuaaagagggugaacgcaagaaacucagaccuaggugguuggaugcacggaccuauagugacccgcuggcccuacgagaguuuaaggaguucgcugccggcagacgcucuguguccggggaucugauucucgagauaggaaaacuuccacagcaccugacauuaagggcucaaaaugcauuggacaaccuggucaugcuccacaauagcgaacagggcgguaaggccuaccggcaugcuauggaggagcugcccgauaccaucgaaacucuuaugcugcucgccuugauugcaguucugaccgggggagugacguuauuuuuccuaucaggaaaaggccuggggaagacaaguaucggacuccuuuguguaauggcgagcuccgcccuguuguggauggcuaacguggagccucacuggauugccgcaucuaucauacuggaauuuuuccucaugguccugcuuauccccgagccagaccgucagagaacuccucaggauaaucaacucgcuuaugugguuauuggucuguuguuuaugauccugaccguggccgcaaacgagaugggcuuacuagaaacaaccaagaaagaccuggggauuggauacgucgccgcugagaaccagcaucacgcgacuaugcucgauguagaccuuaggcccgccagcgcauggacacuguacgcuguggccacgaccguuaucacuccaaugaugcgccacacaauagaaaauaccaccgccaacauuuccuugacagcaaucgcuaaucaggccgcgauucugaugggccucgauaaggguuggccuaucucaaaaauggacauaggggugccgcugcuugcuuuaggcugcuauucucaagucaacccccugacucucacggccgcaguguugaugcuggucgcccauuacgcuaucauuggaccaggccuacaggcaaaggccacccgggaggcgcagaaacgaacagcugccgggaucaugaagaauccuacuguggauggaauuguugcaaucgaccuggaccccgugguauaugaugccaaguucgaaaaacagcucggccaaauaaugcuucugauuuuguguaccagucagauccugcucaugagaacaaccugggcucugugcgagucgaucacuuuagccacggguccacuuacaacccugugggaggggagcccuggaaaguuuuggaacacuaccauugcaguguccauggcuaauaucuucaggggcucuuaccucgccggugcgggccuagccuucucacugaugaaaagccuagggggaggccgccgggggacaggagcacagggcgaaacucugggugagaaguggaagagacagcucaaccaacuuuccaagagugaauuuaauaccuauaagcguucugggauaauggaggucgacaggagcgaagcuaaagagggacugaagcggggcgagacaacgaaacacgccguuucacgcgguaccgcaaaguugcgaugguucguggaaagaaaccuggucaaacccgagggcaaggugauugaucucggguguggaaggggcgggugguccuacuauugcgcuggauuaaagaaaguaacugaagugaagggcuacacaaaaggugggccgggacaugaggaaccaaucccuauggccaccuacggcuggaaucugguuaaacuuuauaguggcaaagacguguuuuucacucccccagagaagugugauacacugcuaugcgacauuggggagagcucucccaacccuaccaucgaagagggacggacgcuccgcguccugaaaaugguggaaccgugguugagagguaaucaguuuuguauaaagauccugaaccccuacaugccauccgucguggagacccucgagcagaugcagaggaagcacggcgggaugcuuguucgaaauccucugucacggaacagcacacaugaaauguauuggguaucgugcggaacuggcaauauugugucugccgucaacaugaccagucguauguuacugaacagauucacaaugacucaccgcaaacccaccuacgagagggauguggacuugggugcggggacacggcacguugcuguggaaccugaggucgcaaaucucgauaucauuggacaaagaaucgaaaacauuaagaaugagcauaaauccaccuggcacuaugacgaggauaacccauacaagacuugggccuaucauggcagcuacgaagugaaacccucaggcuccgcuucuagcaugguaaauggggugguucgccugcuaacgaagccuugggacgucaucccaauggugacacagauagccaugaccgacacuacccccuuuggacagcaaaggguguucaaggagaaagucgauacacgaacgccgcgggcaaagagagguaccgcccagauuauggaaguuacugcuaaauggcuuuggggcuuucugaguaggaacaagaaaccucgcaucuguacacgugaggaguucacccggaaggugagauccaaugcggccaucggggcaguauuuguggacgagaaccaguggaauagcgcuaaggaggccgucgaagaugagagguucugggaccucgugcaccgcgaacgagagcugcacaaacagggaaagugcgcaacuugcguuuacaacaugaugggcaaacgggaaaagaaauugggugaguuugggaaggccaagggaucuagagcuauuugguauauguggcugggcgccagguuccucgaguucgaagcgcuuggcuuuaugaaugaggaucauugguucucacgcgaaaacaguuuuuccgggguggagggagagggucugcacaaauuaggcuacauacugagagacaucagcaagauuccagggggaaauauguaugcagaugacacagccggcugggauacccggaucacagaagacgauuugcaaaacgaggcuaaaauuacugacaucauggaacccgagcaugcccuccuggcaaccucuauauucaagcuaacguaccagaauaaagucgugaggguacagcguccugcuaagaacgguaccguuauggaugugaucucgcgacgcgaccagagagggucaggacaagucggcacauauggccuuaacacuuuuaccaauauggaagugcagcugauucggcagauggagagcgaggggaucuuccucccauccgaacuggagacacccaacuuggccgaaaggguguuaaauuggcuggagaaacacggaacugaacgccucaagagaauggcuauuaguggugacgauugugucguuaagccgguggacgaucgguuugccaccgcacuuaucgcgcugaacgacaugggcaaaguaaggaaggauauaccucagugggagcccucuaaaggguggaaugacuggcaacaggugccauucugcagccaucacuuucaccagcuaauuaugaaggauggacgagagaucgucgugccuugucguaaccaggacgaacugguuggcagagcccgcgugucccaaggugcuggguggucacuccgggagacggccugcuugggaaaaaguuacgcacagauguggcagcugauguauuuccauaggagagaucuucgccuggcugccaaugcaaucuguucugccguccccguggacuggguaccaacaagccggaccacuugguccauucacgcgcaucaccaauggaugacaaccgaagauaugcucucaguuuggaacaggguguggauagaggaaaaucccuggauggaggacaagacucacgucagcucuugggaggaagugccuuacuuaggcaagcgagaggaccaguggugcggcucccugaucggguugaccgcuagagccacaugggcaacgaacauucagguugccaucaaucaggugcggaggcugauuggaaacgaaaauuaccucgauuauaugaccaguaugaaacgcuuuaagaacgagagcgacccagagggugcucuuugguga

SEQ ID NO: 13472 - RNA, 9879 nt, Artificial Sequence
  derived and/or modified CDS sequence (opt3) from DENV-1__FJ205872__SS-prME
agcgugaccaugcugcucaugcuucugcccaccgccuuggcuuuccacuuaacuacgagaggaggggagccucauaugaucgucuccaagcaggaaaggggaaagucucugcuauuuaagaccucagcugguauuaacaugugcacacucauagccauggaccugggcgagcuuugugaagauacuaugaccuacaagugcccacggaucacagaggcggaaccggacgauguugacuguuggugcaaugcuaccgauacuugggugacauaugggaccuguagucagacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcauuuuuccuggcccaugcuaucggcaccucgauuacgcagaagggcaucauauuuauccucuuaaugcugguuacuccaucaauggccaugcggugcguggggauuggaaaccgcgauuucgucgagggucuuagcggcgcgacauggguggacguaguuuuggagcacgggaguugugugaccacuauggcaaaagauaagcccacacuggacaucgaacuacucaaaaccgaggucacgaauccugccgugcugagaaaacuuugcauugaagcuaaaaucuccaacaccacaacugauucuagguguccaacccaaggagaggccacacugguggaagaacaggacagcaauuuugucugccggcgcacuuucguugaucgaggcugggguaacggguguggauuguuuggcaagggcucccuccugaccugcgcaaaguucaaaugcgugacaaaguuagaggggaaaauaguacaguacgaaaaucugaaguauucagugauugucaccgugcacacuggagaccagcaucaaguugguaacgagacgacagaacacggcaccaucgcuacuauuacaccccaggccccuacaagugagauccagcucaccgacuacggggcgcuuacucuggauuguagcccaagaacaggauuggacuuuaaugaaauggugcuacugacgaugaaagagaagucuuggcucguccauaaacagugguuccuggaucuuccgcugcccuggaccuccggcgccucaacuagccaagagacauggaacaggcaggacuugcucgugaccuuuaagacagcacacgcuaagaaacaggaaguaguugugcuggguagucaagagggggccaugcacacugcuuuaaccggcgccacggaaauccagaccucuggaacaacuaccauuuucgcaggccaucugaagugccggcuaaaaauggauaagcucacacugaaagggauguccuaugucauguguacuggcagcuucaaacuugagaaggaaguggccgagacccagcacgguacggucuuggugcagguuaaauacgagggcacagacgcuccuugcaagauaccauuuucggcgcaagaugaaaaaggggugacccagaauggacgucugaucacugcaaaccccauuguaacagacaaggagaaaccugucaauaucgaaaccgagccacccuucggcgagucuuauauagugguuggugccggggaaaaggcucucaagcuguccugguuuaaaaagggcucaaguauuggaaaaauguucgaggccacugcacgcggcgccagaaggauggcuauccuuggggauaccgccugggacuuuggaagcaucgguggcguguucacauccgucgggaagcuggugcaucagguauuuggagcagcguacggcguguuguucucugguguuagcuggacgaugaaaauugggaucggcauucuccugaccugguuaggacugaacucacggaguacuucccuaagcaugacauguauagcugucggcauggugacccucuaccugggggugaugguccaggccgauucuggaugcguuaucaauuggaagggccgagaacuuaagugugguucagggauuuuugugacaaacgaggugcacacuuggaccgaacaauauaaauuccaggcagacaguccgaagcgcuugagcgccgcuaucggaaaagccugggaggagggcguaugcgguaucagauccgcaacgaggcuggaaaacauuauguggaagcagauaucuaaugagcucaaccauauccuguuagaaaaugacaugaaauuuacagucgugguuggcgaugcuaacgggauucuggcccagggaaagaaaaugauccggccucaacccauggagcaccgcuacucguggaaaagcuggggcaaggcgaagauuaucggggccgacauacaaaauuccaccuucaucauugauggaccagacacuccugaaugucccgaugaccagagagcuuggaacaucugggagguggaggauuauggcuuugguauuuucaccacaaauaucuggcuuaaguugagggacucauacacucagaugugcgaucaccgucucaugagugcagccauaaaagacucuaaggcuguccaugccgauaugggguauuggauugaaagcgagaaaaacgaaaccuggaagcuggcacgggcguccuucaucgaggugaagacauguauuuggccaaaaucacacacgcuauggagcaauggaguucuggaaucugagaugaucauacccaagaucuacggcgguccuauuucccaacauaacuaucgaccaggcuacuuuacccagacugccgggccguggcaccucggaaaacuggagcuugacuucgauuugugcgaaggcacaaccgugguagucgacgagcacugcgggaauagaggacccagucugaggacuacaaccgugacgggcaagaucauucaugaaugguguugccgcagcuguacuuuaccuccacuccgguuuagaggugaggacgggugcugguacggaauggagaucaggcccgugaaagaaaaggaggaaaaccugguccgcucuaugguuuccgcuggcucaggugagguggauaguuucagccuuggcauacuguguguaucgauuaugaucgaagaggugaugcgaucccgguggucucguaagauguugaugaccgggacacucgccgucuuucugcuacugaucaugggacagcucaccuggaaugaccugauuagacuuugcaucauggugggcgcaaacgcuagcgauaggauggggaugggaacuacauauuuggcccugauggcaaccuucaaaaugcgcccuauguuugccguuggcuuacucuuccggagacugacaucaagggaggugcuucugcuaacuauuggucucagucuggucgcuuccguggaauugccaaauucucuggaggaauuaggggacggacucgcgaugggcauaaugaugcugaaacuucugaccgaguuucaaccccaccaguuguggacgacacuccugagccuaaccuucaucaaaacuacccugucccuugauuacgccuggcgaacaauggcaaugguucucucaauugugagccuguuuccguugugucugaguacuaccucucagaagacgacaugguuaccuguccuccugggcuccuucgggugcaaaccacuuaccauguuucugaucacugaaaacaagauuuggggacgcaagagcuggcccuugaacgaggguaucauggcuauaggcaucguaucgauucuccugucaucucuacugaaaaaugacgugccucuugccgggccccucaucgccggaggcaugcugauugcuuguuauguuaucagugguuccagcgcagauuugucuuuagagaaggccgcggaagugagcugggaggaagaggcugaacauuccgggacaucacacaacauacuggucgaggugcaggacgauggaaccaugaaaauuaaggacgaggaacgggaugacacucucacaauccugcuuaaagccacccuguuggcaguaaguggcguguacccaaugagcaucccugccacgcuauucgucugguauuucuggcaaaagaaaaagcagagaucuggcguucugugggauacucccuccccaccggagguggaaagggcugugcucgacgacgggauuuaccguauacugcagcgcggacuuuuaggucggucacaggucggcguggggguuuuucaagauggaguauuccauaccauguggcacgugacaagaggcgcaguccugauguaucaggguaagaggcucgagccuaguugggccagcgugaaaaaggacuugaucuccuacgggggaggcuggcgauuucagggcucuuggaauaccggggaggaaguucaggugauugcggucgagcccggcaagaacccaaagaaugugcaaacaacucccgguaccuucaaaacgccugaaggcgagguaggggcuaucgcccuggauuuuaagccaggaacaucgggcagccccauugucaaccgggaagguaagaucguggggcucuacggaaauggcguugugacuaccucaggcacauaugucuccgcaauagcccaggcuaaaaccagucaggaggggccucugccggagaucgaagaggaaguguucaagaaacgcaaccuuacuauuauggaccugcacccaggaucugguaagaccagaagguacuugcccgccaucguucgggaggcaauuaaacgaaagcuaagaacacugauccucgcuccuacgcgcguggucgccagcgaaauggcggaggccuuaaagggcaugccaauaagguaucaaacuaccgcagugaaauccgagcauacagggcgugaaauuguagaucugaugugccacgcuaccuuuacuaugcggcuucugucacccgugagaguuccuaauuacaacaugaucaucauggacgaggcccauuucacagauccggcuucuauugcagccaggggauauaucagcacccgcgucggcaugggugaagccgcugcgauauuuaugacggcaacucccccagggaguguggaggccuucccucaguccaaugcugugauucaggacgaagaacgagauauccccgagagaagcuggaacucuggauacgacuggauuacagauuuuccaggcaagaccgucugguucguaccuucaaucaaauccggcaaugacauagccaacugucuccggaagaaugggaaaagggugauucaguugagucgcaagaccuucgacacugaauaucaaaagacacguaacaacgauugggacuacguugugaccacagauaucagcgagaugggagcaaauuuuagagccgaccgggucaucgaucccaggcgcugccugaaaccagugauucucaaggacgguccggaacgaguuauccuggcuggcccuaugcccgugacugucgcgucggccgcacagagacgggggaggauuggacgcaaccagaauaaagagggcgaucaguacguguauaugggucaaccacuuaacaaugacgaggaucacgcucauuggacggaagccaagaugcuacuggacaacauaaauacccccgaggggaucauuccugcauuguucgaaccagagagagaaaaaucugccgcuaucgauggcgaguacagguuacggggagaggcccguaagacauuuguagaacugaugcgccgaggcgaccuccccguguggcuguccuauaagguugcgagcgagggguuccaguacucagauagaagguggugcuuugacggagaacggaacaaucagguccuugaggaaaacauggacguggagaucuggacuaaagagggugaacgcaagaaacugagaccuagguggcucgaugcacggaccuauagugacccguuggcccugcgagaguucaaggaauuugcugccggcagacgcucuguguccggggaucuaauucuggagauaggaaaacucccacagcaccuuacacugagggcucaaaaugcauuagacaacuuggucaugcugcacaauagcgaacagggcgguaaggccuaccggcaugcuauggaggagcuccccgauaccaucgaaacucugaugcuucuggcccucauugcagcguugaccgggggaguuacgcuguucuuuuuaucaggaaaaggccuagggaagacaaguaucggacugcucugugugauggccagcuccgcacuucuguggauggccaacguagagccucacuggauugcagcuucuaucauauuggaguucuuucugauggugcuccugauccccgagccagaccgucagagaacuccucaggauaaucaacuugccuaugucgugauuggucuccuguucaugaucuugaccguugcagccaacgagaugggccuguuagaaacaaccaagaaagaccuagggauuggauacguggcugcggagaaccagcaucacgccacuaugcuggaugucgaccucaggcccgcaagcgcuuggacacuuuacgccguagccacgaccgugaucacuccaaugaugcgccacacaauagaaaauaccaccgcaaacauuucccugacagcuaucgccaaucaggcggcuauuuugaugggccuggauaaggguuggccuaucucaaaaauggacauagggguuccgcuccuggcccuuggcugcuauucucaagugaaccccuuaacucugacggcagccguccucauguugguggcucauuacgcaaucauuggaccaggccugcaggccaaggcgacccgggaggcucagaaacgaacagccgcagggaucaugaagaauccuacugucgauggaauuguggccaucgaccuagaccccguuguguaugaugcuaaguuugaaaaacagcugggccaaauaaugcuccuuauucuguguaccagucagaucuugcugaugagaacaaccugggcccucugcgagucgaucacucuggcaacggguccauuaacaacccuuugggaggggagcccuggaaaguucuggaacacuaccauugcuguauccauggccaauaucuucaggggcucuuaccuggcgggugccggccucgcauuuucacuaaugaaaagccuagggggaggccgccgggggacaggagcucagggcgaaacuuugggugagaaguggaaaagacagcugaaccaacucuccaagagugaguucaauaccuauaagcguucugggauaauggaaguggacaggagcgaagccaaagagggacuuaagcggggcgagacaacgaaacacgcagucucacgcgguaccgcuaagcugcgaugguuuguugaaagaaacuuggugaaacccgagggcaaggucauugaucugggguguggaaggggcgggugguccuacuauugcgccggacucaagaaagugacugaaguaaagggcuacacaaaaggugggccgggacaugaggaaccaaucccuauggccaccuacggcuggaauuuagugaagcuguauaguggcaaagacguuuucuuuacucccccagagaagugugauacacuucugugcgacauuggggagagcucucccaacccuaccaucgaagagggacggacgcuacgcgugcucaaaauggucgaaccguggcugagagguaaucaguucuguauaaagaucuugaaccccuacaugccauccguggucgagacccuggagcagaugcagaggaagcacggcgggaugcucgugcgaaauccucuuucacggaacagcacacaugaaauguauuggguuucgugcggaacuggcaauauuguaucugcggugaacaugaccagucguaugcuguuaaacagauuuacaaugacucaccgcaaacccaccuacgagagggaugucgaccugggugcugggacacggcacguggcaguugaaccugagguggccaauuuggauaucauuggacaaagaaucgaaaacauuaagaaugagcauaaauccaccuggcacuaugacgaggauaacccauacaagacuugggcuuaucauggcagcuacgaagucaaacccucaggcuccgccucuagcauggugaaugggguagugcgccuccugacgaagccuugggacguuaucccaauggucacacagauagcaaugaccgacacuacccccuucggacagcaaaggguguuuaaggagaaaguggauacacgaacgccgcgggccaagagagguaccgcucagauuauggaagucacugcgaaauggcuauggggcuuccuuaguaggaacaagaaaccucgcaucuguacacgugaggaauuuacccggaagguuagauccaaugccgcaaucggggcuguguucguagacgagaaccaguggaauagcgccaaggaggcaguggaagaugagagguuuugggaccugguccaccgcgaacgagagcuccacaaacagggaaagugcgccacuugcguguacaacaugaugggcaaacgggaaaagaaacugggugaguucgggaaggcuaagggaucuagagccauuugguauaugugguugggcgcgagguuccuggaguuugaagcacucggcuucaugaaugaggaucauugguuuucacgcgaaaacaguuucuccgggguugagggagagggucuucacaaacugggcuacauauuaagagacaucagcaagauuccagggggaaauauguaugccgaugacacagcuggcugggauacccggaucacagaagacgaucugcaaaacgaggccaaaauuacugacaucauggaacccgagcaugcauugcucgcuaccucuauauuuaagcugacguaccagaauaaaguggucagggugcagcguccugccaagaacgguaccguaauggauguuaucucgcgacgcgaccagagagggucaggacaagugggcacauauggccuaaacacuuucaccaauauggaaguccagcuuauucggcagauggagagcgaggggaucuuucugccauccgaacucgagacacccaaccuggcugaaaggguguugaauugguuagagaaacacggaacugaacgccugaagagaauggccauuaguggugacgauuguguggucaagccgguugacgaucgguucgcaaccgcgcucaucgcccuuaacgacaugggcaaagugaggaaggauauaccucagugggagcccucuaaaggguggaaugacuggcaacagguaccauuuugcagccaucacuuccaccagcugauuaugaaggauggacgagagaucguggucccuugucguaaccaggacgagcuggugggcagagcucgcguuucccaaggugccggguggucacugcgggagacggcaugccucggaaaaaguuacgcucagauguggcaguugauguauuuucauaggagagaucugcgccuugccgcaaaugccaucuguucugcggugcccgucgacugggugccaacaagccggaccacuugguccauucacgcucaucaccaauggaugacaaccgaagauaugcugucaguauggaacaggguuuggauagaggaaaaucccuggauggaggacaagacucacgugagcucuugggaggaagucccuuaccucggcaagcgagaggaccaguggugcggcuccuuaaucgggcugaccgccagagcaacaugggccacgaacauucagguggcuaucaaucagguucggagguugauuggaaacgaaaauuaccuggauuauaugaccaguaugaaacgcuucaagaacgagagcgacccagagggugcccucugguga

SEQ ID NO: 13473 - RNA, 9879 nt, Artificial Sequence
  derived and/or modified CDS sequence (opt3) from DENV-1__FJ205873__SS-prME
agcgugaccaugcugcucaugcuucugcccacagccuuggcuuuccacuuaacuacgagaggcggggaaccucauaugaucgucuccaagcaggaaagaggaaaaucucuguuauuuaagaccucagcagguauuaacaugugcacacucauagccauggaccugggcgagcuuugugaagauacuaugaccuacaaaugcccacggaucacagaggcggaaccggacgauguugacuguuggugcaaugcuaccgauacuugggugacauaugggaccuguagucagacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcacuguuucucgcccaugcuaucggcaccucgauuacgcagaagggcaucauauucaucuuacugaugcuuguuacuccaucaauggccaugcggugcguggggauuggaaaccgcgauuuugucgaggguuugagcggcgcgacauggguggacguaguucuggagcacgggaguugugugaccacuauggcaaaagauaagcccacauuggacaucgaacuccugaaaaccgaggucacgaauccugccgugcuuagaaagcugugcauugaagcuaaaaucuccaacaccacaacugauucuagguguccaacccaaggagaggccacauugguggaagaacaagacagcaauuucgucugccggcgcacuuuuguugaucgaggcugggguaacggguguggacucuucggcaagggcucccuguuaaccugcgcaaaguuuaaaugcgugacaaagcuggaggggaaaauaguacaguacgaaaaucucaaguauucagugauugucaccgugcacacuggagaccagcaucaaguugguaacgagacgacagaacacggcaccaucgcuacuauuaccccacaagccccuacaagugagauccagcuuaccgacuacggggcgcugacuuuggauuguagcccaagaacaggacuagacuucaaugaaauggugcugcucacgaugaaagagaagucuuggcugguccauaaacagugguuucuugaucugccguugcccuggaccuccggcgccucaacuagccaagagacauggaacaggcaggaccuccuggugaccuucaagacagcacacgcuaagaaacaggaaguaguuguguuagguagucaagagggggccaugcacacugcucugaccggcgccacggaaauccagaccucuggaacaacuaccauuuuugcaggccaucuaaagugccggcucaaaauggauaagcugacacuuaaagggauguccuaugucauguguacuggcagcuucaaguuggagaaggaaguggccgagacccagcacgguacgguccuggugcagguuaaauacgagggcacagacgcuccuugcaagauaccauucucggcgcaagaugaaaaaggggugacccagaauggacgucucaucacugcaaaccccauuguaacagacaaggagaaaccugucaauaucgaaaccgagccacccuuuggcgagucuuauauagugguuggugccggggaaaaggcucugaaacuuuccugguucaaaaagggcucaaguauuggaaaaauguuugaggccacugcacgcggcgccagaaggauggcuauccugggggauaccgccugggacuucggaagcaucgguggcguguuuacauccgucgggaaguuggugcaucagguauucggagcagcguacggcgugcucuuuucugguguuagcuggacgaugaaaauugggaucggcauucuguuaaccuggcugggacuaaacucacggaguacuucccucagcaugacauguauagcugucggcauggugacccuguaccuuggggugaugguccaggccgauucuggaugcguuaucaauuggaagggccgagaauugaagugugguucagggauuuucgugacaaacgaggugcacacuuggaccgaacaauauaaauuucaggcagacaguccgaagcgccugagcgccgcuaucggaaaagccugggaggagggcguaugcgguaucagauccgcaacgaggcucgaaaacauuauguggaagcagauaucuaaugagcugaaccauaucuuacuggaaaaugacaugaaauucacagucgugguuggcgaugcuaacgggauucuugcccagggaaagaaaaugauccggccucaacccauggagcaccgcuacucguggaaaagcuggggcaaggcgaaaauuaucggggccgacauacaaaauuccaccuuuaucauugauggaccagacacuccugaaugucccgaugaccagagagcuuggaacaucugggagguggaggauuauggcuucgguauuuuuaccacaaauaucugguugaagcucagggacucauacacucagaugugcgaucaccgucugaugagugcagccauaaaagacucuaaggcuguccaugccgauaugggguauuggauugaaagcgagaaaaacgaaaccuggaagcuagcacgggcguccuucaucgaggugaagacauguauuuggccaaaaucacacacgcuguggagcaauggaguucucgaaucugagaugaucauacccaagaucuacggcgguccuauuucccaacauaacuaucgaccaggcuacuucacccagacugccgggccguggcaccugggaaaacuugaguuggacuuugaucugugcgaaggcacaaccgugguagucgacgagcacugcgggaauagaggacccaguuuaaggacuacaaccgugacgggcaagaucauucaugaaugguguugccgcagcuguacucucccuccacugcgguucagaggugaggacgggugcugguacggaauggagaucaggcccgugaaagaaaaggaggaaaaccuuguccgcucuaugguuuccgcuggcucaggugagguggauaguuuuagccugggcauauuguguguaucgauuaugaucgaagaggugaugcgaucccgguggucucguaagaugcucaugaccgggacacuggccgucuuccuacugcucaucaugggacagcugaccuggaaugaccuuauuagauugugcaucauggugggcgcaaacgcuagcgauaggauggggaugggaacuacauaucuggccuuaauggcaaccuuuaaaaugcgcccuauguucgccguuggccuccuguuucggaaacuuacaucaagagaggugcugcuacucacuauuggucugaguuuggucgcuuccguggaacugccaaauucuuuagaggaacucggggacggacuggcgaugggcauaaugaugcuuaaacuguugaccgaguuccaaccccaccagcucuggacgacacugcuaagccugaccuuuaucaagacuacccuuucccucgauuacgccuggaggacaauggcaaugguucugucaauugugagcuuguucccgcuguguuuaaguacuaccucucagaaaacgacauggcucccuguccugcuuggcuccuuugggugcaagccacugaccauguucuugaucacugaaaacaagauuuggggacgaaaaagcuggccccucaacgaggguaucauggcuauaggcaucguaucgauucugcuaucaucucugcuuaagaaugacgugccucucgccgggccccugaucgccggaggcauguugauugcuuguuauguuaucagugguuccagcgcagauuuaucucuggagaaagccgcggaagugagcugggaggaagaggcugaacauuccgggacaucacacaacauacucgucgaggugcaggacgauggaaccaugaagauuaaagacgaggaacgcgaugacacucugacaauccuucugaaggccaccuugcuagcaguaaguggcguguacccaaugagcaucccugccacgcuguuugucugguauuucuggcagaagaagaagcagcggucuggcguucucugggauacucccuccccaccggagguggaaagagcugugcuggacgacgggauuuacaggauacuucagcguggauuacugggucgcucacaggucggcguggggguuuuccaagauggaguauuucauaccauguggcacgugacacggggcgcaguccucauguaucaggguaaaagauuggagccuaguugggccagcgugaagaaagaccugaucuccuacgggggaggcuggagguuccagggcucuuggaauaccggggaggaaguucaggugauugcggucgagcccggaaagaaccccaagaaugugcaaacaacucccgguaccuuuaagacgccugaaggcgagguaggggcuaucgcccucgauuucaagccaggaacaucgggcagccccauugucaaccgagaagguaaagugguugggcuguacggaaauggcguggucacuaccucaggcacauauguguccgcaaucgcccaggcuaagaccagucaggaggggccucuuccggagauagaagaggaaguuuuuaaaaagcggaaccugacuaucauggacuugcacccaggaucugguaaaacccgcagauaccuacccgccauugugagggaggcaaucaagcggaagcugcgaacacucauuuuagcuccuacgagagucguggccagcgaaauggcggaggcccugaaaggcaugccaauccgcuaucaaacuaccgcaguaaaguccgagcauacagggagggaaauaguggaucuuaugugccacgcuaccuucacuaugcgucugcucucacccguucgggucccuaauuacaacaugauuaucauggacgaggcccauuuuacagauccggcuucuaucgcagccagaggauauauuagcaccagggugggcaugggugaagccgcugcgaucuucaugacggcaacucccccagggaguguggaggccuuuccucaguccaaugcugucauacaggacgaagaacgcgauauucccgagcgaagcuggaacucuggauacgacuggaucacagauuucccaggcaaaaccguaugguuugugccuucaauuaaguccggcaaugacaucgccaacuguuugaggaagaaugggaagcggguuauacagcugaguaggaagaccuucgacacugaauaucagaagacgcgcaacaacgauugggacuacguggucaccacagauauuagcgagaugggagcaaauuuccgugccgacagagugaucgauccccggaggugccucaagccaguuauccugaaagacgguccggaacgcgugauucuugcuggcccuaugcccgucacuguggcgucggccgcacagcgaagagggcggaucggaaggaaccagaauaaggagggcgaucaguacguauauaugggucaaccacuaaacaaugacgaggaucacgcucauuggacggaagccaaaaugcuguuggacaacauuaauacccccgaggggauaaucccugcauuauuugaaccagagcgcgaaaagucugccgcuauugauggcgaguacagacugaggggagaggcccggaagacauucguggaacucaugcgucgcggcgaccugcccguuuggcuuuccuauaaagucgcgagcgagggguuucaguacucagaucgaagauggugcuucgacggagaaaggaacaaucaggugcuggaggaaaacauggacguggagaucuggacuaaggagggugaacggaaaaagcuccgcccuagaugguuggaugcaaggaccuauagugacccgcuggcccuacgggaguuuaaagaguucgcugccggccgaagaucugucuccggggaucugauccucgagauuggaaaacuuccacagcaccugacauuacgcgcucaaaaugcauuggacaaccugguuaugcuccacaauagcgaacagggcgguaaagccuacaggcaugcuauggaggagcugcccgauaccauagaaacucuuaugcugcucgccuugaucgcagugcugacagggggaguaaccuuauuuuuccuaucaggaaagggccuggggaagacaaguauuggacuccuuugugugauggcgagcuccgcccuguuguggauggcuaacgucgagccucacuggaucgccgcaucuauuauccuggaauuuuuccucauggugcugcuuauacccgagccagaccggcagcguacuccucaggauaaucaacucgcuuauguugugaucggucuguuguuuaugauucugaccgucgccgcaaacgagaugggcuuacuagaaacaaccaaaaaggaccuggggaucggacauguagccgcugagaaccagcaccacgcgacuaugcucgauguggaccuuagacccgccagcgcauggacacuguacgcuguugccacgaccgugauuacuccaaugaugaggcauacaaucgaaaauaccaccgccaacauauccuugacagcaauugcuaaucaggccgcgauccugaugggccucgauaaagguuggccuauuucaaagauggacaucggggucccgcugcuugcuuuaggcugcuacucucaagugaacccccugacucucacggccgcagucuugaugcugguggcccacuaugcuauaaucggaccaggccuacaggcaaaagccacccgcgaggcgcagaagcggacagcugccgggauuaugaagaauccuacuguugauggaaucguggcaauugaccuggaccccguaguguacgaugccaaauucgaaaagcagcucggccaaaucaugcuucugauauuguguaccagucagauucugcucaugcgaacaaccugggcucugugcgagucgaucacuuuagccacggguccacuuacaacccugugggaggggagcccuggaaaauuuuggaacacuaccaucgcagucuccauggcuaauauuuucagaggcucuuaucucgccggugcgggccuagccuucucacugaugaaaagccuagggggaggcaggcgcgggacaggagcacagggcgaaacucugggugagaaauggaagcggcagcucaaccaacuuuccaagagugaauuuaauaccuacaaaagaucugggaucauggagguugaccguagcgaagcuaaggagggacugaaaaggggcgagacaacgaagcaugccgugucacgggguaccgcaaaauugcgcugguucgucgaacgaaaccuggugaagcccgagggcaagguaauagaucucggguguggaagaggcgggugguccuauuacugcgcuggacuaaagaaggugacugaaguuaaaggcuauacaaagggugggccgggacacgaggaaccaauuccuauggccaccuacggcuggaaucuggugaaacuuuacaguggcaaggacgucuuuuucacucccccagagaaaugugauacacugcuaugcgacaucggggagagcucucccaacccuaccauugaagagggaaggacgcuccgggugcugaagauggucgaaccgugguugcgcgguaaucaguuuuguaucaagauacugaaccccuauaugccauccgugguugagacccucgagcagaugcagagaaaacauggcgggaugcuuguaaggaauccucugucacgaaacagcacacacgaaauguacugggugucgugcggaacuggcaauaucgucucugccgugaacaugaccagucggauguuacugaaccguuucacaaugacucacagaaagcccaccuaugagcgcgauguugacuugggugcggggacaaggcauguggcugucgaaccugagguggcaaaucucgauauuaucggacaacggauugaaaacaucaaaaaugagcacaaguccaccuggcauuacgacgaggauaacccauauaaaacuugggccuaccacggcagcuaugaaguaaagcccucaggcuccgcuucuagcauggugaaugggguugucagacugcuaacgaagccuugggacgugauuccaauggugacacagaucgccaugaccgacacuacccccuuuggacagcaacgcgucuucaaagagaagguugauacaaggacgccgcgagcaaaacgggguaccgcccagauaauggaagugacugcuaaguggcuuuggggcuuucugaguagaaacaaaaagccuaggauuuguacacgcgaggaguucacccguaagguacgguccaaugcggccaucggggcaguguuugucgacgagaaccaguggaauagcgcuaaagaggccguggaagaugagagauucugggaccucguucacagggaacgcgagcugcauaagcagggaaaaugcgcaacuugcguguacaacaugaugggcaagcgagagaaaaaguugggugaguuugggaaggccaaaggaucucgggcuaucugguacauguggcugggcgccagauuccucgaguucgaagcgcuuggcuuuaugaaugaggaucacugguucucaagggaaaacaguuuuuccggggucgagggagagggucugcauaaguuaggcuauauucugcgcgacauaagcaaaaucccagggggaaauauguacgcagaugacacagccggcugggauaccagaauuacagaagacgauuugcaaaacgaggcuaagaucacugacauuauggaacccgagcacgcccuccuggcaaccucuaucuucaaacuaacguaucagaauaaggugguacggguucagaggccugcuaaaaacgguaccgugauggaugucauaucgcgucgagaccagcgcgggucaggacaagugggcacauacggccuuaacacuuuuaccaauauggaagugcagcugaucagacagauggagagcgaggggauuuuccucccauccgaacuggagacacccaacuuggccgaacgggucuuaaauuggcuggagaagcauggaacugaaaggcucaagcgcauggcuaucaguggugacgauuguguugugaaaccgguagacgauagauuugccaccgcacuuauugcgcugaacgacaugggcaaggugcggaaagauaucccucagugggagcccucuaagggguggaaugacuggcaacaggucccauucugcagccaccacuuucaucagcuaauaaugaaagauggaagggagauugugguuccuugucgaaaccaggacgaacuggugggccgugccagagucucccaaggugcuggguggucacuccgcgagacggccugcuugggaaagaguuaugcacagauguggcagcugauguacuuccaccggagggaucuuagacuggcugccaaugcaaucuguucugccgugcccguagacuggguuccaacaagccgcaccacuugguccauccaugcgcaccaccaauggaugacaaccgaagauaugcucucaguguggaaccgggucuggauugaggaaaaucccuggauggaggacaagacucaugugagcucuugggaggaaguuccuuauuuaggcaaaagggaggaccaguggugcggcucccugauaggguugaccgcucgagccacaugggcaacgaacauccagguggccauuaaucaggucagacggcugaucggaaacgaaaauuaccucgauuacaugaccaguaugaagagguuuaaaaacgagagcgacccagagggugcucuuugguga

SEQ ID NO: 13474 - RNA, 9879 nt, Artificial Sequence
  derived and/or modified CDS sequence (opt3) from DENV-1__FJ390379__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguauuaacaugugcacacucauagccauggaccugggcgagcuuugugaagauacuaugaccuacaaaugcccacggaucacagaggcggaaccggacgauguugacuguuggugcaaugcuaccgauacuugggugacauaugggaccuguagucaaacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcacuguuucucgcccaugcuaucggcaccucgauuacgcagaagggcaucauauucaucuuacugaugcuuguuacuccaucaauggccaugcggugcguggggauuggaaaccgcgauuuugucgaggguuugagcggcgcgacauggguggacguaguucuggagcacgggaguugugugaccacuauggcaaaagauaagcccacacuagacaucgaacuccugaaaaccgaggucacgaauccugccgugcuuagaaagcugugcauugaagcuaaaaucuccaacaccacaacugauucuagguguccaacccaaggagaggccacauugguggaagagcaggacagcaauuucgucugccggcgcacuuuuguugaucgaggcugggguaacggguguggacucuucggcaagggcucccuguuaaccugcgcaaaguuuaaaugcgugacaaagcuggaggggaaaauaguacaguacgaaaaucucaaguauucagugauugucaccgugcacacuggagaccagcaucaaguugguaacgagacgacagaacacggcaccaucgcuacuauuaccccccaggccccuacaagugagauccagcuuaccgacuacggggcgcugacuuuggauuguagcccaagaacaggacuagacuucaaugaaauggugcugcucacgaugaaagagaagucuuggcugguccauaaacagugguuucuugaucugccguugcccuggaccuccggcgccucaacuagccaagagacauggaacaggcaggaccuccuggugaccuucaagacagcacacgcuaagaaacaggaaguaguuguguuagguagucaagagggggccaugcacacugcucugaccggcgccacggaaauccagaccucuggaacaacuaccauuuuugcaggccaucuaaagugccggcucaaaauggauaagcugacacuuaaagggauguccuaugucauguguacuggaagcuucaaguuggagaaggaaguggccgagacccagcacgguacgguccuggugcagguuaaauacgagggcacagacgcuccuugcaagauaccauucucggcgcaagaugaaaaaggggugacccagaauggacgucucaucacugcaaaccccauuguaacagacaaggagaaaccugucaauaucgaaaccgagccacccuuuggcgagucuuauauagugguuggugccggggaaaaggcucugaagcuuuccugguucaaaaagggcucaaguauuggaaaaauguuugaggccacugcacgcggcgccagaaggauggcuauccugggggauaccgccugggacuucggaagcaucgguggcguguuuacauccgucgggaaguuggugcaucagguauucggagcagcguacggcgugcucuuuucugguguuagcuggacgaugaaaauugggaucggcauucuguuaaccuggcugggacuaaacucacggaguacuucccucagcaugacauguauagcugucggcauggugacccuguaccuuggggugaugguccaggccgauucuggaugcguuaucaauuggaagggccgagaauugaagugugguucagggauuuucgugacaaacgaggugcacacuuggaccgaacaauauaaauuucaggcagacaguccgaagcgccugagcgccgcuaucggaaaagccugggaggagggcguaugcgguaucagauccgcaacgaggcucgaaaacauuauguggaagcagauaucuaaugagcugaaccauaucuuacuggaaaaugacaugaaauucacagucgugguuggcgaugcuaacgggauucuugcccagggacggaagaugauccgcccucaacccauggagcacagauacucguggaaaagcuggggcaaggcgaagauuaucggggccgacauacagaauuccaccuuuaucauugauggaccagacacuccugaaugucccgaugaccagagggcuuggaacaucugggagguggaggauuauggcuucgguauuuuuaccacaaauaucugguugaaacuccgugacucauacacucagaugugcgaucaccggcugaugagugcagccauaaaggacucuaaagcuguccaugccgauaugggguauuggauugaaagcgagaagaacgaaaccuggaaacuagcacgagcguccuucaucgaggugaagacauguauuuggccaaagucacacacgcuguggagcaauggaguucucgaaucugagaugaucauacccaaaaucuacggcgguccuauuucccaacauaacuauagaccaggcuacuucacccagacugccgggccguggcaccugggaaagcuugaguuggacuuugaucugugcgaaggcacaaccgugguagucgacgagcacugcgggaauaggggacccaguuuacgcacuacaaccgugacgggcaaaaucauucaugaaugguguugccggagcuguacucucccuccacugagauucaggggugaggacgggugcugguacggaauggagauccgccccgugaaggaaaaagaggaaaaccuuguccgaucuaugguuuccgcuggcucaggugagguggauaguuuuagccugggcauauuguguguaucgauuaugaucgaagaggugaugcggucccguuggucuagaaagaugcucaugaccgggacacuggccgucuuccuacugcucaucaugggacagcugaccuggaaugaccuuauuagguugugcaucauggugggcgcaaacgcuagcgaucgcauggggaugggaacuacauaucuggccuuaauggcaaccuuuaagaugcggccuauguucgccguuggccuccuguuuagaaggcuuacaucacgagaggugcugcuacucacuauuggucugaguuuggucgcuuccguggaacugccaaauucuuuagaggaacucggggacggacuggcgaugggcauaaugaugcuuaaacuguugaccgaguuccaaccccaccagcucuggacgacacugcuaagccugaccuuuaucaagacuacccuuucccucgauuacgccuggcgcacaauggcaaugguucugucaauugugagcuuguucccgcuguguuuaaguacuaccucucagaaaacgacauggcucccuguccugcuuggcuccuuugggugcaagccacugaccauguucuugaucacugaaaacaaaauuuggggacggaagagcuggccccucaacgaggguaucauggcuauaggcaucguaucgauucugcuaucaucucugcuuaagaaugacgugccucucgccgggccccugaucgccggaggcauguugauugcuuguuauguuaucagugguuccagcgcagauuuaucucuggagaaagccgcggaagugagcugggaggaagaggcugaacauuccgggacaucacacaacauacucgucgaggugcaggacgauggaaccaugaagauuaaagacgaggaaagagaugacacucugacaauccuucugaaggccaccuugcuagcaaucaguggcguauacccaaugagcauuccugccacgcuguuugugugguauuucuggcaaaaaaagaaacagaggucuggcguccucugggauacucccuccccaccggagguugaacgugcugugcuggacgacgggauauaccgcauccuucagcggggauuacuggguagaucacaggugggcgucgggguguuccaagauggaguuuuucauaccauguggcacguaacaaggggcgcagugcucauguaucaggguaagcgauuggagccuaguugggccagcgucaagaaagaccugauuuccuacgggggaggcuggcgguuccagggcucuuggaauaccggggaggaagugcagguuaucgcgguggagcccggaaagaacccaaaaaauguccaaacaacucccgguaccuuuaagacgccugaaggcgaggugggggcuauugcccucgauuucaaaccaggaacaucgggcagccccaucguaaaccgcgaagguaagauagucgggcuguacggaaauggcgugguuacuaccucaggcacauauguguccgcaaucgcccaggcuaagaccagucaggaggggccucuuccggagauugaagaggaagucuuuaaaaagagaaaccugacuaucauggacuugcacccaggaucugguaaaaccaggcgguaccuacccgccauugugcgagaggcaaucaagagaaaacugcgcacacucauauuagcuccuacgaggguuguggccagcgaaauggcggaggcccugaagggcaugccaauucguuaucaaacuaccgcagucaaguccgagcauacagggcgggaaaucguggaucuuaugugccacgcuaccuucacuaugagacugcucucacccguaagggugccuaauuacaacaugaucauuauggacgaggcccauuuuacagauccggcuucuaucgcagcccgcggauauauaagcacccgaguuggcaugggugaagccgcugcgauuuucaugacggcaacucccccagggagugucgaggccuuuccucaguccaaugcugugauccaggacgaagagagagauauucccgagcggagcuggaacucuggauacgacuggaucacagauuucccaggcaaaaccgugugguuugucccuucaauaaaguccggcaaugacauugccaacuguuugaggaaaaaugggaagcgcguaauccagcugagucguaaaaccuucgacacugaauaucaaaagacaagaaacaacgauugggacuacgugguuaccacagauaucagcgagaugggagcaaauuuccgggccgacagggugauugauccccgccgaugccucaagccagucauccugaaagacgguccggaaagagugauucuugcuggcccuaugcccguuacuguggcgucggccgcacagcggagggggcgcauaggaagaaaccagaauaaggagggcgaucaguacgucuauaugggucaaccacuaaacaaugacgaggaucacgcucauuggacggaagccaaaaugcuguuggacaacaucaauacccccgaggggauuaucccugcauuauuugaaccagagagggaaaagucugccgcuaucgauggcgaguaccggcugcguggagaggcccgcaaaacauucguggaacucaugcgaagaggcgaccugcccguauggcuuuccuauaagguggcgagcgagggguuucaguacucagauaggcgguggugcuucgacggagaacgcaacaaucagguucuggaggaaaacauggacgucgagauuuggacuaaggagggugaaagaaaaaagcucaggccucggugguuggaugcacgaaccuauagugacccgcuggcccuaagagaguuuaaagaauucgcugccggccgcaggucuguguccggggaucugauacucgagaucggaaagcuuccacagcaccugacauuacgggcucaaaaugcauuggacaaccuggugaugcuccacaauagcgaacagggcgguaaagccuaccgucaugcuauggaggagcugcccgauaccauugaaacucuuaugcugcucgccuugaucgcaguccugacggggggcguuaccuuauuuuuccuaucaggaaagggccuggggaaaacaaguauuggacuccuuugugugauggcgagcuccgcccuguuguggauggcuaacguagagccucacuggaucgccgcaucuauaauccuggaauuuuuccucauggugcugcuuauucccgagccagacagacagaggacuccucaggauaaucaacucgcuuaugucgugaucggucuguuguuuaugauucugaccguugccgcaaacgagaugggcuuacuagaaacaaccaagaaggaccuggggaucggacauguggccgcugagaaccagcaccacgcgacuaugcucgaugucgaccuucgccccgccagcgcauggacacuguacgcuguagccacgaccgugauaacuccaaugaugcggcauacaauugaaaauaccaccgccaacaucuccuugacagcaauugcuaaucaggccgcgauccugaugggccucgauaaagguuggccuauaucaaagauggacaucgggguuccgcugcuugcuuuaggcugcuacucucaagugaacccccugacucucacggccgcagucuugaugcugguggcccacuaugcuauuaucggaccaggccuacaggcaaaagccacccgagaggcgcagaagagaacagcugccgggauuaugaaaaauccuacugucgauggaaucguggcaauagaccuggaccccguuguguacgaugccaaguucgaaaagcagcucggccaaauuaugcuucugaucuuguguaccagucagauccugcucaugaggacaaccugggcucugugcgagucgauuacuuuagccacggguccacuuacaacccugugggaggggagcccuggaaaauuuuggaacacuaccaucgcaguauccauggcuaauauauuccgcggcucuuaucucgccggugcgggccuagccuucucacugaugaagagcuuggggggaggccggagagggacaggagcacagggcgaaacucugggugagaaauggaagcgucagcucaaccaacuuuccaaaagugaauuuaauaccuacaagaggucugggauuauggagguggaccggagcgaagcuaaggagggacugaaacgcggcgagacaacgaagcaugccgucucacgagguaccgcaaaauugagaugguucguugaaaggaaccuggugaagcccgagggcaaagucaucgaucucggguguggacggggcgggugguccuauuacugcgcuggauuaaagaaggugacugaaguaaaaggcuauacaaagggugggccgggacacgaggaaccagugccuauggccaccuacggcuggaaucugguuaaacuuuacaguggcaaggacguguuuuucacucccccagagaaaugugauacacugcuaugcgacauuggggagagcucucccaacccuaccaucgaagagggacgcacgcucagaguccugaagaugguggaaccgugguugagggguaaucaguuuuguauaaaaauccugaaccccuauaugccauccgucguggagacccucgagcagaugcagcgaaagcauggcgggaugcuuguucggaauccucugucacguaacagcacacacgaaauguacuggguaucgugcggaacuggcaauauugugucugccgucaacaugaccaguagaauguuacugaaccgcuucacaaugacucacaggaagcccaccuaugagcgggauguggacuugggugcggggacaagacauguugcuguggaaccugaggucgcaaaucucgauaucauuggacaacgcaucgaaaacauuaaaaaugagcacaaguccaccuggcauuacgacgaggauaacccauauaaaacuugggccuaccacggcagcuaugaagugaagcccucaggcuccgcuucuagcaugguaaauggggugguuaggcugcuaacgaaaccuugggacgucaucccaauggugacacagauagccaugaccgacacuacccccuuuggacagcaacgaguguucaaggagaaggucgauacacggacgccgagagcaaaaagggguaccgcccagauuauggaaguuacugcuaaguggcuuuggggcuuucugagucgcaacaaaaagccucguaucuguacacgggaggaauucaccagaaaagugagguccaaugcggccaucggggcaguauuuguggacgagaaccaguggaauagcgcuaaggaggccgucgaagaugagcgcuucugggaccucgugcaccgagaacgggagcugcauaagcagggaaaaugcgcaacuugcguuuacaacaugaugggcaagagagaaaaaaaguugggugaguuugggaaagccaagggaucuagggcuauuugguacauguggcugggcgcccgcuuccucgaguucgaagcgcuuggcuuuaugaaugaggaucacugguucucaagagaaaacaguuuuuccgggguggagggagagggucugcauaaguuaggcuauauacugcgggacaucagcaaaauuccagggggaaauauguacgcagaugacacagccggcugggauaccaggaucacagaagacgauuugcaaaacgaggcuaagauuacugacaucauggaacccgagcacgcccuccuggcaaccucuauauucaaacuaacguaucagaauaaggucgugcguguacagcgaccugcuaaaaacgguaccguuauggaugugaucucgcgcagagaccagcgggggucaggacaagucggcacauacggccuuaacacuuuuaccaauauggaagugcagcugauuaggcagauggagagcgaggggaucuuccucccauccgaacuggagacacccaacuuggccgaacgcguguuagacuggcuggagaagcauggaacugaaagacucaaacggauggcuauuaguggugaugacugugucguuaagccgguggaugacagguuugccaccgcacuuaucgcgcugaaugauaugggcaagguacgaaaagacauaccucagugggagcccucuaagggguggaacgauuggcaacaggugccauucugcagccaccacuuucaucagcuaauuaugaaagacggacgugagaucgucgugccuuguagaaaucaggaugaacugguuggccgcgcccgggugucccaaggugcuggguggucacucagggagacggccugcuugggaaagaguuaugcacagauguggcagcugauguacuuccacagacgcgaccuucggcuggcugccaacgcaaucuguucugccguccccguggauuggguaccaacaagcaggaccacuugguccauucaugcgcaccaccaauggaugacaaccgaagacaugcucucaguuuggaaucgaguguggauagaggaaaaccccuggauggaggacaaaacucaugucagcucuugggaggaagugccuuauuuaggcaagagagaggaucaguggugcggcucccugaucggguugaccgcucgggccacaugggcaacgaauauucagguugccaucaaccaggugaggcgccugauuggaaaugaaaacuaccucgacuacaugaccaguaugaagcguuuuaaaaaugagagcgauccagagggugcucuuugguga

SEQ ID NO: 13475 - RNA, 9879 nt, Artificial Sequence
  derived and/or modified CDS sequence (opt3) from DENV-1__FJ390380__SS-prME
agcgugaccaugcugcucaugcuucugcccaccgccuuggcuuuccacuuaacuacgagaggaggggagccucauaugaucgucuccaagcaggaaaggggaaagucucugcuauuuaagaccucagcagguauuaacaugugcacacucauagccauggaccugggcgagcuuugugaagauacuaugaccuacaagugcccacggaucacagaggcggaaccggacgauguugacuguuggugcaaugcuaccgauacuugggugacauaugggaccuguagucagacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcacuguuucucgcccaugcuaucggcaccucgauuacgcagaagggcaucauauucaucuuacugaugcuuguuacuccaucaauggccaugcggugcguggggauuggaaaccgcgauuuugucgaggguuugagcggcgcgacauggguggacguaguucuggagcacgggaguugugugaccacuauggcaaaagauaagcccacacuagacaucgaacuccugaaaaccgaggucacgaauccugccgugcuuagaaagcugugcauugaagcuaaaaucuccaacaccacaacugauucuagguguccaacccaaggagaggccacauugguggaagaacaggacagcaauuucgucugccggcgcacuuuuguugaucgaggcugggguaacggguguggacucuucggcaagggcucccuguuaaccugcgcaaaguuuaaaugcgugacaaagcuggaggggaaaauaguacaguacgaaaaucucaaguauucagugauugucaccgugcacacuggagaccagcaucaaguugguaacgagacgacagaacacggcaccaucgcuacuauuacaccccaggccccuacaagugagauccagcuuaccgacuacggggcgcugacuuuggauuguagcccaagaacaggacuagacuucaaugaaauggugcugcucacgaugaaagagaagucuuggcugguccauaaacagugguuucuugaucugccguugcccuggaccuccggcgccucaacuagccaagagacauggaacaggcaggaccuccuggugaccuucaagacagcacacgcuaagaaacaggaaguaguuguguuagguagucaagagggggccaugcacacugcucugaccggcgccacggaaauccagaccucuggaacaacuaccauuuuugcaggccaucuaaagugccggcucaaaauggauaagcugacacuuaaagggauguccuaugucauguguacuggcagcuucaaguuggagaaggaaguggccgagacccagcacgguacgguccuggugcagguuaaauacgagggcacagacgcuccuugcaagauaccauucucggcgcaagaugaaaaaggggugacccagaauggacgucucaucacugcaaaccccauuguaacagacaaggagaaaccugucaauaucgaaaccgagccacccuuuggcgagucuuauauagugguuggugccggggaaaaggcucugaaacuuuccugguucaaaaagggcucaaguauuggaaaaauguuugaggccacugcacgcggcgccagaaggauggcuauccugggggauaccgccugggacuucggaagcaucgguggcguguuuacauccgucgggaaguuggugcaucagguauucggagcagcguacggcgugcucuuuucugguguuagcuggacgaugaaaauugggaucggcauucuguuaaccuggcugggacuaaacucacggaguacuucccucagcaugacauguauagcugucggcauggugacccuguaccuuggggugaugguccaggccgauucuggaugcguuaucaauuggaagggccgagaauugaagugugguucagggauuuucgugacaaacgaggugcacacuuggaccgaacaauauaaauuucaggcagacaguccgaagcgccugagcgccgcuaucggaaaagccugggaggagggcguaugcgguaucagauccgcaacgaggcucgaaaacauuauguggaagcagauaucuaaugagcugaaccauaucuuacuggaaaaugacaugaaauucacagucgugguuggcgaugcuaacgggauucuugcccagggaaagaaaaugauccggccucaacccauggagcaccgcuacucguggaaaagcuggggcaaggcgaagauuaucggggccgacauacaaaauuccaccuuuaucauugauggaccagacacuccugaaugucccgaugaccagagagcuuggaacaucugggagguggaggauuauggcuucgguauuuuuaccacaaauaucugguugaagcucagggacucauacacucagaugugcgaucaccgucugaugagugcagccauaaaagacucuaaggcuguccaugccgauaugggguauuggauugaaagcgagaaaaacgaaaccuggaagcuagcacgggcguccuucaucgaggugaagacauguauuuggccaaaaucacacacgcuguggagcaauggaguucucgaaucugagaugaucauacccaagaucuacggcgguccuauuucccaacauaacuaucgaccaggcuacuucacccagacugccgggccguggcaccugggaaaacuugaguuggacuuugaacugugcgagggcacaaccgugguagucgaugaacacugcgggaauagaggacccaguuuaaggacuacaaccgugacgggcaagaucauucaugagugguguugccgcagcuguacucucccuccacugcgguucagaggugaggacgggugcugguacggaauggaaaucaggcccgugaaagagaaggaagagaaccuuguccgcucuaugguuuccgcuggcucaggugaaguggacaguuuuagccugggcauauuguguguaucgauuaugaucgaggaggugaugcgaucccgguggucucguaagaugcucaugaccgggacacuggucguguucuuucuacugaucaugggacagcucaccuggaaugaucugauuagacuuugcaucaugguuggcgccaacgcaagcgacaggauggggaugggaacuacauauuuggcucugauggccaccuucaaaaugcgcccuauguuugcagugggcuuacucuuccggagacugacaucaagggaaguccuucugcuaacuauuggucucagucugguggccuccguugaguugccaaauucucuggaagaguuaggggauggacucgcuaugggcauaaugaugcugaaacuucugaccgaauuucaaccccaccaguuguggacgacacuccugagccuaaccuucaucaaaacuacccugucccuugacuacgcguggcgaacaauggccauggugcucucaauugucagccuguuuccguugugucugaguacuaccucucagaagacgacaugguuaccuguacuccugggcuccuucgggugcaaaccacuuaccauguuucugaucacugagaacaagauuuggggacgcaagagcuggcccuugaacgaggguaucauggcaauaggcaucgugucgauucuccugucaucucuacugaaaaaugauguuccucuugcugggccccucaucgccggaggcaugcugauugccuguuaugugaucagugguuccagcgcugacuugucuuuagaaaaggcagccgaggucagcugggaagaggaagcggagcauuccgggacaucacacaacauacugguggagguacaggaugacggaaccaugaaaauuaaggaugaggaacgggacgauacucucacaauccugcuuaaagcuacccuguuggccgugaguggcgucuacccaaugagcaucccugcaacguucuucguuugguauuuuuggcaaaagaaaaagcagagaucuggcgugcuaugggacacucccuccccaccggaaguggagagggccguccuggaugacgggauuuaccguauacuccagcgcggacugcuuggucggucacaggugggcguugggguauuccaagacggaguguuucauaccauguggcacgucacaagaggcgcuguguuaauguaucaggguaagaggcuggagccuaguugggcaagcguuaaaaaggaucucaucuccuacgggggaggcuggcgauuccagggcucuuggaauaccggggaagaggugcaggucauugccguggaacccggcaagaacccaaagaauguacaaacaacucccgguaccuuuaaaacgccugagggcgaagucggggcgaucgcuuuggacuucaagccaggaacaucgggcagccccauugugaaccgggaggguaagaucguugggcuguacggaaauggcguggucacuaccucaggcacauauguguccgccauagcacaggccaaaaccagucaggaggggccucucccggaaaucgaggaagagguuuuuaagaaacgcaaccugacuauuauggaucuucacccaggaucugguaagaccagaagguaccugcccgcuaucgugcgggaagccauuaaacgaaaguugagaacacuaauccuggcaccuacgcgcgucguggcuagcgagauggccgaggcgcucaagggcaugccaauaagguaucaaacuaccgccguaaaauccgaacauacagggcgugagauuguggacuuaaugugccacgcaaccuucacuaugcggcugcuuucacccguuagagucccuaauuacaacaugaucaucauggaugaagcucauuuuacagacccggccucuauugcugcaaggggauauaucagcacccgcgugggcaugggugaggccgccgcuauauucaugacggcgacucccccagggaguguggaagcauuuccucaguccaaugccgucauucaggaugaggagcgagacauccccgaaagaagcuggaacucuggauacgauuggauuacagacuucccaggcaagaccguaugguucgugccuucaaucaaauccggcaaugauauagcuaacugucugcggaagaaugggaaaaggguuauucagcucagucgcaagaccuuugacacugaguaucaaaagacacguaacaacgacugggauuacguggucaccacagacaucagcgaaaugggagccaauuucagagcagaucgggugaucgaccccaggcgcugcuugaaaccaguuauucugaaggaugguccggagcgagugauccucgccggcccuaugcccgucacuguggcuucggcggcccagagacgggggaggauuggacgcaaccagaauaaagagggcgaccaguacguauauaugggucaaccacugaacaaugaugaagaccacgcacauuggacggaggcuaagaugcuucuagauaacauaaauacccccgaagggaucauuccugcccuguuugagccagaaagagagaaaucugcagccaucgacggcgaguacagguugcggggagaagcucguaagacauucguggaguuaaugcgccgaggcgaucugcccguuuggcucuccuauaaggucgccagcgaaggguuucaguacucagacagaagguggugcuucgauggagagcggaacaaucaggugcuggaagagaacauggacguggagaucuggacuaaagaaggugagcgcaagaaacuuagaccuagguggcuggacgcgcggaccuauagugauccgcucgcauugcgagaauuuaaggaguucgccgcuggcagacgcucugucuccggggaccugauucuagaaauaggaaaacugccacagcaccucacacuuagggcccaaaaugcucuggauaacuuaguuauguugcacaauagcgagcagggcgguaaggcauaccggcaugccauggaggaacugcccgacaccaucgagacucucaugcugcuugcucugauugccgugcucaccgggggaguaacguuguuuuuccugucaggaaaaggcuuagggaagacaaguaucggacuacugugugugauggcaagcuccgcgcuccuuuggauggccaacgucgaaccucacuggauugcugccucuaucauacuggaguuuuucuugauggugcugcucauccccgagccagaucgucagagaacuccucaggacaaucaacuggcauauguugugauuggucuucucuuuaugauccugaccgucgcugccaacgaaaugggcuugcuggagacaaccaagaaagauuuagggauuggacauguagcagccgaaaaccagcaccacgcuacuaugcuagacguggaucugaggcccgcgagcgccuggacacucuacgcaguugcuacgaccgugaucacuccaaugaugcgccauacaauagagaauaccaccgccaacauuucccuuacagccaucgcaaaucaggcugccauucugaugggcuuggacaaggguuggccuaucucaaaaauggauauaggggucccgcugcucgcgcugggcugcuacucucaagugaacccccuuacuuuaacggcugccguccugaugcucguggcacacuaugccaucauuggaccaggcuugcaggcuaaggcaacccgggaagcccagaaacgaacagcggcugggaucaugaagaauccuacuguugacggaauuguggccaucgaucuggaccccguaguguacgacgcaaaguucgagaaacagcuaggccaaauaaugcugcucauucuuuguaccagucagauccuguugaugagaacaaccugggcccugugcgagucgaucacucucgcuacggguccacugacaaccuuaugggaagggagcccuggaaaguucuggaacacuaccauugccgucuccauggcaaauaucuuuaggggcucuuaucuugcuggugccggccuggcguucucacucaugaaaagccuagggggaggccgccgggggacaggagcccagggcgagacucugggugaaaaguggaaaagacaguugaaccaacuguccaagagugaguuuaauaccuacaagcguucugggauaauggaaguugauaggagcgaggcaaaagagggacucaagcggggcgaaacaacgaaacaugcugugucacgcgguaccgccaaacuucgaugguucgucgagagaaaccuggugaaacccgaaggcaagguaauugacuugggguguggaaggggcgggugguccuauuacugcgcaggacugaagaaagugacugagguuaagggcuauacaaaaggugggccgggacacgaggaaccaaucccuauggcuaccuacggcuggaaucucgugaaguuauacaguggcaaagaugucuuuuucacucccccagagaagugugacacacugcuuugcgauauuggggaaagcucucccaacccuaccaucgaggaaggacggacgcugcgcgugcuaaaaauggucgagccguggcucagagguaaucaguuuuguauaaagauccugaaccccuauaugccauccgugguugagaccuuggaacagaugcagaggaagcauggcgggaugcugguacgaaauccucucucacggaacagcacacacgagauguacugggugucgugcggaacuggcaauauugucucugccgugaacaugaccagucguaugcuucugaacagauucacaaugacucaccgcaaacccaccuaugaaagggacguugauuuaggugccgggacacggcauguggcggucgagccugaaguggcuaaucuggacaucauuggacaaagaaucgagaacauuaagaaugagcacaaauccaccuggcauuacgaugaagacaacccauauaagacuugggcauaccacggcagcuaugagguaaaacccucaggcuccgccucuagcauggugaaugggguuguccgcuugcucacgaagccuugggaugugaucccaauggugacacagauagcuaugaccgacacuacccccuuuggacagcaaagggucuucaaggaaaaaguugacacacgaacgccgcgggccaagagagguaccgcacagauuauggaggugacugccaaauggcuguggggcuuucuaaguaggaacaagaaaccucgcaucuguacacgugaagaguucacccggaagguaagauccaaugcugcgaucggggccguguuugucgaugagaaccaguggaauagcgcaaaggaagcuguggaggacgaaagguucugggaucuuguucaccgcgagcgagaacugcauaaacagggaaagugcgccacuugcguguacaacaugaugggcaaacgggagaagaaacucggugaguucgggaaggcaaagggaucuagagccauuugguacauguggcugggcgcuagguuuuuggaguucgaggcccugggcuuuaugaaugaagaccacugguucucacgcgagaacaguuuuuccggggucgagggagaaggucuccauaaacuuggcuauauacugagagauaucagcaagauuccagggggaaauauguacgcggacgauacagcaggcugggacacccggaucacagaggaugacuuacaaaacgaagccaaaauuacugauaucauggagcccgaacacgcucuguuggccaccucuauauucaagcucacguaucagaauaaagugguaaggguucagcguccugcaaagaacgguaccgugauggacgucaucucgcgacgcgaucagagagggucaggacaagugggcacauacggccugaacacuuuuaccaauauggaggugcagcuaauucggcagauggagagcgaagggaucuuccuuccauccgagcuggaaacacccaaccucgcugagaggguccugaauugguuggaaaaacauggaacugagcgcuuaaagagaauggccauuaguggugacgacuguguugugaagccgguagaugaccgguuugcuaccgcccugaucgcacucaacgauaugggcaaagugaggaaggacauaccucagugggagcccucuaaaggguggaaugauuggcaacaggucccauucugcagccaccacuuucaucagcuuauuaugaaggacggacgagaaaucgugguuccuugucguaaccaggaugagcuggugggcagagcgcgcgucucccaaggugccggguggucacuacgggaaacggcuugccugggaaaaaguuaugcccagauguggcagcucauguacuuccacaggagagacuugcgccuggcagcuaaugccaucuguucugcagugcccguagauuggguuccaacaagccggaccacuugguccauucaugcccaccaccaauggaugacaaccgaggacaugcuuucaguguggaacagggucuggauagaagagaaucccuggauggaggauaagacucaugugagcucuugggaagagguuccuuaucugggcaagcgagaagaccaguggugcggcucccucaucggguuaaccgcgagagcuacaugggccacgaacauucagguggcaaucaaucagguccggaggcugauuggaaacgagaauuacuuggacuacaugaccaguaugaaacgcuuuaagaacgagagcgauccagaaggugcccugugguga

SEQ ID NO: 13476 - RNA, 9879 nt, Artificial Sequence
  derived and/or modified CDS sequence (opt3) from DENV-1__FJ205874__SS-prME
agcgugaccaugcugcucaugcuucugcccacagucuuggccuuccacuuaacuacgagaggcggggagccucauaugaucguuggaaagcaggaaagggguaaaucccugcuauuuaagaccucugcuggcgugaacaugugcacacucauugcaauggaccugggggagcuuugugaagauacuaugaccuacaaaugcccacggauaacagaggccgaaccggacgauguagacuguuggugcaaugcgaccgauacuugggugacauauggaaccuguucacaaacgggcgagcaccgccgagacaagcguagugucgcucuggccccccauguggguuuggggcucgagacuagaaccgaaacauggaugagcuccgagggagcauggaaacagauccagaagguugaaacuugggcccugaggcacccuggcuucaccgugauugcuuuuuuccuggcacaugccaucggcacaucuauuacccagaaggggaucauauuuauccucuuaaugcuggucacgccaucgauggcuaugcggugcgugggaauugguaaccgcgauuucguagagggccuuucaggggccacuuggguugacguggucuuggagcacggaagcugugugacaaccauggcgaaaaauaagcccacucuggauaucgaacuacucaaaacagaggugaccaacccugcaguccugagaaagcuuugcauugaagccaaaaucaguaauacgaccacagacuccagguguccaacucaaggcgaggcuacccugguugaagagcaggaugccaacuuugugugccggcgcacauucguagaccgagguugggggaauggauguggcuuguuuggcaaggggucucuccugacuugcgcaaaguucaaaugcgugaccaaguuagagggaaaaauaguccaguacgaaaaccugaaguauagcgugauuguuacagugcacaccggugaucagcaucaagucggcaaugagacuacggaacacgggacaaucgcuaccauuacuccccaggccccuaccuccgagauccagcucacagacuacggagcgcuuacccuggacuguucaccaagaacuggcuuggauuuuaacgaaauggugcuacugacaaugaaagagaagaguuggcucguacauaaacagugguuccuggaccuuccgcugcccuggacgagcggugccucuaccucccaagagacuuggaauaggcaggauuugcucguuacauuuaagaccgcacacgcuaagaaacaggaaguggucgugcuggggucacaagagggcgccaugcacacagcuuuaacuggagccaccgaaauccagacgagcggcaccacaacuauuuucgcagggcaucugaagugccggcuaaaaauggacaagcucacccugaaaggaaugaguuaugucauguguacagguucuuucaagcuugagaaggaaguggccgagacucagcacggcaccguuuuggugcagguaaaauacgaggggacggaugcuccuugcaagauaccacuguccacacaagacgaaaaaggagucacccagaacggccgucucaucacugcgaaucccauugugacagauaaggagaaaccuguuaacaucgaaaccgagccacccuuuggugagagcuauauaauugugggggcaggcgaaaaggcccugaagcuuucgugguucaaaaagggaucuuccaucggcaaaauguuugaggcuacugcccgcggggcaagaaggauggccauccugggagacaccgcuugggauuucgguucaauuggcggggucuuuacaagugugggaaaguugguacaucagguguucggcacggccuacgguguucucuuuagcggggucuccuggaccaugaaaaucggcauuggaauacuguuaacuuggcugggccuaaauucucggagcgcaucacucaguaugacauguaucgcgguggggauggugacccuguaccuuggagucaugguucaggcugacuccggcugcgugauuaacuggaagggucgagaauugaagugugggagcggaaucuucgugacaaacgagguacacacuuggaccgaacaauauaaauuucaggccgauucuccgaagcgccugucagcagccaucggcaaagcuugggaggagggugucugcggcgugagaagugccacgaggcucgaaaauauuauguggaagcagauaagcaacgagcugaaucauaucuuacuggaaaacgacaugaaauucacaguuguggucggggacgcaaauggaauucuugcucagggcaagaaaaugauccggccucaacccauggagcacaaguacuccuggaagucuugggggaaagccaagauuaucggagcggauauacagaacaccacuuuuaucauugacggcccagauaccccugaaugucccgacgaucagcgcgccuggaauaucugggagguggaggacuaugguuucgggauuuuuacaacuaacaucugguugaaacucagagauucguacacccagaugugcgaccacaggcugaugagcgcugcaauaaaggauuccaaagccguucaugcugacaugggauauuggauugaaucagagaagaaugaaacauggcgucuagcccgggcaaguuucaucgaggugaagacguguauuuggccaaaaucucacacccuguggagcaacggcguacucgaauccgagaugaucauacccaagaucuacgguggcccuauuucacaacauaauuaucgaccaggguacuucacucagacagcgggaccguggcaccugggcaaacuugaguuggauuuugaccugugcgaagggaccacugucgugguggaugagcacugcggaaacagaggccccagcuuaaggacaaccacggucacugguaagaucauucaugaaugguguugccgcucuuguacccucccuccacugcgguucagaggggaggacggaugcugguacggcauggagaucaggcccguuaaagaaaaggaggaaaaucuugugcgcuccaugguaagugccgguagcggcgagguggacucuuuuucccuggggauauugugucucucaauuaugaucgaagaggucaugcgaagucgguggagccguaagaugcugaugacaggaacccuagcuguguuccugcuccugaucaugggccagcuuacuuggaacgauuugauuagacugugcaucaugguuggggccaaugcaucggacaggaugggaaugggcacaaccuauuuagcucucauggccacauuuaaaaugcgcccuauguucgcagugggucugcuuuuucggagacugacuuccagggagguccuacuccugaccauuggguugucucugguggccagcguugaauuaccaaacucacucgaggaacugggagauggccuugcuaugggcauaaugaugcugaaguugcucacggaguuccaaccccaccagcuguggacaacccuacugagucuuacuuuuaucaaaaccacacucucccuggacuacgcguggaagacuauggccaugguguugucuauugucagccuguucccguuaugucucuccaccacgucacagaaaacaaccuggcugccuguacuucuggggagcuuuggaugcaagccauugacuauguuccucaucacagaaaacaagauuuggggucgaaaaaguuggccccugaaugagggcaucauggcaauagggaucgugucuauucuacuguccagccuucucaagaacgauguuccucuggcuggacccuugaucgccggcgguauguuaauugccuguuaugugaucucggggucaucugcugaccugagucucgagaaagcagccgaagucuccugggaggaagaggcggaacauagcggaaccucucacaauauacugguggagguacaggaugacggcacuaugaagauuaaagaugaggaacgcgacgauacacuuaccauccuguugaaggcuacgcuacuggccgugagcggcgucuacccaauguccaucccugcaacucucuuuguuugguauuucuggcaaaaaaagaagcagcggucaggggugcugugggacacccccaguccaccggagguggaaagagccguccuugaugacggaauuuacaggauauuacagcguggucugcucggccgcagccagguggggguuggaguauuccaagacggcguguuucauacaauguggcacgucacccggggugcuguguugauguaucaggggaaaagacuggagccuucuugggcauccguuaagaaagaucucaucucauacggaggcggcuggagguuccaggggaguuggaacacaggagaggaagugcaggucauugccguggagcccgguaagaauccaaaaaacguacaaacuacccccggcacguuuaagacaccugaaggggaggucggagcgguggcucuggacuucaagccaggcacuagcgguucccccaucguuaaucgagaagggaaaauugugggacuuuacggcaacggcgucgugaccacaucugggaccuauguuucggccaucgcacaggccaaggcuagccaggagggaccucugccggagauagaagaugagguguuuaaaaagcggaauuugacuaucauggaccuacacccagguucaggcaaaacccgcagauaccugcccgccauugucagggaagcaaucaagcggaagcuccgaacauuaauucuggcuccuacgagagugguagccuccgagauggcggaagcccuuaaagggaugccaauccgcuaucaaacuaccgcagugaagagugagcauacaggaagggagauaguugaucugaugugccacgcuaccuucacuaugcgucucuugucucccguccgggugccuaacuacaauaugauuaucauggacgaagcccauuuuacagauccggcuagcaucgcagccagaggcuauauuuccaccaggguggguaugggggaggccgcugcgaucuucaugacggcaacucccccaggaucagucgaagccuuuccucagucuaacgcuguaauacaggacgaggaacgcgauauucccgagcgaagcuggaguuccggcuacgacuggaucacagauuucccaggcaaaaccgugugguuuguuccuagcauuaagucugggaaugacaucgccaacugucugagaaaaaauggaaagcgggugauacagcucucaaggaagaccuucgacacugaguaucaaaaaacaaagaacaacgauugggacuacgucgugaccacagauauuuccgaaaugggugcaaauuuccgcgccgaccguguuaucgaucccagacggugccugaaaccagugauccuuaaggacggcccggagagggucauucuagcugggccuaugcccgugacuguagcgagugccgcacagcgccgaggaagaaucggccggaaccagaauaaagaaggugaucaguacguguauauggggcaaccacugaacaaugacgaggaucacgcucauuggacggaggccaagauguuguuagacaacauuaauacccccgaaggcauaaucccugcacuguuugagccagaaagggagaagagcgccgcuauugauggagaauaccgccucagaggcgaggccaggaaaacauucguugagcugaugaagcggggggaccuucccgucuggcugucguauaaaguggcgucugaaggauuucaguacuccgaucgucgcuggugcuucgacggugagcgaaacaaucaggugcucgaagagaacauggacgucgaaaucuggacuaaggagggcgagagaaaaaaguugaggccucgguggcuggaugcacgcaccuauagcgacccgcuagcccugagagaauuuaaagaguucgcugccgggaggcggucaguuaguggagaucucauccuugaaauuggcaagcugccacagcacuuaacauugcgagcucaaaaugcacuggacaaccucgugaugcugcacaauucugagcagggugggaaggccuacagacaugcuauggaagagcuucccgauaccauagagacucugaugcucuuggcccugaucgcaguauuaacgggcggagugaugcuauuuuuccuguccggcaaagggcucggaaagaccagcauuggucuucugugugucauggcgucaagugccuugcuguggauggcuagcguggaaccucacuggaucgccgcauccauuauccucgaguuuuuccugaugguucuucucauacccgaaccagaccgccagaggacaccucaggauaaccaacuggcuuauguggucaucggcuugcuguuuaugauuuuaacuguagccgcaaaugagauggggcuacuggagaccacaaaaaaggaccucggaaucggccauguggccgcugaaaaccaccaccauguuaccaugcuugauguggaccugcggcccgcgucugccuggacuuuguacgcagucgcuacaacggugauuaccccaaugaugcgucacacuaucgagaacacaaccgccaauauaagccugaccgccauugcaaaccaggcugccauccucaugggucuggauaaaggguggccuauuuccaagauggacaucggcgucccgcuuuuagcgcugggaugcuacucacaggugaauccccucacauugacugcugccguucugaugcuaguggcacauuaugccauaaucggcccagggcugcaagcuaaggcaacgagagaagcccagaaaaggaccgcggcuggaauuaugaagaacccuacaguagauggcaucguggccauugaccucgaccccgucguuuacgaugcaaaauucgagaagcagcuuggucagaucaugcuguugauacuguguacuucucaaauucuccugaugcgcaccacaugggccuuaugcgaaaguaucacccuugcuacugggccacugacgacacucugggagggaucgccuggcaaauuuuggaauaccacuaucgccgugagcauggcaaacauuuuccgggguuccuaucuagcuggcgccgggcuggcguucucuuugaugaagucacugggaggcgggcgaagaggaaccggcgcccagggugagacacucggggaaaaguggaaaaggcagcuuaaucagcugagcaaguccgaguuuaacacuuacaaacgcaguggaaucauggaagucgaccggucugaggcaaaggaaggcuugaaaagaggugagaccacaaagcacgcugugagccguggcacggccaagcugaggugguucguagagcggaaucucgugaaacccgaagggaagguuauagauuuaggauguggccgcgggggauggucauauuacugcgcaggccugaaaaaggugaccgaggucaaagguuauacuaaggggggaccgggccaugaagagccaauuccuauggcuacauacggcuggaaccuugugaaacugcacuccgggaaggacgucuuuuucacccccccagaaaagugugauacucuacucugcgacaucggagagaguagccccaauccuacaauugaggaaggucgaacccugagaguguugaaaaugguugagccguggcugaggggcaaccaauuuuguaucaagauacucaaucccuacaugccaucuguaguggaaacgcuugagcagaugcagcggcgccacgggggaaugcuggucagaaacccuuuauccaggaauucaacccaugagauguauugggugagcugcggcacagguaacaucguuucggccgugaauaugacuucucgaaugcuguugaaccgguucaccauggcccaccguaaacccacauacgaaagagaugucgaccucggggcgggaacucgccauguggcuguagagccugaaguggcaaaccugggcauuaucggccagaggauugagaauaucaagaacgaacacaaaaguaccuggcacuaugaugaggacaauccauacaagacaugggccuaucauggguccuacgagguuaagcccagcggaucagcuuccucuauggucaacgguguggugcggcuacuuaccaaaccuugggaugucauuccaaugguuacucaaaucgccaugacggacacaacccccuuuggccagcagagaguguucaaggaaaaaguagacacucgcaccccgagggcaaagcgagggacagcccaaauaauggaggugacggcuaaauggcugugggauuuucucagccggaauaagaagccuagaauuuguaccagggaagaguucauccgcaaaguccguaguaacgcggccaucggagcaguguuuguugacgaaaaucaguggaacuccgcuaaggaggccguggaggaugaacgguucugggaccugguccacagagagagggaauugcauaaacagggcaagugcgcaacuugcguguauaauaugauggguaaacgcgagaagaagcugggggaauuuggaaaagccaagggcagccgagcuauuugguacauguggcucggcgcccgguuccuugaguucgaggcgcugggguuuaugaacgaagaucacugguucucuagagagaauucauuaaguggaguagaaggugagggccugcauaaauugggguacauacucagggacaucuccaagauuccaggaggcaacauguaugcagaugacacagccgguugggauacccgcaucacugaggacgaucugcagaaugaagcuaaaauuacagacaucauggagcccgaacacgcccuacuugcaaccagcauauuuaagcugacauaccaaaacaaaguugugagaguccagcggccugcuaagaaugggacugugauggaugugaucucuaggcgugaccagcgaggaucgggccaggucggcaccuaugggcucaacacguucaccaacauggagguucaacugauucgccagauggaaucagagggaaucuuuuugccaagcgaguuagaaacaacuaaucuggccgagagagugcucgacuggcuugaaaagcacgguguagagcggcugaaaaggauggcuauuuccggcgaugacuguguggucaagcccaucgaugaccgcuucgccaccgcacuaauagcgcugaacgauauggggaaagugagaaaggacauuccgcagugggaaccuaguaaaggauggaaugauuggcagcaaguucccuuuugcucucaucacuuccaucagcucaucaugaaggacggccgggagaucguggucccauguaggaaccaggaugaguuggugggucgagcccguguaagccagggggcuggauggucccugagagaaacagccugccuuggcaagucauacgcacaaauguggcagcugauguauuuucaccgccgggaccucagguuagcugccaaugcaauuuguagugccguuccuguggauuggguccccacuucuagaaccacguggagcauacacgcgcaucaccaguggaugacaaccgaggacaugcuguccguguggaaccgcguuuggaucgaagagaauccauggauggaagacaaaacucaugugucaagcugggaggagguccccuacuugggcaagcgggaagaucaauggugcgggucucugauuggacucacagcuagggccaccugggcaacuaacauccagguggccauuaaucagguacgaagacuuaucgguaacgagaauuaucuggacuacaugaccuccaugaaacgguucaagaacgaaagugauccugagggcgcucuaugguga

SEQ ID NO: 13477 - RNA, 9879 nt, Artificial Sequence
  derived and/or modified CDS sequence (opt3) from DENV-1__FJ205875__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguauuaacaugugcacacucauagccauggaccugggcgagcuuugugaagauacuaugaccuacaaaugcccacggaucacagaggcggaaccggacgauguugacuguuggugcaaugcuaccgauacuugggugacauaugggaccuguagucaaacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugaucgcacuguuucucgcccaugcuauuggcacaucgaucacccagaagggcauaaucuucauuuuacugaugcuuguuacgccaucaauggccaugcggugcguggggaucggaaaccgcgauuuugucgaggguuugagcggcgcgacuuggguggacguaguucuggagcacgggaguugugugacaaccauggcaaaagauaagcccacucuagacauugaacuccugaaaacagaggucaccaauccugccauccuuagaaagcugugcauagaagcuaaaauuuccaacacgaccacagauucuagguguccaacucaaggagaggccaccuugguggaagagcaggacgcaaauuucgugugccggcgcacauuugucgaucgaggcugggguaacggguguggacucuucggcaagggcagccuguuaacuugcgcuaaguuuaaaugcguuaccaagcuggaggggaaaaucgugcaguacgaaaaucucaaguauuccguaauugugacaguccacaccggagaccagcaucaaguggguaacgagacuacggaacacggcacaaucgccaccaucacuccccaggcgccuaccucagagauucagcuuacagacuacggggcccugaccuuggauuguaguccaagaacuggacuagacuucaaugaaaugguucugcucacaaugaaagagaagagcuggcuggugcauaaacagugguuucuugaucugccguugcccuggacgucuggcgcauccaccucacaagagacuuggaacaggcaggaccuccuggucacauucaagaccgcucacgccaagaaacaggaagugguaguuuuagguagccaagagggggcuaugcacacagcccugacuggcgcaaccgaaauacagacgaguggaaccacaacuaucuuugccggccaucuaaagugccggcucaaaauggauaagcugacccuuaaagggaugucuuaugugauguguacaggauccuucaaguuggagaaggaagucgcugagacucagcacgguaccgugcugguccaggugaaauacgagggcacggacgcgccuugcaagauuccauucagcacacaagaugaaaaagggguuacccagaauggacgucucaucacugcaaaccccauagugacagacaaggagaaaccuguaaauauugaaaccgagccacccuuuggcgagucguauaucgucgugggugccggggaaaaggcucugaagcuuucuugguucaaaaagggcuccucaaucggaaaaauguuugaggccacugcacgcggcgccagaaggauggcuauucugggggauaccgccugggacuucggaaguaucgguggcguuuuuacaagcguggggaaguugguccaucagguguucggaacggcauacggcguacucuuuuccggugugucuuggaccaugaaaauugggauaggcauccuguuaacuuggcugggacuaaacagccggucaacaagucucuccaugaccuguauugcgguuggcauggucacacuguaccuuggggugauggugcaggcugauagcggaugcgucaucaauuggaagggccgagaauugaagugugguucugggaucuucguuacuaacgaggugcacaccuggacggaacaauauaaauuucaggccgacucaccgaagcgccugagugcagccauuggaaaagcuugggaggagggcgugugcgguauaagaagcgccacaaggcucgaaaacaucauguggaagcagauuuccaaugagcugaaccauaucuuacuggaaaaugacaugaaauucaccguagucgugggcgaugcaaacgggauucuugcucagggaaagaaaaugauccggccucaacccauggagcacaaguacucuuggaagucguggggcaaagccaagauaaucggggcggacauucagaauacuaccuuuaucauugauggaccagacacaccugaaugucccgaugaccagcgcgccuggaacaucugggagguugaggauuauggcuucgguauauuuacuaccaauauuugguugaaacucagagacagcuacacacagaugugcgaucacaggcugauguccgcugcaaucaaggacucaaaagccgugcaugcugauaugggguauuggauugaaagugagaagaacgaaacguggaagcuagcccgugcaucuuucaucgaggucaaaaccuguauauggccaaagagccacacucugugguccaauggagugcucgaaucagagaugaucauucccaaaaucuacggcgguccuauuagccaacauaacuaucggccaggcuacuucacacagaccgcggggccguggcaccugggaaagcuugaguuggacuuugaucugugcgaaggcacuacaguugugguagacgagcacugcgggaaucgaggacccucuuuaagaaccacgacugucaccggcaaaaucauacaugaaugguguugcagguccuguacacucccuccacugcgcuuccggggugaggacgggugcugguacggaauggagauuagacccgugaaggaaaaggaggaaaaccuugugaggaguauggucagcgccggcucuggugagguugauuccuuuucacugggcaucuugugugugaguaucaugauugaagagguaaugcgcagccgauggucgaaaaagaugcucaugaccgggacucuggcuguguuccuacugcucaucaugggacagcugacauggaaugaccuuauucgguugugcauaauggucggcgccaacgcauccgaucguauggggaugggaaccacauaucuggcuuuaauggccacuuuuaaaaugagaccuauguucgcagugggccuccuguuuaggcgccuuaccucucgggagguucugcuacucacgaucggucugagcuugguggccucagucgaacugccaaauaguuuagaggaacucggggacggacuggcuaugggcauuaugaugcuuaagcuguugacagaguuccaaccccaccagcucuggaccacucugcuaucccugaccuuuaucaaaacaacucuuucucucgauuacgcguggagaaccauggccauggugcugagcauuguuuccuuguucccgcuguguuuaucaacgacaagccagaagaccacuuggcucccugugcugcuuggcaguuuugggugcaagccacugacaauguucuugaucaccgaaaacaaaauauggggaaggaagucuuggccccucaacgaggguaucauggcaauuggcaucgucuccauucugcuaagcucgcugcuuaaaaaugacguaccucucgcugggccccugaucgccggaggcauguugauagccuguuaugugauuucagguucuagugcugauuuaucccuggagaaggcagccgaaguuagcugggaggaagaggcggaacauucugggacuagccacaacauccucguggagguccaggacgauggaacaaugaaaaucaaggacgaggaacgagaugacacccugacgauucuucugaaagcuacuuugcuagccguguccggcguauacccaaugucaauaccugcaacccuguuugugugguauuucuggcaaaagaagaaacagcgcaguggcguccucugggauacacccagcccaccggagguugaacgggccgugcuggacgacgggaucuacagaauucuucagaggggauuacugggucguucucaggugggcgucgggguguuccaagauggaguuuuucauaccauguggcacguaacacgcggcgcugugcucauguaucaggguaagcgguuggagccuuccugggcaucagucaaaaaggaccugaucaguuacgggggaggcuggagauuccagggcagcugguccacuggggaggaagugcagguuauugccguggagcccggaaaaaauccaaagaacguccaaaccacgcccgguacauuuaagacuccugaaggcgaggugggggcgaucgcucucgauuucaaaccaggaaccucuggcucgcccauaguaaauagggaagguaagaucgucgggcuguacggaaacggcgugguuacaaccagcggcacuuaugugucagccauugcacaggccaaaaccucccaggaggggccucuuccggagaucgaagacgaggucuuuaagaaacgaaaucugacaauuauggauuugcacccaggaagugguaagacgcggcgcuaccuacccgcuaucgugagagaagccauaaagaggaaacugcggacucucauuuuagcaccuacccgaguuguggcuucugagauggccgaagcgcugaagggcaugccaaucagauaucaaacaaccgccgucaaaagcgagcauacugggcgcgagaucguggaccuuaugugccacgcaacauucaccaugaggcugcucucccccguacgugugccuaacuacaauaugauuaucauggaugaagcucauuuuacggacccggccucaauagcugcacggggauauauuucuacuagaguuggcaugggugaggccgccgcuaucuucaugacagcgacccccccagggagcgucgaagcauuuccucagaguaacgccgugauucaggaugaggaaagggacauccccgagcgcuccuggaauagcggauacgauuggauaaccgacuucccaggcaagacugugugguuugucccuucuauuaaaucaggcaacgacaucgcuaauuguuugcgaaagaacgggaagagaguaauccagcugucccggaaaacauucgauaccgaguaucaaaagacaaaaaauaacgacugggauuacgugguuacuacggacauuagugaaaugggagccaacuucagggcagaucgcgugaucgacccccguagaugccucaagccagucauucugaaagaugguccggagcgggugauacuugccggcccuaugcccguuaccguggcuagcgcggcccagaggcgcgggcgaaucggaagaaaucagaacaaggaaggcgaccaguacgucuauaugggucaaccacuaaauaacgaugaggaccacgcacauuggacagaggcuaagaugcuguuggauaauauuaacacucccgaagggaucaucccugccuuauuugagccagaacgggagaaaucggcagccauugacggcgaauacaggcugcgcggagaggcuagaaagaccuucguggagcucaugaggcggggcgaucugcccguauggcuuucuuauaaaguggccuccgaaggguuucaguacagcgaccgucgcuggugcuucgacggagagcgaaauaaccagguucuggaagagaauauggaugucgaaauauggacaaaggagggugagagaaaaaagcucaggccucggugguuggacgcgcgcaccuauucagauccgcuggcacuaagagaauuuaaagaguucgccgcuggcaggcggagugugucuggggaccugauccucgaaauuggaaagcuuccacagcaccugacuuuacgagcccaaaacgcuuuggauaaucuggugaugcuccacaacuccgagcagggcgguaaggcauacagacaugccauggaagagcugcccgacacgaucgagacccuuaugcugcucgcuuugauugccguccugacagggggcguuacuuuauuuuuccuaagcggaaaaggccuggggaagaccucaaucggacuccuuugugugauggcaaguagcgcgcuguuguggauggccaauguagaaccucacuggauagcugccuccaucauucuggaguuuuuccucauggugcugcuuauccccgaaccagaucgccagaggacaccucaggacaaccaacucgcauaugucgugauuggucuguuguuuaugauccugaccguugcugccaaugagaugggcuuacuagagacuacaaaaaaggaucuggggauaggacauguggcagccgaaaaccaccaccaugcuacgaugcucgacgucgaucuucggcccgcgucugccuggacccuguacgcaguagcuacuacagugauuaccccaaugaugcgucacaccaucgagaacacaacugccaauauuagcuugacggccaucgcaaaccaggcugccauacugaugggccucgacaaagguuggccuaucuccaagauggauauugggguuccgcugcuugcguuaggcugcuacucacaggugaauccccugacccucacagcugccgucuugaugcugguggcacauuaugccaucauuggaccaggccuacaagcuaaggcaacuagagaagcccagaaaaggaccgcggcugggaucaugaagaacccuacagucgacggaauaguggccauugaccuggaucccguuguguacgacgcaaaauucgagaagcagcucggccagaucaugcuucugaucuuguguaccucucaaauucugcucaugcgcacuacgugggcccugugcgaaaguaucacauuagcuaccgguccacuuacuacccugugggaggggucgccuggaaaauuuuggaauacaacuauagccguaagcauggcaaacauuuuccggggcuccuaucucgcuggugccggccuagcguucucucugaugaagucauuggggggaggccgaagagggaccggagcccagggcgagacacugggugaaaaguggaaaaggcagcucaaucagcuuagcaaguccgaguuuaacacguacaaacgcagugggaucauggaaguggaucggucugaggcaaaggaaggacugaaaagaggcgagaccacuaagcacgcugucagccgugguacagccaaguugagguggcugguugagcggaaucucgugaaacccgaaggcaaggucauugacuuaggguguggacgcggcggguggucauauuacugcgcaggacugaaaaaggugaccgagguaaaaggcuauacuaagggugggccgggacaugaagagccaaucccuauggcuacauacggcuggaaccuugugaaacuguacuccggcaaggauguuuucuuuacccccccagaaaagugugacacgcuacucugcgauauaggggagaguagccccaauccuaccaucgaggaaggacgaacacugagaguguugaaaauggucgagccguggcugagggguaaccaauucuguauuaagauccucaaucccuauaugccaucuguggucgaaacucuugagcagaugcagcggaaacacggcgggaugcuggugcgcaacccuuuauccagaaauucaacccacgagauguacuggguuagcugcggaacaggcaacauuguaucggccgugaauaugacuucuaggaugcuguugaaccgauuuaccaugguccaucggaagcccacauaugaacgugacguggaucucggugccgggaccagacacguugcgguggagccugaagucgcuaaccuggacaucauuggacagcgcaucgagaauauaaaaaacgaacauaagaguacuuggcacuacgaugaggacaauccauauaagacgugggcauaccacggcuccuaugaggugaaacccagcggcucagccuccucuaugguaaacggggugguuaggcuacuuacaaagccuugggacgucauuccaauggugacccaaaucgcuaugacugauaccacacccuucggacagcagcggguguuuaaagaaaaggucgacacgagaaccccgcgcgccaaaagggguacugcacaaaucauggagguuacagccaaguggcuguggggcuuccucagccgaaauaagaaaccucggauuuguaccagagaagaguuuacuaggaaggugcgcaguaacgcugcgauaggggccguauucguggaugaaaaucaguggaacuccgcaaaagaggcugucgaggacgaacguuuuugggaucuggugcaucgggagagagaauugcacaagcagggaaaaugcgccacaugcguuuacaauaugaugggcaagagggagaagaaacugggugaauucgggaaggcaaaaggaagccgcgccaucugguacauguggcucggcgcucgauuucuugaguucgaggcccugggcuucaugaacgaagaccauugguuuucucgggagaauucauucagugggguggaaggagaugguuuacacaagcugggcuauauuuugagagacaucuccaaaauuccagggggaaacauguacgcggaugacaccgcaggcugggauacaaggaucacugaggacgaucuccagaaugaggccaagauaaccgacaucauggaacccgagcaugcucugcuagccacgagcauuuuuaaacuuaccuaucaaaacaaggucgugcgcguacagagaccugcaaagaaugguacaguuauggacgugaucucucggagggaucagcgugggucgggacaggucggcacuuacggccugaacaccuucacaaacauggaagcucaacucauucgacagauggagucagaagggaucuuucugccaagcgaguuggagacucccaauuuagccgaacgcgugcuggacuggcucgagaaacacggaaccgaaagacuuaagcggauggcuauauccggugaugacuguguggucaaaccgguugaugacagguucgccacggcacugacagcgcuaaacgauaugggcaaggugcgcaaagacauuccucagugggagcccaguaagggguggaaugauuggcagcaaguaccauuuugcucucaccauuuccaccagcugaucaugaaggacggaagagaaaucguggucccuugucggaaccaggaugagcucgugggcagggcccgaguuagccagggugcugggugguccuugcgugagaccgccugccugggaaaaucauaugcacaaauguggcagcuuauguacuuucauagacgcgaccugcggcucgcugccaaugcaauuuguagugccgugcccgucgacugggugccaacuucuaggacaaccuggagcauacacgcgcaccaucaguggaugacuaccgaagauauguuauccguauggaacagaguuuggaucgaggaaaaucccuggauggaggacaagacacacgugucaagcugggaagaggucccuuaucugggcaaacgcgaggaucaauggugcggcucuuugauugggcugacggcucgggccaccugggcaacuaacauccagguggccauuaaucagguuaggcgacucaucggaaacgaaaauuaccuugacuacaugacauccaugaagagauucaaaaacgagagugauccagaaggugcucugugguga

SEQ ID NO: 13478 - RNA, 9879 nt, Artificial Sequence
  derived and/or modified CDS sequence (opt3) from DENV-1__FJ410173__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguauuaacaugugcacacucauagccauggaccugggcgagcuuugugaagauacuaugaccuacaaaugcccacggaucacagaggcggaaccggacgauguugacuguuggugcaaugcuaccgauacuugggugacauaugggaccuguagucaaacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcacuguuucucgcccaugcuaucggcaccucgauuacgcagaagggcaucauauucaucuuacugaugcuuguuacuccaucaauggccaugcggugcguggggauuggaaaccgcgauuuugucgaggguuugagcggcgcgacauggguggacguaguucuggagcacgggaguugugugaccacuauggcaaaagauaagcccacacuagacaucgaacuccugaaaaccgaggucacgaauccugccgugcuuagaaagcugugcauugaagcuaaaaucuccaacaccacaacugauucuagguguccaacccaaggagaggccacauugguggaagagcaggacagcaauuucgucugccggcgcacuuuuguugaucgaggcugggguaacggguguggacucuucggcaagggcucccuguuaaccugcgcaaaguuuaaaugcgugacaaagcuggaggggaaaauaguacaguacgaaaaucucaaguauucagugauugucaccgugcacacuggagaccagcaucaaguugguaacgagacgacagaacacggcaccaucgcuacuauuaccccccaggccccuacaaccgagauccagcuuacugacuacggggcgcugacauuggauuguaguccaagaacgggacuagacuucaaugaaauggugcugcucaccaugaaagagaagagcuggcugguccauaaacagugguuucuugaucugccguugcccuggacuucuggcgccuccacaucacaagagaccuggaacaggcaggaccuccuggugacauucaagacugcacacgcuaagaaacaggaaguaguuguguuagguagccaagagggggccaugcacaccgcucugacgggcgccaccgaaauccagacaaguggaacuaccacaauuuuugcaggccaucuaaagugccggcucaaaauggauaagcugacucuuaaagggaugucuuaugucauguguaccggauccuucaaguuggagaaggaaguggccgagacgcagcacgguacaguccuggugcagguuaaauacgagggcaccgacgcuccuugcaagauaccauucagcgcgcaagaugaaaaaggggugacucagaauggacgucucaucacagcaaaccccauuguaaccgacaaggagaaaccugucaauaucgaaacugagccacccuuuggcgagucguauauagugguuggugccggggaaaaggcucugaagcuuucuugguucaaaaagggcuccucaauuggaaaaauguuugaggccaccgcacgcggcgccagaaggauggcuauccugggggauacagccugggacuucggaaguaucgguggcguguuuacgagcgucgggaaguuggugcaucagguauucggagcagcguacggcgugcucuuuuccgguguuucuuggaccaugaaaauugggaucggcauucuguuaacuuggcugggacuaaacagccggucaacaagucucuccaugaccuguauagcugucggcauggugacacuguaccuuggggugaugguccaggccgauagcggaugcguuaucaauuggaagggccgagaauugaagugugguucugggauuuucgugacuaacgaggugcacaccuggacggaacaauauaaauuucaggcagacucaccgaagcgccugagugccgcuaucggaaaagccugggaggagggcguaugcgguaucagaagcgcaacaaggcucgaaaacauuauguggaagcagauauccaaugagcugaaccauaucuuacuggaaaaugacaugaaauucaccgucgugguuggcgaugcuaacgggauucuugcccagggaaagaaaaugauccggccucaacccauggagcaccgcuacucuuggaagucguggggcaaggcgaaaauuaucggggccgacauacagaauagcacuuuuaucauugauggaccagacaccccugaaugucccgaugaccagagagcuuggaacaucugggagguggaggauuauggcuucgguauuuuuacaacuaauaucugguugaagcucagggacuccuacacccagaugugcgaucaccgucugaugucagcagccauaaaagacaguaaggcuguccaugccgauaugggguauuggauugaaucugagaaaaacgaaacauggaagcuagcacgggcgagcuucaucgaggugaagacguguauuuggccaaaaucccacacccuguggucaaauggaguucucgaaagcgagaugaucauacccaagaucuacggcgguccuauuucucaacauaacuaucgaccaggcuacuucacucagacagccgggccguggcaccugggaaaacuugaguuggacuuugaucugugcgaaggcaccacugugguagucgacgagcacugcgggaauagaggacccuccuuaaggacaaccacggugacuggcaagaucauucaugaaugguguugccgcaguuguacccucccuccacugcgguucagaggugaggacgggugcugguacggaauggagaucaggcccgugaaagaaaaggaggaaaaccuuguccgcagcaugguuucugcuggcuccggugagguggauucauuuagucugggcauauuguguguaagcauuaugaucgaagaggugaugcgaucgcgguggucccguaagaugcucaugacagggacccuggccgucuuccuacugcucaucaugggacagcugacuuggaaugaccuuauuagauugugcaucauggugggcgcaaacgcuucugauaggauggggaugggaacaaccuaucuggccuuaauggcaacauuuaaaaugcgcccuauguucgccguuggccuccuguuucggagacuuacuagcagggaggugcugcuacucaccauuggucugucauuggucgcuaguguggaacugccaaauuccuuagaggaacucggggacggacuggcgaugggcauaaugaugcuuaagcuguugacggaguuccaaccccaccagcucuggacaacccugcuaucucugacuuuuaucaaaaccacacuuagccucgauuacgccuggcgaacuauggcaaugguucuguccauugugucauuguucccgcuguguuuaagcaccacgagucagaagacaaccuggcucccuguccugcuuggcucuuuugggugcaaaccacugacuauguucuugaucacagaaaacaagauuuggggacgcaaguccuggccccucaacgaggguaucauggcuauaggcaucguaagcauucugcuaucgucacugcuuaaaaaugacgugccucucgccgggccccugaucgccggaggcauguugauugcuuguuauguuaucucugguaguuccgcagauuuaagccuggagaaggccgcggaagugucuugggaggaagaggcugaacauagcgggaccucccacaacauacucgucgaggugcaggacgauggaacuaugaaaauuaaggacgaggaacgggaugacacacugaccauccuucugaaagccacguugcuagcaguaucaggcguguacccaaugaguaucccugccacuuuuuucgucugguauuucuggcaaaagaaaaagcagagaagcggcguucugugggauacccccucuccaccggagguggaaagggcugugcucgacgacgggauuuaccguauacugcagcgcggacuuuuaggucggucccaggucggcguggggguuuuucaagauggaguauuccauacaauguggcacgugaccagaggcgcaguccugauguaucaggguaagaggcucgagccuucaugggccagugugaaaaaggacuugaucagcuacgggggaggcuggcgauuucagggcuccuggaauacaggggaggaaguucaggugauugcggucgagcccggaaaaaacccaaagaaugugcaaacuacccccgguacguucaaaacaccugaaggcgagguaggggcuaucgcccuggauuuuaagccaggaacuucuggcucgcccauugucaaccgggaagguaagaucguggggcucuacggaaauggcguugugaccacaagcggcaccuaugucucagcaauagcccaggcuaaaacuucccaggaggggccucugccggagaucgaagaggaaguguucaagaaacgcaaccuuaccauuauggaccugcacccaggaagugguaagacaagaagguacuugcccgccaucguucgggaggcaauuaaacgaaagcuaagaacgcugauccucgcuccuacucgcguggucgccucugaaauggcggaggccuuaaagggcaugccaauaagguaucaaaccacagcagugaaaagcgagcauaccgggcgugaaauuguagaucugaugugccacgcuacuuuuacaaugcggcuucugucccccgugagaguuccuaauuacaacaugaucaucauggacgaggcccauuucaccgauccggcuucaauugcagccaggggauauaucucuacgcgcgucggcaugggugaagccgcugcgauauuuaugacugcaacacccccagggagcguggaggccuucccucagaguaaugcugugauucaggacgaagagcgagauauccccgagagauccuggaacagcggauacgacuggauuaccgauuuuccaggcaagaccgucugguucguaccuucuaucaaaucaggcaaugacauagccaacugucuccggaagaaugggaaaagggugauucaguugucccgcaagacuuucgacacagaauaucaaaagacccguaacaacgauugggacuacguugugacaacugauaucagugagaugggagcaaauuuuagagccgaccgggucaucgaucccaggcgcugccugaaaccagugauucucaaggacgguccggaacgaguuauccuggcuggcccuaugcccgugacggucgcgagcgccgcacagagacgggggaggauuggacgcaaccagaauaaagagggcgaucaguacguguauaugggucaaccacuuaacaaugacgaggaucacgcucauuggaccgaagccaagaugcuacuggacaacauaaauacacccgaggggaucauuccugcauuguucgaaccagagagagaaaaaucggccgcuaucgauggcgaguacagguuacggggagaggcccguaagacuuuuguagaacugaugcgccgaggcgaccuccccguguggcugucuuauaagguugcguccgagggguuccaguacagcgauagaagguggugcuuugacggagaacggaacaaucagguccuugaggaaaacauggacguggagaucuggaccaaagagggugaacgcaagaaacugagaccuagguggcucgaugcacggacauauucagacccguuggcccugcgagaguucaaggaauuugcugccggcagacgcagugugucuggggaucuaauucuggagauaggaaaacucccacagcaccuuacccugagggcucaaaaugcauuagacaacuuggucaugcugcacaauuccgaacagggcgguaaggccuaccggcaugcuauggaggagcuccccgauacuaucgaaacgcugaugcuucuggcccucauugcaguuuugaccgggggcgugacacuguucuuuuuaagcggaaaaggccuagggaagacuucaaucggacugcucuguguaauggcgaguagcgcccuucuguggauggcuaacguggagccucacuggauugccgcauccaucauauuggaauucuuucugaugguccuccugauccccgagccagaccgucagagaaccccucaggauaaucaacuugcuuaugugguuauuggucuccuguucaugaucuugacaguggccgcaaacgagaugggccuguuagaaaccacuaagaaagaccuagggauuggacaugucgccgcugagaaccagcaccacgcgacaaugcuggauguagaccucaggcccgccucugcauggacgcuuuacgcuguggccaccacuguuaucacaccaaugaugcgccauaccauagaaaauaccacagccaacauuagccugacugcaaucgcuaaucaggccgcgauuuugaugggccuggauaaggguuggccuaucuccaaaauggacauaggggugccgcuccuggcucuuggcugcuacucacaagucaaccccuuaacgcugaccgccgcagugcucauguuggucgcccacuaugcuaucauuggaccaggccugcaggcaaaggccacacgggaggcgcagaaacgaacugcugccgggaucaugaagaauccuaccguggauggaauuguugcaaucgaccuagaccccgugguauacgaugccaaguuugaaaaacagcugggccaaauaaugcuccuuauucuguguacaucucagaucuugcugaugagaaccacuugggcucucugcgagaguaucacgcuggccacagguccauuaaccacucuuugggaggggucgccuggaaaguucuggaacaccacaauugcagugagcauggcuaauaucuucaggggcuccuaucuggccggugcgggccucgccuuuucucuaaugaaaucacuggggggaggccgccgggggacuggagcacagggcgaaaccuugggugagaaguggaaaagacagcugaaccaacucagcaaguccgaauucaauacauacaagcguagugggauaauggaggucgacaggucugaagcuaaagagggacuuaagcggggcgagacgaccaaacaugccguuagccgcgguacugcaaagcugcgaugguuuguggaaagaaacuuggucaaacccgagggcaaggugauugaucugggguguggaaggggcggguggucauauuacugcgcuggacucaagaaaguaacagaagugaagggcuauaccaaaggugggccgggacacgaggaaccaaucccuauggccacuuacggcuggaauuuaguuaagcuguacuccggcaaagacguguucuuuacacccccagagaagugugauacccuucugugcgacauuggggagaguagccccaacccuacgaucgaagagggacggacccuacgcguccucaaaaugguggaaccguggcugagagguaaucaguucuguauaaagaucuugaaccccuauaugccaucugucguggagacacuggagcagaugcagaggaagcauggcgggaugcucguucgaaauccucuuucccggaacucaacucacgaaauguacuggguaagcugcggaaccggcaauauugugucggccgucaacaugacaucucguaugcuguuaaacagauuuacuaugacccaccgcaaacccacauaugagagggauguggaccugggugcggggacccggcauguugcuguggaaccugaggucgcaaauuuggauaucauuggacaaagaaucgaaaacauuaagaaugagcacaaaaguacuuggcauuacgacgaggauaacccauauaagacgugggccuaccacggcuccuaugaagugaaacccagcggcucagcuuccucuaugguaaauggggugguucgccuccugacaaagccuugggacgucaucccaauggugacccagauagccaugacugacaccacacccuucggacagcaaaggguguuuaaggagaaagucgauacgcgaaccccgcgggcaaagagagguacugcccagauuauggaaguuacagcuaaauggcuauggggcuuccuuagcaggaacaagaaaccucgcaucuguacccgugaggaauuuacucggaaggugagaaguaaugcggccaucggggcaguauucguggacgagaaccaguggaauuccgcuaaggaggccgucgaagaugagagguuuugggaccuggugcaccgcgaacgagagcuccauaaacagggaaagugcgcaacaugcguuuacaacaugaugggcaaacgggaaaagaaacugggugaguucgggaaggccaagggaagcagagcuauuugguacaugugguugggcgccagguuccuggaguuugaagcgcucggcuucaugaaugaggaucacugguuuucucgcgaaaacucauucagugggguggagggagagggucuucauaaacugggcuauauauuaagagacaucuccaagauuccagggggaaauauguacgcagaugacaccgccggcugggauacacggaucacugaagacgaucugcaaaacgaggcuaaaauuaccgacaucauggaacccgagcacgccuugcucgcaacgagcauauuuaagcugaccuaucagaauaaagucgugaggguacagcguccugcuaagaacgguacaguuauggaugugaucucucgacgcgaccagagagggucgggacaagucggcacuuacggccuaaacaccuucacaaauauggaagugcagcuuauucggcagauggagucagaggggaucuuucugccaagcgaacucgagacucccaaccuggccgaaaggguguugaauugguuagagaaacauggaaccgaacgccugaagagaauggcuauuuccggugacgauugugucguuaagccgguggacgaucgguucgccacggcacucaucgcgcuuaacgacaugggcaaaguaaggaaggauauaccucagugggagcccaguaaaggguggaaugacuggcaacaggugccauuuugcucucaccacuuccaucagcugauuaugaaggauggacgagagaucgucgugccuugucguaaccaggacgaacuaguuggcagagcccgcgugagccaaggugcuggguggucccugcgggagacagccugccucggaaaaucauaugcacagauguggcaguugauguacuuucacaggagagaucugcgccuugcugccaaugcaaucuguagugccguccccguggacuggguaccaaccucucggacuacauggagcauucaugcgcaccaccaauggaugaccacugaagauaugcuguccguuuggaacaggguguggauagaggaaaaucccuggauggaggacaagacccaugucucaagcugggaggaagugccuuaucucggcaagcgagaggaccaguggugcggcucuuuaaucgggcugacagcuagagccacgugggcaaccaacauucagguugccaucaaucaggugcggagguugauuggaaacgaaaauuaccuggauuacaugacuuccaugaaacgcuucaagaacgagagugacccagagggugcucucugguga

SEQ ID NO: 13479 - RNA, 9879 nt, Artificial Sequence
  derived and/or modified CDS sequence (opt3) from DENV-1__FJ410174__SS-prME
agcgugaccaugcugcucaugcuucugcccacagccuuggcuuuccacuuaacuacgagaggaggggaaccucauaugauagucuccaagcaggaaaggggaaaaucucuguuauuuaagaccucagcagguauuaacaugugcacacucauagccauggaccugggcgagcuuugugaagauacuaugaccuacaaaugcccacggaucacagaggcggaaccggacgauguugacuguuggugcaaugcuaccgauacuugggugacauaugggaccuguagucaaacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcacuguuucucgcccaugcuaucggcaccucgauuacgcagaagggcaucauauucaucuuacugaugcuuguuacuccaucaauggccaugcggugcguggggauuggaaaccgcgauuuugucgaggguuugagcggcgcgacauggguggacguaguucuggagcacgggaguugugugaccacuaucgcaaaagauaagcccacacuagacauugaacuccugaaaaccgaggucacgaauccugccgugcuuagaaagcugugcaucgaagcuaaaauauccaacaccacaacugauucuagguguccaacccaaggagaggccacauugguggaagaacaggacagcaauuucgucugccggcgcacuuuuguugaucgaggcugggguaacggguguggacucuucggcaagggcucccuguuaaccugcgcaaaguuuaaaugcgugacaaagcuggaggggaaaauuguacaguacgaaaaucucaaguauucagugaucgucaccgugcacacuggagaccagcaucaaguugguaacgagacgacagaacacggcaccauugcuacuaucacaccccaggccccuacaagugagauccagcuuaccgacuacggggcgcugacuuuggauuguagcccaagaacaggacuagacuucaaugaaauggugcugcucacgaugaaagagaagucuuggcugguccauaaacagugguuucuugaucugccguugcccuggaccuccggcgccucaacuagccaagagacauggaacaggcaggaccuccuggugaccuucaagacagcacacgcuaagaaacaggaaguaguuguguuagguagucaagagggggccaugcacacugcucugaccggcgccacggaaauucagaccucuggaacaacuaccauauuugcaggccaucuaaagugccggcucaaaauggauaagcugacacuuaaagggauguccuaugucauguguacuggcagcuucaaguuggagaaggaaguggccgagacccagcacgguacgguccuggugcagguuaaauacgagggcacagacgcuccuugcaagaucccauucucggcgcaagaugaaaaaggggugacccagaauggacgucucauuacugcaaaccccaucguaacagacaaggagaaaccugucaauauagaaaccgagccacccuuuggcgagucuuauauugugguuggugccggggaaaaggcucugaaacuuuccugguucaaaaagggcucaaguaucggaaaaauguuugaggccacugcacgcggcgccagaaggauggcuauccugggggauaccgccugggacuucggaagcauugguggcguguuuacauccgucgggaaguuggugcaucagguauucggagcagcguacggcgugcucuuuucugguguuagcuggacgaugaaaaucgggauuggcauacuguuaaccuggcugggacuaaacucacggaguacuucccucagcaugacauguaucgcugucggcauggugacccuguaccuuggggugaugguccaggccgauucuggaugcguuauuaauuggaagggccgagaauugaagugugguucagggaucuucgugacaaacgaggugcacacuuggaccgaacaauauaaauuucaggcagacaguccgaagcgccugagcgccgcuaucggaaaagccugggaggagggcguaugcgguauuagauccgcaacgaggcucgaaaacauaauguggaagcagaucucuaaugagcugaaccauauuuuacuggaaaaugacaugaaauucacagucgugguuggcgaugcuaacgggauccuugcccagggaaagaaaaugauucggccucaacccauggagcaccgcuacucguggaaaagcuggggcaaggcgaaaaucauaggggccgacauccagaauaccacuuuuauuaucgauggaccagacaccccugaaugucccgaugaccagagagcuuggaacauuugggagguggaggauuauggcuucgguaucuuuacaacuaauauaugguugaagcucagggacuccuacacccagaugugcgaucaccgucugaugucagcagccauuaaagacaguaaggcuguccaugccgauaugggguauuggaucgaaucugagaaaaacgaaacauggaagcuagcacgggcgagcuucauugaggugaagacguguaucuggccaaaaucccacacccuguggucaaauggaguucucgaaagcgagaugauaauccccaagauuuacggcgguccuaucucucaacauaacuaucgaccaggcuacuucacucagacagccgggccguggcaccugggaaaacuugaguuggacuuugaucugugcgaaggcaccacugugguagucgacgagcacugcgggaauagaggacccuccuuaaggacaaccacggugacuggcaagauuauccaugaaugguguugccgcaguuguacccucccuccacugcgguucagaggugaggacgggugcugguacggaauggagauaaggcccgugaaagaaaaggaggaaaaccuuguccgcagcaugguuucugcuggcuccggugagguggauucauuuagucugggcauuuuguguguaagcaucaugaucgaagaggugaugcgaucgcgguggucccguaagaugcucaugacagggacccuggccgucuuccuacugcucauuaugggacagcugacuuggaaugaccuuaucagauugugcauuauggugggcgcaaacgcuucugauaggauggggaugggaauaacauaucuggccuuaauggcaaccuuuaaaaugcgcccuauguucgccguuggccuccuguuucggagacuuacaagcagggaggugcugcuacucacuaucggucugucauuggucgcuaguguggaacugccaaauuccuuagaggaacucggggacggacuggcgaugggcauuaugaugcuuaagcuguugaccgaguuccaaccccaccagcucuggacgacacugcuaucucugaccuuuaucaaaacuacccuuagccucgauuacgccuggcgaacaauggcaaugguucuguccauugugucauuguucccgcuguguuuaagcacuaccagucagaagacgacauggcucccuguccugcuuggcucuuuugggugcaaaccacugaccauguucuugaucacugaaaacaagauauggggacgcaaguccuggccccucaacgaggguaucauggcuauuggcaucguaagcauucugcuaucgucacugcuuaaaaaugacgugccucucgccgggccccugaucgccggaggcauguugauagcuuguuauguuauuucugguaguuccgcagauuuaagccuggagaaggccgcggaagugucuugggaggaagaggcugaacauagcgggacaucccacaacauccucgucgaggugcaggacgauggaaccaugaaaaucaaggacgaggaacgggaugacacucugacaauucuucugaaagccaccuugcuagcaguaucaggcguguacccaaugaguauaccugccacgcuguuugucugguauuucuggcaaaagaaaaagcagagaagcggcguucucugggauacucccucuccaccggagguggaaagggcugugcuggacgacgggaucuaccguauucuucagcgcggauuacugggucggucccaggucggcguggggguuuuccaagauggaguauuucauaccauguggcacgugacaagaggcgcaguccucauguaucaggguaagagguuggagccuucaugggccagugugaaaaaggaccugaucagcuacgggggaggcuggcgauuccagggcuccuggaauaccggggaggaaguucaggugauugcggucgagcccggcaagaauccaaagaaugugcaaacaacucccgguaccuuuaaaacgccugaaggcgagguaggggcuaucgcccucgauuucaagccaggaacaucuggcucgcccauagucaaccgggaagguaagaucguggggcuguacggaaauggcguugugacuaccagcggcacauaugucucagcaauugcccaggcuaaaaccucccaggaggggccucuuccggagaucgaagaggaaguguuuaagaaacgcaaccugacuauuauggacuugcacccaggaagugguaagaccagaagguaccuacccgccaucguucgggaggcaauaaaacgaaagcugagaacacucauuuuagcuccuacgcgcguggucgccucugaaauggcggaggcccugaagggcaugccaaucagguaucaaacuaccgcagugaaaagcgagcauacagggcgugaaaucguagaucuuaugugccacgcuaccuucacuaugcggcugcucucccccgugagaguuccuaauuacaacaugauuaucauggacgaggcccauuuuacagauccggcuucaauagcagccaggggauauauuucuacccgcgucggcaugggugaagccgcugcgaucuucaugacggcaacucccccagggagcguggaggccuuuccucagaguaaugcugugauucaggacgaagaacgagauauccccgagagauccuggaacagcggauacgacuggauaacagauuucccaggcaagaccgucugguuuguaccuucuauuaaaucaggcaaugacaucgccaacuguuugcggaagaaugggaaaagggugauccagcugucccgcaagaccuucgacacugaauaucaaaagaccaagaacaacgauugggacuacguugugaccacagauauuagugagaugggagcaaauuuccgugccgacagagucaucgauccccggaggugccucaagccagugauucugaaagacgguccggaacgcguuauacuugcuggcccuaugcccgugacugucgcgagcgccgcacagcgaagagggcggaucggaaggaaccagaauaaggagggcgaucaguacguguauaugggucaaccacuaaacaaugacgaggaucacgcucauuggacggaagccaaaaugcuguuggacaacauuaauacccccgaggggaucaucccugcauuauuugaaccagagcgcgaaaagucggccgcuauugauggcgaguacagacugaggggagaggcccggaagacauucguagaacucaugcgucgcggcgaccugcccguguggcuuucuuauaaaguugcguccgagggguuucaguacagcgaucgaagauggugcuucgacggagaaaggaacaaucagguccuggaggaaaacauggacguggagauauggacuaaggagggugaacggaaaaagcuccgcccuagaugguuggaugcaaggaccuauucagacccgcuggcccuacgggaguuuaaagaguucgcugccggccgaagaagugugucuggggaucugauccucgagauuggaaaacuuccacagcaccugacauuacgcgcucaaaaugcauuggacaaccuggucaugcuccacaauuccgaacagggcgguaaagccuacaggcaugcuauggaggagcugcccgauaccaucgaaacucuuaugcugcucgccuugauugcaguucugaccgggggagugacguuauuuuuccuaagcggaaagggccuggggaagacaucaaucggacuccuuuguguaauggcgaguagcgcccuguuguggauggcuaacguggagccucacuggauagccgcauccaucauucuggaauuuuuccucaugguccugcuuauccccgagccagaccggcagcguacuccucaggauaaucaacucgcuuaugugguuauuggucuguuguuuaugauccugaccguggccgcaaacgagaugggcuuacuagaaacaaccaaaaaggaccuggggauaggacaugucgccgcugagaaccagcaccacgcgacuaugcucgauguagaccuuagacccgccucugcauggacacuguacgcuguggccacgaccguuauuacuccaaugaugaggcauacaaucgaaaauaccaccgccaacauuagcuugacagcaaucgcuaaucaggccgcgauacugaugggccucgauaaagguuggccuaucuccaagauggacauuggggugccgcugcuugcuuuaggcugcuacucacaagucaacccccugacucucacggccgcaguguugaugcuggucgcccacuaugcuaucauuggaccaggccuacaggcaaaagccacccgcgaggcgcagaagcggacagcugccgggaucaugaagaauccuacuguggauggaauaguugcaauugaccuggaccccgugguauacgaugccaaauucgaaaagcagcucggccaaaucaugcuucugaucuuguguaccucucagauucugcucaugcgaacaaccugggcucugugcgagaguaucacuuuagccacggguccacuuacaacccugugggaggggucgccuggaaaauuuuggaacacuaccauagcagugagcauggcuaauauuuucagaggcuccuaucucgccggugcggcccuagcauucucucugaugaagucauugggcgggggaaggcgcggcacaggggcucagggagaaacucugggcgagaaauggaagcggcagcucaaccaacuuagcaaguccgaauuuaauaccuacaaaagaagugguaucauggaggucgaccguucugaagccaaggaggggcugaaaaggggagagacaacgaagcaugcaguuagccggggcaccgcuaaauugcgcugguucguggaacgaaaccuggucaagcccgaggguaaggugauugaucucggcugugggagaggaggcuggucauauuacugcgccgggcuaaagaagguaacugaagugaaaggauauacaaagggcgguccggggcacgaggaaccaaucccuauggccaccuacggauggaaucugguuaaacuuuacuccggcaaggacguguuuuucacucccccagagaaaugugauacacugcuaugcgacauaggcgagaguagccccaacccuaccaucgaagaggggaggacgcuccggguccugaagaugguggaaccgugguugcgcggaaaucaguuuuguauuaagauccugaaccccuauaugccaucugucguggagacccucgagcagaugcagagaaaacaugguggcaugcuuguuaggaauccucugucccgaaacucaacacacgaaauguacuggguaagcugcgggacuggaaauauugugucggcggucaacaugaccucucggauguuacugaaccguuucacaaugacucacagaaagcccaccuaugagcgcgauguggacuugggcgcugguacaaggcauguugcaguggaaccugaggucgccaaucucgauaucauugggcaacggaucgaaaacaucaaaaaugagcacaagaguaccuggcauuacgacgaggauaacccauauaaaacuugggcuuaccacggauccuaugaagugaagcccagcggcucagccuccucuaugguaaauggcgugguuagacugcuaacgaagccuugggacgucauuccaauggugacacagaucgcaaugaccgacacuacccccuuugggcagcaacgcguguucaaagagaaggucgauacaaggacgccgcgagccaaacggggaaccgcucagaucauggaaguuacugcgaaguggcuuugggguuuucugagcagaaacaaaaagccuaggauuuguacacgcgaggaguucacccguaaggugcggaguaaugccgcaauaggcgcuguauuuguggacgagaaccaguggaacuccgccaaagaggcagucgaagaugagagauucugggaccucgugcacagggaacgcgagcugcauaagcaggggaaaugcgccacuugcguuuacaacaugaugggaaagcgagagaaaaaguugggcgaguuugguaaggcuaaagggagccgggccaucugguacauguggcugggagcgagauuccucgaguucgaagcacuuggcuuuaugaaugaggaucacugguucucuagggaaaacucauuuaguggcguggagggggagggacugcauaaguuagguuauauucugcgcgacaucuccaaaauuccaggcgggaauauguacgccgaugacacagcuggaugggauaccagaaucacagaagacgauuugcaaaacgaggccaagauaacugacaucauggaagcagagcacgcucuccuggccaccagcauuuucaaacuaacguaucagaauaaggucgugcggguacagaggcccgcuaaaaacggcaccguuauggaugugaucucucgucgagaccagcgcgguucggggcaagucggaacauacggccuuaacacuuuuaccaauauggaagugcagcugauuagacagauggagucagagggcaucuuccucccuagcgaacuggagacaccaaacuuggccgaacggguguuagacuggcuggagaagcaugggacugaaaggcucaagcgcauggcaauauccggagaugacugugucguuaaacccguggaugacagauuugcgaccgcccuuauugcucugaaugauauggguaagguacggaaagacaucccgcagugggagccuaguaagggcuggaacgauuggcaacaggugcccuucugcucucaccacuuucaucagcuaaucaugaaagacgggagggagauugucgugccaugucgaaaucaggaugaacugguuggacgugccagagugagccaaggcgcagguuggucccuccgcgagacggcuugcuuggggaagucauaugcccagauguggcagcugauguacuuccaccggagggaccuuagacuggcagccaacgcgauauguagugcugucccuguggauuggguacccacaucucgcaccacuuggagcauccaugcccaccaccaauggaugacaaccgaagacaugcucuccguuuggaaucggguguggauugaggaaaacccauggauggaggacaagacucaugucucaagcugggaggaagugcccuauuuaggaaaaagggaggaucaguggugcggcucucugaucggcuugaccgcacgagccacaugggcuacgaauauucagguugccaucaaccaggugagacggcugauagggaaugaaaacuaccucgacuacaugaccuccaugaagagguuuaaaaaugagagugauccugagggagcacuuugguga

SEQ ID NO: 13480 - RNA, 9879 nt, Artificial Sequence
  derived and/or modified CDS sequence (opt3) from DENV-1__FJ410175__SS-prME
agcgugaccaugcugcucaugcuucugcccaccgccuuggcuuuccacuuaacuacgagaggaggggaaccucauaugaucgucuccaagcaggaaaggggaaaaucucuguuauuuaagaccucagcagguauuaacaugugcacacucauagccauggaccugggagagcuuugugaagauacuaugaccuacaaaugcccacggaucacagaggcggaaccggacgauguugacuguuggugcaaugcuaccgauacuugggugacauaugggaccuguagucaaacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcacuguuucucgcccaugcuaucggcaccucgauuacgcagaagggcaucauauucaucuuacugaugcuuguuacuccaucaauggccaugcggugcguggggauuggaaaccgcgauuuugucgaggguuugagcggcgcgacauggguggacguaguucuggagcacgggaguugugugaccacuauggcaaaagauaagcccacauuggacaucgaacuccugaaaaccgaggucacgaauccugccgugcuuagaaagcugugcauugaagcuaaaaucuccaacaccacaacugauucuagguguccaacccaaggagaggccacauugguggaagaacaggacagcaauuucgucugccggcgcacuuuuguugaucgaggcugggguaacggguguggacucuucggcaagggcucccuguuaaccugcgcaaaguuuaaaugcgugacaaagcuggaggggaaaauaguacaguacgaaaaucucaaguauucagugauugucaccgugcacacuggagaccagcaucaaguugguaacgagacgacagaacacggcaccaucgcuacuauuacaccccaggccccuacaagugagauccagcuuaccgacuacggggcgcugacuuuggauuguagcccaagaacaggacuagacuucaaugaaauggugcugcucacgaugaaagagaagucuuggcugguccauaaacagugguuucuugaucugccguugcccuggaccuccggcgccucaacuagccaagagacauggaacaggcaggaccuccuggugaccuucaagacagcacacgcuaagaaacaggaaguaguuguguuagguagucaagagggggccaugcacacugcucugaccggcgccacggaaauccagaccucuggaacaacuaccauuuuugcaggccaucuaaagugccggcucaaaauggauaagcugacacuuaaagggauguccuaugucauguguacuggcagcuucaaguuggagaaggaaguggccgagacccagcacgguacgguccuggugcagguuaaauacgagggcacagacgcuccuugcaagauaccauucucggcgcaagaugaaaaaggggugacccagaauggacgucucaucacugcaaaccccauuguaacagacaaggagaaaccugucaauaucgaaaccgagccacccuuuggcgagucuuauauagugguuggugccggggaaaaggcucugaaacuuuccugguucaaaaagggcucaaguauuggaaaaauguuugaggccacugcacgcggcgccagaaggauggcuauccugggggauaccgccugggacuucggaagcaucgguggcguguuuacauccgucgggaaguuggugcaucagguauucggagcagcguacggcgugcucuuuucugguguuagcuggacgaugaaaauugggaucggcauucuguuaaccuggcugggacuaaacucacggaguacuucccucagcaugacauguauagcugucggcauggugacccuguaccuuggggugaugguccaggccgauucuggaugcguuaucaauuggaagggccgagaauugaagugugguucagggauuuucgugacaaacgaggugcacacuuggaccgaacaauauaaauuucaggcagacaguccgaagcgccugagcgccgcuaucggaaaagccugggaggagggcguaugcgguaucagauccgcaacgaggcucgaaaacauuauguggaagcagauaucuaaugagcugaaccauaucuuacuggaaaaugacaugaaauucacagucgugguuggcgaugcuaacgggauucuugcccagggaaagaaaaugauccggccucaacccauggagcaccgcuacucguggaaaagcuggggcaaggcgaagauuaucggggccgacauacagaauaccacuuuuaucauugauggaccagacaccccugaaugucccgaugaccagagagcuuggaacaucugggagguggaggauuauggcuucgguauuuuuacaacuaauaucugguugaagcucagggacuccuacacccagaugugcgaucaccgucugaugucagcagccauaaaagacaguaaggcuguccaugccgauaugggguauuggauugaaucugagaaaaacgaaacauggaagcuagcacgggcgagcuucaucgaggugaagacguguauuuggccaaaaucccacacccuguggucaaauggaguucucgaaagcgagaugaucauacccaagaucuacggcgguccuauuucucaacauaacuaucgaccaggcuacuucacucagacagccgggccguggcaccugggaaaacuugaguuggacuuugaucugugcgaaggcaccacugugguagucgacgagcacugcgggaauagaggacccuccuuaaggacaaccacggugacuggcaagaucauucaugaaugguguugccgcaguuguacccucccuccacugcgguucagaggugaggacgggugcugguacggaauggagaucaggcccgugaaagaaaaggaggaaaaccuuguccgcagcaugguuucugcuggcuccggugagguggauucauuuagucugggcauauuguguguaagcauuaugaucgaagaggugaugcgaucgcgguggucccguaagaugcucaugacagggacccuggccgucuuccuacugcucaucaugggacagcugacuuggaaugaccuuauuagauugugcaucauggugggcgcaaacgcuucugauaggauggggaugggaacaaccuaucuggccuuaauggcaacauuuaaaaugcgcccuauguucgccguuggccuccuguuucggagacuuacuagcagggaggugcugcuacucaccauuggucugucauuggucgcuaguguggaacugccaaauuccuuagaggaacucggggacggacuggcgaugggcauaaugaugcuuaagcuguugacggaguuccaaccccaccagcucuggacaacccugcuaucucugacuuuuaucaaaaccacacuuagccucgauuacgccuggcgaacuauggcaaugguucuguccauugugucauuguucccgcuguguuuaagcaccacgagucagaagacaaccuggcucccuguccugcuuggcucuuuugggugcaaaccacugacuauguucuugaucacagaaaacaagauuuggggacgcaaguccuggccccucaacgaggguaucauggcuauaggcaucguaagcauucugcuaucgucacugcuuaaaaaugacgugccucucgccgggccccugaucgccggaggcauguugauugcuuguuauguuaucucugguaguuccgcagauuuaagccuggagaaggccgcggaagugucuugggaggaagaggcugaacauagcgggaccucccacaacauacucgucgaggugcaggacgauggaacuaugaaaauuaaggacgaggaacgggaugacacacugaccauccuucugaaagccacguugcuagcaguaucaggcguguacccaaugaguaucccugccacucuguuugucugguauuucuggcaaaagaaaaagcagagaagcggcguucucugggauacccccucuccaccggagguggaaagggcugugcuggacgacgggauuuaccguauacuucagcgcggauuacugggucggucccaggucggcguggggguuuuccaagauggaguauuucauacaauguggcacgugaccagaggcgcaguccucauguaucaggguaagagguuggagccuucaugggccagugugaaaaaggaccugaucagcuacgggggaggcuggcgauuccagggcuccuggaauacaggggaggaaguucaggugauugcggucgagcccggcaagaauccaaagaaugugcaaacuacccccgguacguuuaaaacaccugaaggcgagguaggggcuaucgcccucgauuucaagccaggaacuucuggcucgcccauugucaaccgggaagguaagaucguggggcuguacggaaauggcguugugaccacaagcggcaccuaugucucagcaauagcccaggcuaaaacuucccaggaggggccucuuccggagaucgaagaggaaguguuuaagaaacgcaaccugaccauuauggacuugcacccaggaagugguaagacaagaagguaccuacccgccaucguucgggaggcaauuaaacgaaagcugagaacgcucaucuuagcuccuacucgcguggucgccucugaaauggcggaggcccugaagggcaugccaauaagguaucaaaccacagcagugaaaagcgagcauaccgggcgugaaauuguagaucuuaugugccacgcuacuuucacaaugcggcugcucucccccgugagaguuccuaauuacaacaugaucaucauggacgaggcccauuuuaccgauccggcuucaauugcagccaggggauauaucucuacgcgcgucggcaugggugaagccgcugcgauauucaugacugcaacacccccagggagcguggaggccuuuccucagaguaaugcugugauucaggacgaagaacgagauauccccgagagauccuggaacagcggauacgacuggauuaccgauuucccaggcaagaccgucugguuuguaccuucuaucaaaucaggcaaugacauagccaacuguuugcggaagaaugggaaaagggugauucagcugucccgcaagacuuucgacacagaauaucaaaagaccaaaaacaacgauugggacuacguugugacaacugauaucagugagaugggagcaaauuuccgugccgacagagucaucgauccccggaggugccucaagccagugauucugaaagacgguccggaacgcguuauccuugcuggcccuaugcccgugacggucgcgagcgccgcacagcgaagagggcggauuggaaggaaccagaauaaggagggcgaucaguacguguauaugggucaaccacuaaacaaugacgaggaucacgcucauuggaccgaagccaaaaugcuguuggacaacauaaauacacccgaggggaucauuccugcauuauuugaaccagagcgcgaaaagucggccgcuaucgauggcgaguacagacugaggggagaggcccggaagacuuucguagaacucaugcgucgcggcgaccugcccguguggcuuucuuauaaaguugcguccgagggguuucaguacagcgaucgaagauggugcuucgacggagaaaggaacaaucagguccuggaggaaaacauggacguggagaucuggaccaaggagggugaacggaaaaagcuccgcccuagaugguuggaugcaaggacauauucagacccgcuggcccuacgggaguuuaaagaguucgcugccggccgaagaagugugucuggggaucugauucucgagauaggaaaacuuccacagcaccugaccuuacgcgcucaaaaugcauuggacaaccuggucaugcuccacaauuccgaacagggcgguaaagccuacaggcaugcuauggaggagcugcccgauacuaucgaaacgcuuaugcugcucgccuugauugcaguucugaccgggggcgugacauuauuuuuccuaagcggaaagggccuggggaagacuucaaucggacuccuuuguguaauggcgaguagcgcccuguuguggauggcuaacguggagccucacuggauugccgcauccaucauacuggaauuuuuccucaugguccugcuuauccccgagccagaccggcagcguaccccucaggauaaucaacucgcuuaugugguuauuggucuguuguuuaugauccugacaguggccgcaaacgagaugggcuuacuagaaaccacuaaaaaggaccuggggauuggacaugucgccgcugagaaccagcaccacgcgacaaugcucgauguagaccuuagacccgccucugcauggacgcuguacgcuguggccaccacuguuaucacaccaaugaugaggcauaccauagaaaauaccacagccaacauuagcuugacugcaaucgcuaaucaggccgcgauucugaugggccucgauaaagguuggccuaucuccaagauggacauaggggugccgcugcuugcuuuaggcugcuacucacaagucaacccccugacgcucaccgccgcaguguugaugcuggucgcccacuaugcuaucauuggaccaggccuacaggcaaaagccacacgcgaggcgcagaagcggacugcugccgggaucaugaagaauccuaccguggauggaauuguugcaaucgaccuggaccccgugguauacgaugccaaauucgaaaagcagcucggccaaauaaugcuucugauuuuguguacaucucagauccugcucaugcgaaccacuugggcucugugcgagaguaucacguuagccacagguccacuuaccacucugugggaggggucgccuggaaaauuuuggaacaccacaauugcagugagcauggcuaauaucuucagaggcuccuaucucgccggugcgggccuagccuucucucugaugaagucacuagggggaggcaggcgcgggacuggagcacagggcgaaacccugggugagaaauggaagcggcagcucaaccaacuuagcaaguccgaauuuaauacauacaaaagaagugggauaauggaggucgaccguucugaagcuaaggagggacugaaaaggggcgagacgaccaagcaugccguuagccgggguacugcaaaauugcgcugguucguggaacgaaaccuggucaagcccgagggcaaggugauugaucucggguguggaagaggcggguggucauauuacugcgcuggacuaaagaagguaacagaagugaaaggcuauaccaagggugggccgggacacgaggaaccaaucccuauggccacuuacggcuggaaucugguuaaacuuuacuccggcaaggacguguuuuucacacccccagagaaaugugauacccugcuaugcgacauuggggagaguagccccaacccuacgaucgaagagggaaggacccuccggguccugaagaugguggaaccgugguugcgcgguaaucaguuuuguauaaagauccugaaccccuauaugccaucugucguggagacacucgagcagaugcagagaaaacauggcgggaugcuuguuaggaauccucugucccgaaacucaacucacgaaauguacuggguaagcugcggaaccggcaauauugugucggccgucaacaugacaucucggauguuacugaaccguuucacuaugacccacagaaagcccacauaugagcgcgauguggacuugggugcggggaccaggcauguugcuguggaaccugaggucgcaaaucucgauaucauuggacaacggaucgaaaacauuaaaaaugagcacaagaguacuuggcauuacgacgaggauaacccauauaaaacgugggccuaccacggcuccuaugaagugaagcccagcggcucagcuuccucuaugguaaauggggugguuagacugcuaacaaagccuugggacgucaucccaauggugacccagauagccaugacugacaccacacccuuuggacagcaacgcguguucaaagagaaggucgauacgaggaccccgcgagcaaaacgggguacugcccagauuauggaaguuacagcuaaguggcuuuggggcuuucugagcagaaacaaaaagccuaggaucuguacccgcgaggaguucacucguaaggugcggaguaaugcggccaucggggcaguauuuguggacgagaaccaguggaacuccgcuaaagaggccgucgaagaugagagauucugggaccucgugcacagggaacgcgagcugcauaagcagggaaaaugcgcaacaugcguuuacaacaugaugggcaagcgagagaaaaaguugggugaguuugggaaggccaaaggaagccgggcuauuugguacauguggcugggcgccagauuccucgaguucgaagcgcuuggcuuuaugaaugaggaucacugguucucuagggaaaacucauuuagugggguggagggagagggucugcauaaguuaggcuauauacugcgcgacaucuccaaaauuccagggggaaauauguacgcagaugacaccgccggcugggauacaagaaucacugaagacgauuugcaaaacgaggcucggauuaccgacaucauggaacccgagcacgcccuccuggcaacgagcauauucaagcuaaccuaucagaauaaagucgugaggguacagcguccugcuaagaacgguacaguuauggaugugaucucucgacgcgaccagagagggucgggacaagucggcacuuacggccuuaacaccuuuacaaauauggaagugcagcugauucggcagauggagucagaggggaucuuccucccaagcgaacuggagacucccaacuuggccgaaaggguguuagacuggcuggagaaacauggaaccgaacgccucaagagaauggcuauuuccggugaugacugugucguuaagccgguggaugaccgguuugccacggcacuuaucgcgcugaaugauaugggcaaaguaaggaaggacauaccucagugggagcccaguaaaggguggaacgauuggcaacaggugccauucugcucucaccacuuucaucagcuaauuaugaaggacggacgagagaucgucgugccuugucguaaucaggaugaacugguuggcagagcccgcgugagccaaggugcuggguggucccuccgggagacagccugcuugggaaaaucauaugcacagauguggcagcugauguacuuccacaggagagaccuucgccuggcugccaacgcaaucuguagugccguccccguggauuggguaccaaccucucggacuacauggagcauucaugcgcaccaccaauggaugaccacugaagacaugcucuccguuuggaauaggguguggauagaggaaaaccccuggauggaggacaagacccaugucucaagcugggaggaagugccuuauuuaggcaagcgagaggaucaguggugcggcucucugaucggguugacagcuagagccacgugggcaaccaauauucagguugccaucaaccaggugcggaggcugauuggaaaugaaaacuaccucgacuacaugacuuccaugaaacgcuuuaagaaugagagugauccagagggugcucuuugguga

SEQ ID NO: 13481 - RNA, 9879 nt, Artificial Sequence
  derived and/or modified CDS sequence (opt3) from DENV-1__FJ562105__SS-prME
agcgugaccaugcugcucaugcuucugcccacagucuuggccuuccacuuaacuacgagaggcggggagccucauaugaucguuggaaagcaggaaagggguaaaucccugcuauuuaagaccucugcuggcgugaacaugugcacacucauugcaauggaccugggggagcuuugugaagauacuaugaccuacaaaugcccacggauaacagaggccgaaccggacgauguagacuguuggugcaaugcgaccgauacuugggugacauauggaaccuguucacaaacgggcgagcaccgccgagacaagcguagugucgcucuggccccccauguggguuuggggcucgagacuagaaccgaaacauggaugagcuccgagggagcauggaaacagauccagaagguugaaacuugggcccugaggcacccuggcuucaccgugauugcuuuuuuccuggcacaugccaucggcacaucuauuacccagaaggggaucauauuuauccucuuaaugcuggucacgccaucgauggcuaugcggugcgugggaauugguaaccgcgauuucguagagggccuuucaggggccacuuggguugacguggucuuggagcacggaagcugugugacaaccauggcgaaaaauaagcccacucuggauaucgaacuacucaaaacagaggugaccaacccugcaguccugagaaagcuuugcauugaagccaaaaucaguaauacgaccacagacuccagguguccaacucaaggcgaggcuacccugguugaagagcaggaugccaacuuugugugccggcgcacauucguagaccgagguugggggaauggauguggcuuguuuggcaaggggucucuccugacuugcgcaaaguucaaaugcgugaccaaguuagagggaaaaauaguccaguacgaaaaccugaaguauagcgugauuguuacagugcacaccggugaucagcaucaagucggcaaugagacuacggaacacgggacaaucgcuaccauuacuccccaggccccuaccuccgagauccagcucacagacuacggagcgcuuacccuggacuguucaccaagaacuggcuuggauuuuaacgaaauggugcuacugacaaugaaagagaagaguuggcucguacauaaacagugguuccuggaccuuccgcugcccuggacgagcggugccucuaccucccaagagacuuggaauaggcaggauuugcucguuacauuuaagaccgcacacgcuaagaaacaggaaguggucgugcuggggucacaagagggcgccaugcacacagcuuuaacuggagccaccgaaauccagacgagcggcaccacaacuauuuucgcagggcaucugaagugccggcuaaaaauggacaagcucacccugaaaggaaugaguuaugucauguguacagguucuuucaagcuugagaaggaaguggccgagacucagcacggcaccguuuuggugcagguaaaauacgaggggacggaugcuccuugcaagauaccacuguccacacaagacgaaaaaggagucacccagaacggccgucucaucacugcgaaucccauugugacagauaaggagaaaccuguuaacaucgaaaccgagccacccuuuggugagagcuauauaauugugggggcaggcgaaaaggcccugaagcuuucgugguucaaaaagggaucuuccaucggcaaaauguuugaggcuacugcccgcggggcaagaaggauggccauccugggagacaccgcuugggauuucgguucaauuggcggggucuuuacaagugugggaaaguugguacaucagguguucggcacggccuacgguguucucuuuagcggggucuccuggaccaugaaaaucggcauuggaauacuguuaacuuggcugggccuaaauucucggagcgcaucacucaguaugacauguaucgcgguggggauggugacccuguaccuuggagucaugguucaggcugacuccggcugcgugauuaacuggaagggucgagaauugaagugugggagcggaaucuucgugacaaacgagguacacacuuggaccgaacaauauaaauuucaggccgauucuccgaagcgccugucagcagccaucggcaaagcuugggaggagggugucugcggcgugagaagugccacgaggcucgaaaauauuauguggaagcagauaagcaacgagcugaaucauaucuuacuggaaaacgacaugaaauucacaguuguggucggggacgcaaauggaauucuugcucagggcaagaaaaugauccggccucaacccauggagcacaaguacuccuggaagucuugggggaaagccaagauuaucggagcggauauacagaacaccacuuuuaucauugacggcccagauaccccugaaugucccgacgaucagcgcgccuggaauaucugggagguggaggacuaugguuucgggauuuuuacaacuaacaucugguugaaacucagagauucguacacccagaugugcgaccacaggcugaugagcgcugcaauaaaggauuccaaagccguucaugcugacaugggauauuggauugaaucagagaagaaugaaacauggaagcuagcccgugcaaguuucaucgaggugaaaacguguauuuggccaaagucucacacccuguggagcaacggcguacucgaauccgagaugaucauacccaaaaucuacgguggcccuauuucacaacauaauuaucggccaggguacuucacucagacagcgggaccguggcaccugggcaagcuugaguuggauuuugaccugugcgaagggaccacugucgugguggaugagcacugcggaaaccgaggccccagcuuaagaacaaccacggucacugguaaaaucauucaugaaugguguugcaggucuuguacccucccuccacugcgcuuccggggggaggacggaugcugguacggcauggagaucagacccguuaaggaaaaggaggaaaaucuugugagguccaugguaagugccgguagcggcgagguggacucuuuuucccuggggauauugugucucucaauuaugaucgaagaggucaugcgcagucgauggagccggaaaaugcugaugacaggaacccuagcuguguuccugcuccugaucaugggccagcuuacuuggaacgauuugauucgucugugcaucaugguuggggccaaugcaucggacagaaugggaaugggcacaaccuauuuagcucucauggccacauuuaagaugaggccuauguucgcagugggucugcuuuuucgccggcugacuuccagagagguccuacuccugaccauuggguugucucugguggccagcguugaauuaccaaacucacucgaggaacugggagauggccuugcuaugggcauaaugaugcugaaauugcucacggaguuccaaccccaccagcuguggacaacccuacugagucuuacuuuuaucaagaccacacucucccuggacuacgcguggaaaacuauggccaugguguugucuauugucagccuguucccguuaugucucuccaccacgucacagaagacaaccuggcugccuguacuucuggggagcuuuggaugcaagccauugacuauguuccucaucacagaaaacaaaauuugggguaggaagaguuggccccugaaugagggcaucauggcaauagggaucgugucuauucuacuguccagccuucucaaaaacgauguuccucuggcuggacccuugaucgccggcgguauguuaauugccuguuaugugaucucggggucaucugcugaccugagucucgagaaggcagccgaagucuccugggaggaagaggcggaacauagcggaaccucucacaauauacugguggagguacaggaugacggcacuaugaaaauuaaggaugaggaacgagacgauacacuuaccauccuguugaaagcuacgcuacuggccgugagcggcgucuacccaauguccaucccugcaacucucuuuguuugguauuucuggcaaaagaagaaacagcgcucaggggugcugugggacacccccaguccaccggagguggaacgggccguccuugaugacggaauuuacagaauauuacagaggggucugcucggccguagccagguggggguuggaguauuccaagacggcguguuucauacaauguggcacgucacccgcggugcuguguugauguaucaggggaagcggcuggagccuucuugggcauccguuaaaaaggaucucaucucauacggaggcggcuggagauuccaggggaguuggaacacaggagaggaagugcaggucauugccguggagcccgguaaaaauccaaagaacguacaaacuacccccggcacguuuaagacaccugaaggggaggucggagcgguggcucuggacuucaaaccaggcacuagcgguucccccaucguuaauagggaagggaagauugugggacuuuacggcaacggcgucgugaccacaucugggaccuauguuucggccaucgcacaggccaaagcuagccaggagggaccucugccggagauagaagaugagguguuuaagaaacgaaauuugacuaucauggaccuacacccagguucaggcaagacccggcgcuaccugcccgccauugucagagaagcaaucaagaggaaacuccggacauuaauucuggcuccuacgcgagugguagccuccgagauggcggaagcccuuaaggggaugccaaucagauaucaaacuaccgcagugaaaagugagcauacaggacgcgagauaguugaucugaugugccacgcuaccuucacuaugaggcucuugucucccguccgugugccuaacuacaauaugauuaucauggacgaagcccauuuuacagauccggcuagcaucgcagcccggggcuauauuuccaccagaguggguaugggggaggccgcugcgaucuucaugacggcaacucccccaggaucagucgaagccuuuccucagucuaacgcuguaauacaggacgaggaaagggauauucccgagcgcagcuggaauaguggcuacgacuggaucacagauuucccaggcaagaccgugugguuuguuccuuccauuaaaagcgggaacgacaucgccaauugucugcgaaagaacggaaagagagugauacagcucucucggaaaaccuucgacacugaguaucaaaagacaaaaaacaaugauugggacuacgucgugaccacagauauuucagaaaugggugcaaacuucagggccgaccgcguuaucgauccccguagaugccugaagccagugauccuuaaagacggcccggagcgggucauucuagcugggccuaugcccgugacuguagcguccgccgcacagaggcgcggacgaaucggcagaaaucagaacaaggaaggugaucaguacguguauauggggcaaccacugaauaacgacgaggaucacgcucauuggacggaggccaagauguuguuagacaauauuaacacccccgaaggcauaaucccugcacuguuugagccagaacgggagaaaagugccgcuauugauggagaauacaggcuccgcggcgaggccagaaagacauucguugagcugaugaggcggggggaccuucccgucuggcugagcuauaaaguggcgucggaaggauuucaguacucugaucgucgcuggugcuucgacggugagcgaaauaaccaggugcucgaagagaauauggacgucgaaaucuggacuaaggagggcgagagaaaaaaguugaggccucgguggcuggaugcacgcaccuauuccgacccgcuagcccugagagaauuuaaagaguucgcugccgggaggcggagcguuucaggagaucucauccuugaaauuggcaagcugccacagcacuuaacauugcgagcucaaaacgcacuggacaaucucgugaugcugcacaacagugagcagggugggaaggccuacagacaugcuauggaagagcuucccgauaccauagagacucugaugcucuuggcccugaucgcaguauuaacgggcggagugaugcuauuuuuccugucuggcaaagggcucggaaagaccuccauuggucuucugugugucauggcgagcucagccuugcuguggauggcuaguguggaaccucacuggaucgccgcaagcauuauccucgaguuuuuccugaugguucuucucauacccgaaccagaccgccagaggacaccucaggauaaucaacuggcuuauguggucaucggcuugcuguuuaugauuuuaacuguagccgcaaacgagauggggcuacuggagaccacaaaaaaggaccucggaaucggccauguggccgcugaaaaccaccaccauguuaccaugcuugauguggaccugcggcccgcguccgccuggacuuuguacgcagucgcuacaacggugauuaccccaaugaugcgucacacuaucgagaauacaaccgccaacauaucucugaccgccauugcaaaucaggcugccauccucaugggucuggauaaaggguggccuauuagcaagauggacaucggcgucccgcuuuuagcgcugggaugcuacucccaggugaacccccucacauugacugcugccguucugaugcuaguggcacauuaugccauaaucggcccagggcugcaagcuaaggcaacgagagaagcccagaaaaggaccgcggcuggaauuaugaagaauccuacaguagauggcaucguggccauugaccucgaccccgucguuuacgaugcaaaauucgagaagcagcuuggucagaucaugcuguugauacuguguacuucacaaauucuccugaugcgcaccacaugggccuuaugcgaaucuaucacccuugcuacugggccacugacgacacucugggagggaaguccuggcaaauuuuggaacaccacuaucgccgugucgauggcaaauauuuuccgggguagcuaucuagcuggcgccgggcuggcguucuccuugaugaagucucugggaggcgggcgaagaggaaccggcgcccagggugagacacucggggaaaaguggaaaaggcagcuuaaccagcugucaaagagcgaguuuaauacuuacaaacgcuccggaaucauggaagucgaccggagugaggcaaaggaaggcuugaaaagaggugagaccacaaagcacgcugugucucguggcacggccaagcugaggugguucguagagcggaaccucgugaaacccgaagggaagguuauagauuuaggauguggccgcgggggauggagcuauuacugcgcaggccugaaaaaggugaccgaggucaaagguuauacuaaggggggaccgggccaugaagagccaauuccuauggcuacauacggcuggaaucuugugaaacugcacucagggaaggacgucuuuuucacccccccagaaaagugugauacucuacucugcgacaucggagaguccagucccaacccuacaauugaggaaggucgaacccugagaguguugaaaaugguugagccguggcugggcgggaaucaauuuuguaucaagauacucaaccccuacaugccaagcguaguggaaacgcuugagcagaugcagaggaaacacggaggcaugcugguccggaauccuuuaucucgcaacuccacccaugagauguauugggugucaugcgguacagggaauaucguuagcgccgugaacaugacuucgagaaugcuguugaacagguucaccauggcccaccgaaagcccacauacgaacgggaugucgaccucggagcgggcacucgucauguggcuguagagccugaaguggcaaaucugggcauuaucgggcagagaauugagaacaucaaaaaugaacacaagucuaccuggcacuaugaugaggacaacccauacaagacaugggccuaucauggaaguuacgagguuaaacccuccgguagcgcuucauccauggucaauggcguggugcgccuacuuaccaagccuugggaugucauuccaaugguuacucaaaucgccaugacggacacaacccccuuugggcagcagaggguguucaaagaaaagguagacacucggaccccgagagcaaaacgcggaacagcccaaauaauggaggugacggcuaaguggcugugggauuuucucucuaggaacaagaaaccucgaauuuguacccgggaagaguucaucagaaaggucaggagcaaugcggccaucggcgcaguguuuguugacgaaaaccaguggaauagugcuaaagaggccguggaggaugaacgcuucugggaccugguccaccgugagcgggaauugcauaagcaggguaaaugcgcaacuugcguguauaacaugauggggaagagagagaagaaacugggagaauuuggcaaggccaaaggcuccagggcuauuugguacauguggcucggggcccgcuuccuugaguucgaggcgcugggauuuaugaaugaagaucacugguucagccgagagaacucuuuaucagguguagaaggcgaggggcugcauaaguugggauacauacuccgggacaucaguaaaauuccaggcgguaauauguaugcagaugacacagccgggugggauaccagaaucacugaggacgaucugcagaacgaagcuaagauuacagacaucauggagcccgaacacgcccuacuugcaaccuccauauuuaaacugacauaccaaaauaagguugugaggguccagcgcccugcuaagaacggaacugugauggaugugaucagcagacgggaccagaggggcucuggccaggucgggaccuauggacucaacacguucaccaauauggagguucaacugauucgucagauggaaucggaggguaucuuuuugccaucagaguuagaaacaacuaaccuggccgagcgagugcucgacuggcuugaaaaacacggcguagagcgccugaagagaauggcuauuagcggggaugacuguguggucaaacccaucgaugaccgguucgccaccgcacuaauagcgcugaaugauaugggaaaggugaggaaagacauuccgcagugggaaccuuccaagggcuggaacgauuggcagcaaguucccuuuugcagucaucacuuccaucagcucaucaugaaggacggucgcgagaucguggucccauguagaaaucaggaugaguugguggggcgggccaggguaucucagggagcuggcuggagccugcgagaaacagccugccuuggcaaauccuacgcacaaauguggcagcugauguauuuucaccguagagaccuccgcuuagcugccaacgcaauuuguucagccguuccuguggauuggguccccacuagucggaccacguggucuauacacgcgcaucaccaguggaugacaaccgaggacaugcugagcguguggaauaggguuuggaucgaagagaacccauggauggaagacaagacucauguguccucaugggaggagguccccuacuuggggaaaagagaagaucaauggugcggaagccugauuggucucacagcucgcgccaccugggcaacuaauauccagguggccauuaaccagguacggaggcuuaucggcaaugagaacuaucuggacuacaugaccucuaugaagcgauucaaaaaugaauccgauccugagggggcucuaugguga

SEQ ID NO: 13482 - RNA, 9879 nt, Artificial Sequence
  derived and/or modified CDS sequence (opt3) from DENV-1__FJ562106__SS-prME
agcgugacaaugcugcucaugcuucugcccacagcauuggcuuuccacuuaacuacgcggggcggggagccucauaugaucgucuccaagcaggaaagaggaaagucucugcuauuuaagaccucagcugguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuucggaagcugugcauugaagcuaaaaucuccaauacgaccacagacucuagguguccaacucaaggagaggccaccuuggucgaggaacaggaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggaugucuuaugugauguguacaggauccuucaaguuggagaaggaagucgcugagacucagcacgguaccgugcugguucaggugaaauacgagggcacggaugcgccuugcaagauaccauucagcacacaagacgaaaaagggguaacccagaacggacgucucaucacugcaaaucccauugucacagauaaggagaaaccugugaacaucgaaaccgagccacccuuuggcgagucguauauaaugguuggugccggggaaaaggcucugaaacuuucuugguucaaaaagggcuccucaauuggaaaaauguuugaggccacugcacgcggcgccagaaggauggcuauccugggggacaccgccugggauuucggaaguaucgguggcguguuuacaagcgucgggaaguuggugcaucagguauucggaacggcauacggcgugcucuuuuccgguguuucuuggaccaugaaaauugggaucggcauucuguuaacuuggcugggacuaaauagccggucagcgagucucuccaugacauguauagcugucggcauggugacccuguaccuuggggugaugguccaggccgacagcggaugcguuaucaacuggaagggccgagaauugaagugugguucugggauuuucgugacaaacgaggugcacacuuggaccgaacaauauaaauuucaggcagauucaccgaagcgccugagugccgcuaucggaaaagccugggaggagggcguaugcgguaucagaagcgcaacgaggcucgaaaauauuauguggaagcagauauccaacgagcugaaucauaucuuacuggaaaacgacaugaaauucacagucgugguuggcgacgcuaaugggauucuugcccagggaaagaaaaugauccggccucaacccauggagcacaaguacucuuggaagucguggggcaaagcgaagauuaucggggccgauauacagaacaccacuuuuaucauugacggaccagauaccccugaaugucccgacgaucagcgcgcuuggaauaucugggagguggaggacuauggcuucgguauuuuuacaacuaacaucugguugaaacucagagauagcuacacccagaugugcgaccacaggcugauguccgcagccauuaaaaauucaaaagcuguccaugccgauaugggguauuggauagaaagugagaagaacgaaacauggaagcuagcacgugcgucuuucaucgaggugaaaacguguauuuggccaaagagccacacccugugguccaauggaguucucgaaucagagaugaucauacccaaaaucuacggcgguccuauuagccaacauaacuaucggccaggcuacuucacucagacagccgggccguggcaccugggaaaacuugaguuggacuuuggccugugcgaagggaccacugugguagucgaugagcacugcggaaaucgaggccccucuuuaagaacaaccacggugacugguaaaaucauucaugaaugguguugcagguccuguacccucccuccacugcgcuucagaggggaagacggaugcugguacggcauggagaucagacccgugaaggaaaaggaggaaaaccuugucaggaguaugguuagcgcugguucuggcgagguggauuccuuuucacuggggauauuguguguaaguauuaugaucgaagaggugaugcgcagccgauggucgcggaaaaugcucaugacaggaacccuggccgucuuccuacugcucaucaugggccagcugacuuggaaugaccuuauucguuugugcaucauggugggggcaaacgcuuccgacagaaugggaaugggcacaaccuaucuggccuuaauggcaacauuuaagaugaggccuauguucgccguuggucuccuguuucgccggcuuacuucuagagaggugcugcuacucaccauugggcugagcuuggucgcuucaguggaacugccaaacaguuuagaggaacucggagauggccuggcgaugggcauaaugaugcuuaaacuguugacggaguuccaaccccaccagcucuggacaacccugcuaucccugacuuuuaucaagaccacauucucucuugacuacgccuggaaaacuauggcaaugguucucagcauugugucccuguuuccguugugucugucaaccacgagccagaagacaaccugguuaccuguccuccuggggaguuucggaugcaagccacuuacuauguuucugaucacagaaaauaaaauuugggguaggaagucuuggcccuugaacgagggcaucauggcuauagggaucguauccauucuccugagcucgcuacugaaaaaugaugugccucuugccggaccccucaucgccggcgguaugcugauugcuuguuauguuaucucagggucuagugcagacuuguccuuagagaaggccgcggaagugagcugggaggaagaggcugaacauucuggaaccagccacaacauacuggucgaggugcaggaugacggcacuaugaaaauuaaggaugaggaacgagacgauacacucaccauccugcuuaaagccacgcuguuggcaguauccggcguguacccaaugucaaucccugccacucuauucgucugguauuucuggcaaaagaagaaacagcgcagugggguucugugggacacccccagcccaccggagguggaacgggcugugcucgaugacggaauuuacagaauacugcagaggggucuuuuaggccguucucaggucggggugggaguuuuucaagauggcguauuccauacaauguggcacgugacccgcggugcaguccugauguaucaggggaagcggcucgagccuuccugggccucagugaaaaaggacuugaucaguuacggaggcggcuggagauuucaggggagcuggaauacaggagaggaaguucaggugauugcggucgagcccgguaaaaacccaaagaaugugcaaacuacccccggcacguucaagacaccugaaggggagguaggagcuaucgcccuggacuuuaaaccaggcacuuccgguucucccauugucaacagggaagggaagaucgugggacucuacggcaauggcguugugaccacaucggggaccuaugucagcgcaauagcccaggcuaaagccucacaggagggaccucugccggagaucgaagaugagguguucaagaaacgaaaccuuacuauuauggaccugcacccagguuccggcaagacccggcgcuacuugcccgcaaucguuagagaagcuauuaagaggaaacuacggacacugauccucgccccuacgcgaguggucgcgagugagauggccgaagcauuaaaggggaugccaauaagauaucaaacuaccgcugugaaaucugagcauacaggacgcgagauuguagaucugaugugccacgccaccuuuacuaugaggcuucugagccccgugcguguuccuaauuacaacaugaucaucauggacgaagcucauuucacagauccggcauccauugccgcccggggcuauaucucaaccagagucgguaugggggaggcugcggcaauauuuaugacggccacucccccaggaucuguggaggcuuucccucagagcaaugccgugauucaggacgaagaaagggauauccccgagcgcaguuggaacuccggcuacgacuggauuacagauuuuccaggcaagaccgucugguucguaccuagcaucaaaucugggaaugacauagcaaacugucuccgaaagaacggaaagagagugauucaguugucacggaaaaccuucgauacugaguaucaaaagaccaagaauaacgacugggacuacguugugaccacagauaucuccgaaaugggugccaauuuuagggcugaccgcgucaucgauccccguagaugccugaagccagugauucucaaagacggcccggagcggguuauccuggcggggccuaugcccgugacugucgccagugcagcucagaggcgcggacgaauuggcagaaaccagaauaaggaaggugaucaguacguguauauggggcaaccacuuaacaaugacgaggaucacgcccauuggacggaggcaaagaugcuacuggacaacauaaauacccccgaaggcaucauuccugccuuguucgagccagaacgggagaaaagcgcugccaucgauggagaauacagguuacgcggcgaggcgagaaagacauuuguagagcugaugaggagaggggaccuccccguguggcugucguauaaaguugcaucugaaggauuccaguacuccgaucgucgcuggugcuuugacggugagcgaaacaaucagguccuugaagagaacauggauguggaaaucuggacuaaggagggcgagaggaagaagcugaggccucgguggcucgacgcccgcaccuauagcgacccguuggcucugagagaguucaaagaguuugccgcugggaggcggucagugaguggagaucuaauucuggaaauaggcaagcucccacagcaccuuacacugcgagcacaaaaugccuuagacaacuuggucaugcugcacaauucugagcagggugggaaggcuuacagacaugccauggaggaacuccccgauaccaucgagacucugaugcuucuggcacucauugcgguuuugacgggcggagugacccuguucuuuuuauccggcaaagggcuaggaaagacaagcaucggucugcucuguguaauggccucaagugcacuucuguggauggccagcguggaaccucacuggauugcagcuuccaucauauuggaguucuuucugaugguccuccugauccccgaaccagaccgccagaggacuccucaggauaaccaacuugccuaugugguuauuggccuccuguucaugaucuugaccguggcagccaacgagauggggcuguuagagacaaccaaaaaggaccuaggaauuggccaugucgcugcggaaaaucaccaccaugccacuaugcuggauguagaccuccggcccgcaucugcuuggacacuuuacgccguggccacgaccguuaucacuccaaugaugcgucacacaauagagaacaccaccgcaaauauuagccugacagcuaucgccaaccaggcggcuauuuugaugggucuggauaaaggguggccuaucuccaagauggacauaggcgugccgcuccuggcccuuggaugcuacucacaggucaaucccuuaacucugacggcagccgugcucauguuggucgcucauuaugcaaucauuggcccagggcugcaagccaaggcgaccagagaagcucagaaaaggacagccgcaggaaucaugaagaacccuacuguggauggcauuguugccaucgaccuagaucccgugguauacgacgcuaaauuugagaagcagcugggucagauaaugcuccuuauucuguguaccucucaaaucuugcugaugcgcacaaccugggcccucugcgaaaguaucacucuggcaacggggccauuaacaacccuuugggagggaucgccuggcaaauucuggaauacuaccauugcugugagcauggccaacaucuuccgggguuccuaucuggcgggcgccgggcucgcauuuucucuaaugaagucacugggaggcgggcgaagaggaacaggcgcucagggugagacuuugggggaaaaguggaaaaggcagcugaaucagcucagcaaguccgaguucaacaccuacaaacgcaguggaauaauggaagucgaccggucugaggccaaggaaggccuuaaaagaggugagacaacgaagcacgcaguuagccguggcaccgcuaagcugaggugguuuguggagcggaauuuggucaaacccgaagggaaggugauugaucugggauguggccgcgggggauggucauauuacugcgccggccucaaaaagguaacugaggugaaagguuauacaaaagggggaccgggccaugaggagccaaucccuauggccaccuacggcuggaacuuaguuaaacugcacuccgggaaggacguguucuuuacucccccagaaaagugugauacacuucugugcgacauuggagagaguagccccaauccuaccaucgaggaaggucgaacgcuaagaguccucaaaaugguggagccguggcugaggggcaaccaauucuguauaaagaucuugaaucccuacaugccaucugucguggaaacccuggagcagaugcagcggaaacacgggggaaugcucguucgcaacccucuuuccagaaauucaacacaugagauguauuggguaagcugcggcacugguaacauugugucggcggucaacaugaccucuaggaugcuguuaaaucgauuuacaauggcucaccggaagcccacuuacgaacgugauguggaccugggggcaggaaccagacauguugccguggagccugaagucgcuaacuuggauaucauuggccagcgcaucgagaauauuaaaaacgaacacaagaguacauggcacuaugacgaggauaauccauacaagaccugggccuaucauggcuccuacgaggugaaacccagcgggucagcauccucuaugguaaacggagugguuaggcuccugacuaagccuugggacgucaucccaauggugacgcaaauagccaugacagauaccacucccuucggucagcagcggguguuuaaagaaaaggucgacaccagaacaccgcgcgcuaaaaggggcacggcgcaaauuauggagguuaccgccaaguggcuauggggguuccuuagccgaaauaagaaaccucggaucuguacuagagaagaguuuacaaggaaggugcgcaguaacgcagcuaucggagccguauucguggacgaaaaucaguggaacuccgcaaaagaggccgucgaggaugaacguuuuugggaccuggugcaccgggagagagaacuccauaagcagggcaaaugcgcuaccugcguuuauaauaugauggguaagagggagaagaaacugggggaguucggaaaggccaaaggcagccgcgcgauuugguacaugugguugggcgcacgauuccuggaguuugaggcccucggguucaugaacgaagaucacugguuuucucgggaaaauucacuuaguggaguggaaggugagggccugcauaaguuaggguacauacugagagacaucuccaaaauuccaggaggcaacauguaugcugaugacacugccgguugggauacaaggaucaccgaggacgauuugcagaaugaagcaaagauuacagacaucauggagcccgaacacgcucuccuggccacuagcauauucaaacuaaccuaccaaaacaaggucgugcgcguacagagaccugcuaagaacgggacgguuauggaugugaucucucggagggaccagcguggaucgggccaggucggcaccuaugggcuuaauacauuuacuaacauggaggugcaacugauucgacagauggaaucagagggaaucuuccucccaugugagcuggaaacccccaauuuggccgagcgcguguuagauuggcuggaaaaacacggugcagagagacucaagcggauggcgauuagcggcgacgacugcgucguuaaaccgaucgaugacagguuugccacagcucuuauagcccugaacgauauggggaaggugcgcaaagacauuccucagugggaacccuccaagggauggaaugauuggcagcaaguaccauucuguagucaucacuuucaucagcuaaucaugaaggacggcagagagaucguggucccuugccggaaccaggaugagcugguggguagggcacgaguuucucagggggcuggauggagccuccgugaaacugccuguuugggcaaauccuacgcacaaauguggcagcugauguauuuccacagacgcgaccuucggcuggccgcgaaugcuauuugcucagccgugcccgucgauugggugccaaccaguaggacgacauggucuauacacgcacaucaccaguggaugaccacugaggacaugcucagcguauggaacagaguuuggaucgaagagaaucccuggauggaagauaagacacauguguccucaugggaggaggucccuuacuuaggcaaacgcgaagaccaauggugugggagccugauuggauugaccacucgggccaccugggcuacaaacauccagguggccauuaaucagguuaggcgacugaucgguaacgagaauuaucucgacuacaugacgucuaugaagagauuuaaaaacgaauccgauccagagggcgcacuuugguga

SEQ ID NO: 13483 - RNA, 9879 nt, Artificial Sequence
  derived and/or modified CDS sequence (opt3) from DENV-1__FJ410179__SS-prME
agcgugaccaugcugcucaugcuucugcccaccgccuuggcuuuccacuuaacuacgagaggaggggagccucauaugaucgucuccaagcaggaaaggggaaaaucucuguuguuuaagaccucagcagguauuaacaugugcacacucauagccauggaccugggcgagcuuugugaagauacuaugaccuacaaaugcccacggaucacagaggcggaaccggacgauguugacuguuggugcaaugcuaccgauacuugggugacauaugggaccuguagucagacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcacuguuucucgcccaugcuaucggcaccucgauuacgcagaagggcaucauauucaucuuacugaugcuuguuacuccaucaauggccaugcggugcguggggauuggaaaccgcgauuuugucgaggguuugagcggcgcgacauggguggacguuguucuggagcacgggaguugugugaccacuauggcaaaagauaagcccacacuagacaucgaacuccugaaaaccgaggucacgaauccugccgugcuuagaaagcugugcauugaagcuaaaaucuccaacaccacaacugauucuagguguccaacccaaggagaggccacauugguggaagaacaggacagcaauuucgucugccggcgcacuuuuguugaucgaggcugggguaacggguguggacucuucggcaagggcucccuguuaaccugcgcaaaguuuaaaugcgugacaaagcuggaggggaaaauaguacaguacgaaaaucucaaguauucagugauugucaccgugcacacuggagaccagcaucaaguugguaacgagacgacagaacacggcaccaucgcuacuauuacaccccaggccccuacaagugagauccagcuuaccgacuacggggcgcugacuuuggauuguagcccaagaacaggacuagacuucaaugaaauggugcugcucacgaugaaagagaagucuuggcugguccauaaacagugguuucuugaucugccguugcccuggaccuccggcgccucaacuagccaagagacauggaacaggcaggaccuccuggugaccuucaagacagcacacgcuaagaaacaggaaguaguuguguuagguagucaagagggggccaugcacacugcucugaccggcgccacggaaauccagaccucuggaacaacuaccauuuuugcaggccaucuaaagugccggcucaaaauggauaagcugacacuuaaagggauguccuaugucauguguacuggcagcuucaaguuggagaaggaaguggccgagacccagcacgguacgguccuggugcagguuaaauacgagggcacagacgcuccuugcaagauaccauucucggcgcaagaugaaaaaggggugacccagaauggacgucucaucacugcaaaccccauuguaacagacaaggagaaaccugucaauaucgaaaccgagccacccuuuggcgagucuuauauagugguuggugccggggaaaaggcucugaaacuuuccugguucaaaaagggcucaaguauuggaaaaauguuugaggccacugcacgcggcgccagaaggauggcuauccugggggauaccgccugggacuucggaagcaucgguggcguguuuacauccgucgggaaguuggugcaucagguauucggagcagcguacggcgugcucuuuucugguguuagcuggacgaugaaaauugggaucggcauucuguuaaccuggcugggacuaaacucacggaguacuucccucagcaugacauguauagcugucggcauggugacccuguaccuuggggugaugguccaggccgauucuggaugcguuaucaauuggaagggccgagaauugaagugugguucagggauuuucgugacaaacgaggugcacacuuggaccgaacaauauaaauuucaggcagacaguccgaagcgccugagcgccgcuaucggaaaagccugggaggagggcguaugcgguaucagauccgcaacgaggcucgaaaacauuauguggaagcagauaucuaaugagcugaaccauaucuuacuggaaaaugacaugaaauucacagucgugguuggcgaugcuaacgggauucuugcccagggaaagaaaaugauccggccucaacccauggagcaccgcuacucguggaaaagcuggggcaaggcgaagauuaucggggccgacauacaaaauuccaccuuuaucauugauggaccagacacuccugaaugucccgaugaccagagagcuuggaacaucugggagguggaggauuauggcuucgguauuuuuaccacaaauaucugguugaagcucagggacucauacacucagaugugcgaucaccgucugaugagugcagccauaaaagacucuaaggcuguccaugccgauaugggguauuggauugaaagcgagaaaaacgaaaccuggaagcuagcacgggcguccuucaucgaggugaagacauguauuuggccaaaaucacacacgcuguggagcaauggaguucucgaaucugagaugaucauacccaagauguacggcgguccuaucucccaacauaacuaucgaccaggcuacuucacccagacugccgggccguggcaccugggaaaacuugaguuggacuuugaucugugcgaaggcacaaccgugguagucgacgagcacugcgggaauagaggacccaguuuaaggacuacaaccgugacgggcaagauuauccaugaaugguguugccgcagcuguacucucccuccacugcgguucagaggugaggacgggugcugguacggaauggagauuaggcccgugaaagaaaaggaggaaaaccuuguccgcucuaugguuuccgcuggcucaggugagguggauaguuuuagccugggcaucuuguguguaucgauaaugauugaagaggugaugcgaucccgguggucucguaagaugcucaugaccgggacacuggccgucuuccuacugcucaucaugggacagcugaccuggaaugaccuuaucagauugugcauuauggugggcgcaaacgcuagcgauaggauggggaugggaacuacauaucuggccuuaauggcaaccuuuaaaaugcgcccuauguucgccguuggccuccuguuucggagacuuacaucaagggaggugcugcuacucacuaucggucugaguuuggucgcuuccguggaacugccaaauucuuuagaggaacucggggacggacuggcgaugggcauuaugaugcuuaagcuguugaccgaguuccaaccccaccagcucuggacgacacugcuaagccugaccuuuauaaaaacuacccuuucccucgauuacgccuggcgaacaauggcaaugguucugucaaucgugagcuuguucccgcuguguuuaaguacuaccucucagaagacgacauggcucccuguccugcuuggcuccuuugggugcaaaccacugaccauguucuugauuacugaaaacaagaucuggggacgcaagagcuggccccucaacgaggguauuauggcuaucggcauaguaucgauccugcuaucaucucugcuuaaaaaugacgugccucucgccgggccccugauugccggaggcauguugaucgcuuguuauguuauuagugguuccagcgcagauuuaucucuggagaaggccgcggaagugagcugggaggaagaggcugaacauuccgggacaucacacaacauccucgucgaggugcaggacgauggaaccaugaaaauaaaggacgaggaacgggaugacacucugacaauucuucugaaagccaccuugcuagcaaucaguggcguauacccaaugagcaucccugccacgcuguuugugugguauuucuggcaaaagaaaaagcagagaucuggcguccucugggauacucccuccccaccggagguugaaagggcugugcuggacgacgggauuuaccguauacuucagcgcggauuacugggucggucacaggugggcgucgggguguuccaagauggaguuuuucauaccauguggcacguaacaagaggcgcagugcucauguaucaggguaagagguuggagccuaguugggccagcgucaaaaaggaccugaucuccuacgggggaggcuggcgauuccagggcucuuggaauaccggggaggaagugcagguuauugcgguggagcccggcaagaacccaaagaauguccaaacaacucccgguaccuuuaaaacgccugaaggcgaggugggggcuaucgcccucgauuucaagccaggaacaucgggcagccccauuguaaaccgggaagguaagaucgucgggcuguacggaaauggcgugguuacuaccucaggcacauauguguccgcaauagcccaggcuaaaaccagucaggaggggccucuuccggagaucgaagaggaagucuuuaagaaacgcaaccugacuauuauggacuugcacccaggaucugguaagaccagaagguaccuacccgccaucgugcgggaggcaauuaaacgaaagcugagaacacucaucuuagcuccuacgcgcguuguggccagcgaaauggcggaggcccugaagggcaugccaauaagguaucaaacuaccgcagucaaauccgagcauacagggcgugaaauuguggaucuuaugugccacgcuaccuucacuaugcggcugcucucacccguaagagugccuaauuacaacaugaucaucauggacgaggcccauuuuacagauccggcuucuauugcagccaggggauauaucagcacccgcguuggcaugggugaagccgcugcgauauucaugacggcaacucccccagggagugucgaggccuuuccucaguccaaugcugugauucaggacgaagaacgagauauccccgagagaagcuggaacucuggauacgacuggauuacagauuucccaggcaagaccgugugguuugucccuucaaucaaauccggcaaugacauagccaacuguuugcggaagaaugggaaaaggguaauucagcugagucgcaagaccuucgacacugaauaucaaaagacacguaacaacgauugggacuacgugguuaccacagauaucagcgagaugggagcaaauuucagagccgaccgggugaucgaucccaggcgcugccucaaaccagucauucugaaggacgguccggaacgagugauccuugcuggcccuaugcccguuacuguggcgucggccgcacagagacgggggaggauuggacgcaaccagaauaaagagggcgaucaguacgucuauaugggucaaccacuaaacaaugacgaggaucacgcucauuggacggaagccaagaugcuguuggacaacauaaauacccccgaggggaucauuccugcauuauuugaaccagagagagaaaaaucugccgcuaucgauggcgaguacaggcugcggggagaggcccguaagacauucguggaacucaugcgccgaggcgaccugcccguauggcuuuccuauaagguggcgagcgagggguuucaguacucagauagaagguggugcuucgacggagaacggaacaaucagguucuggaggaaaacauggacgucgagaucuggacuaaagagggugaacgcaagaaacucagaccuaggugguuggaugcacggaccuauagugacccgcuggcccuacgagaguuuaaggaguucgcugccggcagacgcucuguguccggggaucugauucucgagauaggaaaacuuccacagcaccugacauuaagggcucaaaaugcauuggacaaccuggugaugcuccacaauagcgaacagggcgguaaggccuaccggcaugcuauggaggagcugcccgauaccaucgaaacucuuaugcugcucgccuugauugcaguccugaccgggggaguuacguuauuuuuccuaucaggaaaaggccuggggaagacaaguaucggacuccuuugugugauggcgagcuccgcccuguuguggauggcuaacguagagccucacuggauugccgcaucuaucauacuggaauuuuuccucauggugcugcuuauccccgagccagaccgucagagaacuccucaggauaaucaacucgcuuaugucgugauuggucuguuguuuaugauccugaccguugccgcaaacgagaugggcuuacuagaaacaaccaagaaagaccuggggauuggacauguggccgcugagaaccagcaccacgcgacuaugcucgaugucgaccuuaggcccgccagcgcauggacacuguacgcuguagccacgaccgugaucacuccaaugaugcgccauacaauagaaaauaccaccgccaacauuuccuugacagcaaucgcuaaucaggccgcgauucugaugggccucgauaaggguuggccuaucucaaaaauggacauagggguuccgcugcuugcuuuaggcugcuacucucaagugaacccccugacucucacggccgcagucuugaugcugguggcccacuaugcuaucauuggaccaggccuacaggcaaaggccacccgggaggcgcagaaacgaacagcugccgggaucaugaagaauccuacugucgauggaauuguggcaaucgaccuggaccccguuguguacgaugccaaguucgaaaaacagcucggccaaauaaugcuucugauuuuguguaccagucagauccugcucaugagaacaaccugggcucugugcgagucgaucacuuuagccacggguccacuuacaacccugugggaggggagcccuggaaaguuuuggaacacuaccauugcaguauccauggcuaauaucuucaggggcucuuaucucgccggugcgggccuagccuucucacugaugaaaagccuagggggaggccgccgggggacaggagcacagggcgaaacucugggugagaaguggaagagacagcucaaccaacuuuccaagagugaauuuaauaccuacaagcguucugggauaauggagguggacaggagcgaagcuaaagagggacugaagcggggcgagacaacgaaacaugccgucucacgcgguaccgcaaaguugcgaugguucguugaaagaaaccuggugaaacccgagggcaaggucauugaucucggguguggaaggggcgggugguccuauuacugcgcuggauuaaagaaagugacugaaguaaagggcuauacaaaaggugggccgggacacgaggaaccaaucccuauggccaccuacggcuggaaucuggugaaacuuuacaguggcaaagacguauuuuucacucccccagagaagugugauacacugcuaugcgacauuggggagagcucucccaacccuaccaucgaagagggacggacgcuccgcgugcugaaaauggucgaaccgugguugagagguaaucaguuuuguauaaagauccugaaccccuauaugccauccguggucgagacccucgagcagaugcagaggaagcauggcgggaugcuugugcgaaauccucugucacggaacagcacacacgaaauguacuggguuucgugcggaacuggcaauauuguaucugccgugaacaugaccagucguauguuacugaacagauucacaaugacucaccgcaaacccaccuaugagagggaugucgacuugggugcggggacacggcauguggcuguugaaccugagguggcaaaucucgauaucauuggacaaagaaucgaaaacauuaagaaugagcacaaauccaccuggcauuacgacgaggauaacccauauaagacuugggccuaccacggcagcuaugaagucaaacccucaggcuccgcuucuagcauggugaaugggguagugcgccugcuaacgaagccuugggacguuaucccaauggucacacagauagccaugaccgacacuacccccuuuggacagcaaaggguguucaaggagaaaguggauacacgaacgccgcgggcaaagagagguaccgcccagauuauggaagucacugcuaaauggcuuuggggcuuucugaguaggaacaagaaaccucgcaucuguacacgugaggaguucacccggaagguuagauccaaugcggccaucggggcaguguuuguagacgagaaccaguggaauagcgcuaaggaggccguggaagaugagagguucugggaccucguccaccgcgaacgagagcugcauaaacagggaaagugcgcaacuugcguguacaacaugaugggcaaacgggaaaagaaauugggugaguuugggaaggccaagggaucuagagcuauuugguacauguggcugggcgccagguuccucgaguucgaagcgcuuggcuuuaugaaugaggaucacugguucucacgcgaaaacaguuuuuccgggguugagggagagggucugcauaaauuaggcuauauacugagagacaucagcaagauuccagggggaaauauguacgcagaugacacagccggcugggauacccggaucacagaagacgauuugcaaaacgaggcuaaaauuacugacaucauggaacccgagcacgcccuccuggcaaccucuauauucaagcuaacguaucagaauaaaguggucagggugcagcguccugcuaagaacgguaccguaauggauguuaucucgcgacgcgaccagagagggucaggacaagugggcacauacggccuuaacacuuuuaccaauauggaaguccagcugauucggcagauggagagcgaggggaucuuccucccauccgaacuggagacacccaacuuggccgaaaggguguuagacuggcuggagaaacauggaacugaacgccucaagagaauggcuauuaguggugaugacuguguggucaagccgguugaugaccgguuugccaccgcacuuaucgcgcugaaugauaugggcaaagugaggaaggacauaccucagugggagcccucuaaaggguggaacgauuggcaacagguaccauucugcagccaccacuuucaucagcuaauuaugaaggacggacgagagaucguggucccuugucguaaucaggaugaacuggugggcagagcccgcguuucccaaggugcuggguggucacuccgggagacggccugcuugggaaaaaguuaugcacagauguggcagcugauguacuuccacaggagagaccuucgccuggcugccaacgcaaucuguucugccgugcccgucgauugggugccaacaagccggaccacuugguccauucaugcgcaccaccaauggaugacaaccgaagacaugcucucaguauggaauaggguuuggauagaggaaaaccccuggauggaggacaagacucaugugagcucuugggaggaagucccuuauuuaggcaagcgagaggaucaguggugcggcucccugaucggguugaccgcuagagccacaugggcaacgaauauucagguggccaucaaccagguucggaggcugauuggaaaugaaaacuaccucgacuacaugaccaguaugaaacgcuuuaagaaugagagcgauccagagggugcucuuugguga

SEQ ID NO: 13484 - RNA, 9879 nt, Artificial Sequence
  derived and/or modified CDS sequence (opt3) from DENV-1__FJ410181__SS-prME
agcgugaccaugcugcucaugcuucugcccaccgccuuggcuuuccacuuaacuacgagaggaggggagccucauaugaucgucuccaagcaggaaaggggaaaaucucuguuauuuaagaccucaguugguauuaacaugugcacacucauagcaauggaccugggagagcuuugugaagauacuaugaccuacaaaugcccacggaucacagaggccgaaccggacgauguggacuguuggugcaaugcgaccgauacuuggguaacauaugggaccuguagucaaacgggagagcaccgccgagacaagcguagcguggcucuggcaccccaugucggcuugggucucgagacuagaaccgaaacauggauguccucugagggggcauggaaacagauucagaagguggaaacuugggcccugaggcacccuggauucaccguuacagcucuguuucucgcacaugccaucggcaccucgauuacgcagaagggcaucauauucaucuuacugaugcuugugacuccaucaauggcuaugcggugcgucgggauuggaaaccgcgauuuuguggaggguuugagcggcgccacauggguagacguugugcuggagcacgggaguugugucaccacuauggcgaaagauaagcccacauuggacaucgaacuccugaaaaccgaggugacgaauccugcagugcuuagaaagcugugcauugaagccaaaaucuccaacaccacaacugauucuagguguccaacccaaggagaggcuacauuggucgaggaacaggacagcaauuucguuugccggcgcacuuuuguggaucgaggcugggguaacggguguggacucuucggcaagggcucccuguuaaccugcgccaaguuuaaaugcguaacaaagcuggaggggaaaauagugcaguacgaaaaucucaaguauucagucauugugaccguucacacuggagaccagcaucaaguggguaacgagacgacagaacacggcaccaucgcaacuauuacaccccaggcuccuacaagugagauccagcuuaccgacuacggggcccugacuuuggauuguagcccaagaacaggacuagacuucaaugaaaugguccugcucacgaugaaagagaagucuuggcuggugcauaaacagugguuucuugaucugccguugcccuggaccuccggcgcgucaacuagccaagagacauggaacaggcaggaccuccugguaaccuucaagacagcccacgcaaagaaacaggaaguuguggucuuagguagucaagagggggcuaugcacacugcccugaccggcgcuacggaaauccagaccucuggaacaacuaccauuuuugccggccaucuaaagugccggcucaaaauggauaagcugacacuuaaagggauguccuaugugauguguacuggcagcuucaaguuggagaaggaagucgcagagacccagcacgguacggugcugguucaggugaaauacgagggcacagacgccccuugcaagauaccauucucggcucaagaugaaaaagggguaacccagaauggacgucucaucacugcgaaccccauugucacagacaaggagaaaccugugaauaucgaaaccgagccacccuuuggcgagucuuauauaguuauuggugcaggggaaaaggcccugaaacuuuccugguucaaaaagggcucaaguaucggaaaaauguuugaggcuacugcccgcggcgcaagaaggauggccauccugggggauaccgcuugggacuucggaagcauugguggcguguuuacauccgucgggaaguuggugcaucagguauucggagccgcauacggcgugcucuuuucugguguuagcuggacgaugaaaaucgggauuggcauacuguuaaccuggcugggacuaaacucacggaguacuucccucagcaugacauguaucgcggucggcauggugacccuguaccuuggggugaugguccaggcugauucuggaugcguuauuaauuggaagggccgagaauugaagugugguucagggaucuucgugacaaacgaggugcacacuuggaccgaacaauauaaauuucaggccgacaguccgaagcgccugagcgcagccaucggaaaggcuugggaggagggcguaugcgguauuagauccgccacgaggcucgaaaacauaauguggaagcagaucucuaaugagcugaaccauauuuuacuggaaaaugacaugaaauucacagucgugguuggcgaugcaaacgggauccuugcucagggaaagaaaaugauucggccucaacccauggagcaccgcuacucguggaaaagcuggggcaaggccaaaaucauaggggcggacauccagaauaccacuuuuauuaucgauggaccagacaccccugaaugucccgaugaccagagagccuggaacauuugggagguggaggauuauggcuucgguaucuuuacaacuaauauaugguugaagcucagggacuccuacacccagaugugcgaucaccgucugaugucagcugcaauuaaagacaguaaggccguccaugcugauaugggguauuggaucgaaucugagaaaaacgaaacauggaagcuagcccgggccagcuucauugaggugaagacguguaucuggccaaaaucccacacccuguggucaaauggaguucucgaaagcgagaugauaauccccaagauuuacggcgguccuaucucucaacauaacuaucgaccaggcuacuucacucagacagcggggccguggcaccugggaaaacuugaguuggacuuugaucugugcgaaggcaccacugugguagucgacgagcacugcgggaauagaggacccuccuuaaggacaaccacggugacuggcaagauuauccaugaaugguguugccgcaguuguacccucccuccacugcgguucagaggugaggacgggugcugguacggaauggagauaaggcccgugaaagaaaaggaggaaaaccuuguccgcagcaugguuucugccggcuccggugagguggauucauuuagucugggcauuuuguguguaagcaucaugaucgaagaggugaugcgaucgcgguggucccguaagaugcucaugacagggacccuggcugucuuccuacugcucauuaugggacagcugacuuggaaugaccuuaucagauugugcauuauggugggcgccaacgcaucugauaggauggggaugggaacaaccuaucuggcuuuaauggccacauuuaaaaugcgcccuauguucgcaguuggccuccuguuucggagacuuacuagcagggaggugcugcuacucaccauaggucugucauuggucgccaguguggaacugccaaauuccuuagaggaacucggggacggacuggcuaugggcaucaugaugcuuaagcuguugacggaguuccaaccccaccagcucuggacaacccugcuaucucugacuuuuauuaaaaccacacuuagccucgauuacgcguggcgaacuauggccaugguucuguccaucgugucauuguucccgcuguguuuaagcaccacgagucagaagacaaccuggcucccuguccugcuuggcucuuuugggugcaaaccacugacuauguucuugauuacagaaaacaagaucuggggacgcaaguccuggccccucaacgaggguauaauggcaaucggcauuguaagcauccugcuaucgucacugcuuaaaaaugacgugccucucgcugggccccugauugccggaggcauguugaucgccuguuauguuauaucugguaguuccgcugauuuaagccuggagaaggcagccgaagugucuugggaggaagaggcggaacauagcgggaccucccacaacauucucgucgaggugcaggacgauggaacuaugaaaaucaaggacgaggaacgggaugacacacugaccauccuucugaaagcuacguugcuagccguaucaggcguguacccaaugaguauuccugcaacucuguuugucugguauuucuggcaaaagaaaaagcagagaagcggcguucucugggauacccccucuccaccggagguggaaagggccgugcuggacgacgggauauaccguauccuucagcgcggauuacugggucggucccaggucggcguggggguuuuccaagauggaguauuucauacaauguggcacgugaccagaggcgcuguccucauguaucaggguaagagguuggagccuucaugggcaagugugaaaaaggaccugauuagcuacgggggaggcuggcgauuccagggcuccuggaauacaggggaggaaguucaggugaucgccgucgagcccggcaagaauccaaagaaugugcaaacuacccccgguacguuuaaaacaccugaaggcgagguaggggcgauugcucucgauuucaagccaggaacuucuggcucgcccaucgucaaccgggaagguaagauaguggggcuguacggaaauggcguugugaccacaagcggcaccuaugucucagccaucgcacaggccaaaacuucccaggaggggccucuuccggagauugaagacgagguguuuaagaaacgcaaccugaccaucauggauuugcacccaggaagugguaagacaagaagguaccuacccgcuauuguucgggaagccaucaaacgaaagcugagaacgcucauauuagcaccuacucgcguggucgcuucugagauggccgaagcgcugaagggcaugccaauuagguaucaaaccacagccgugaaaagcgagcauaccgggcgugagaucguagaccuuaugugccacgcaacuuucacaaugcggcugcucucccccgugagaguuccuaauuacaacaugaucauuauggaugaagcucauuuuaccgacccggccucaaucgcugcaaggggauauauaucuacgcgcgucggcaugggugaggccgccgcuauuuucaugacugcgacacccccagggagcguggaagcauuuccucagaguaaugccgugauccaggaugaggaacgagacauucccgagagauccuggaacagcggauacgauuggaucaccgacuucccaggcaagaccgucugguuuguaccuucuauaaaaucaggcaaugacauugcuaacuguuugcggaagaaugggaaaagggugauccagcugucccgcaagacuuucgauacagaguaucaaaagaccaaaaacaacgacugggauuacguugugacaacugacaucagugaaaugggagccaauuuccgugcagauagagucauugacccccggaggugccucaagccagugauccugaaagaugguccggagcgcguuauucuugccggcccuaugcccgugacggucgcuagcgcggcccagcgaagagggcggauaggaaggaaccagaauaaggaaggcgaccaguacguguauaugggucaaccacuaaacaaugaugaggaccacgcacauuggaccgaggcuaaaaugcuguuggauaacaucaauacacccgaagggauuaucccugccuuauuugagccagaacgcgagaagucggcagccaucgacggcgaauacagacugaggggagaggcucggaagacuuucguagagcucaugcgucgcggcgaucugcccguguggcuuucuuauaaaguugccuccgaaggguuucaguacagcgaccgaagauggugcuucgacggagagaggaacaaucagguccuggaagagaacauggauguggaaauuuggaccaaggagggugagcggaaaaagcuccgcccuagaugguuggacgcgaggacauauucagauccgcuggcacuacgggaauuuaaagaguucgccgcuggccgaagaagugugucuggggaccugauacucgaaaucggaaaacuuccacagcaccugaccuuacgcgcccaaaaugcuuuggauaaccuggucaugcuccacaauuccgagcagggcgguaaagcauacaggcaugccauggaggaacugcccgacacuauugagacgcuuaugcugcucgcuuugaucgccguucugaccgggggcgugacauuauuuuuccuaagcggaaagggccuggggaagacuucaauuggacuccuuuguguaauggcaaguagcgcgcuguuguggauggccaacguggaaccucacuggaucgcugccuccauaauccuggaguuuuuccucaugguccugcuuauucccgaaccagaucggcagcguaccccucaggacaaucaacucgcauaugugguuaucggucuguuguuuaugauucugacaguggcugccaacgagaugggcuuacuagagaccacuaaaaaggaucuggggaucggacaugucgcagccgaaaaccagcaccacgcuacaaugcucgacguagaucuuagacccgcgucugccuggacgcuguacgcaguggcuaccacuguuauaacaccaaugaugaggcauaccauugagaauaccacagccaacaucagcuugacugccauugcaaaucaggcugccauccugaugggccucgacaaagguuggccuauauccaagauggauaucggggugccgcugcuugcguuaggcugcuacucacaagucaacccccugacgcucaccgcugccguguugaugcuggucgcacacuaugccauuaucggaccaggccuacaggcuaaagcaacacgcgaagcccagaagcggacugcggcugggauuaugaagaauccuaccguggacggaaucguugccauagaccuggaucccgugguauacgacgcaaaauucgagaagcagcucggccaaauuaugcuucugaucuuguguacaucucagauccugcucaugcgaaccacuugggcccugugcgaaaguauuacguuagcuacagguccacuuaccacucugugggaggggucgccuggaaaauuuuggaacaccacaaucgccgugagcauggcaaauauauucagaggcuccuaucucgcuggugccggccuagcguucucucugaugaagucacuagggggaggcaggcgcgggacuggagcccagggcgagacccugggugaaaaauggaagcggcagcucaaccaacuuagcaaguccgaguuuaauacauacaaaagaagugggauuauggaagucgaucguucugaggcaaaggaaggacugaaaaggggcgagacgaccaagcaugcuguuagccgggguacugccaaauugcgcugguucguggagcgaaaccuggucaagcccgaaggcaaggugaucgaccucggguguggaagaggcggguggucauauuacugcgcaggacuaaagaagguaacagaggugaaaggcuauaccaagggugggccgggacacgaggaaccaauuccuauggcuacuuacggcuggaaucugguuaaacuuuacuccggcaaggauguguuuuucacacccccagaaaaaugugacacccugcuaugcgauaucggggagaguagccccaacccuacgauagaggaaggaaggacccuccggguccugaagaugguggagccgugguugcgcgguaaucaguuuuguaucaagauucugaaccccuauaugccaucugucguggaaacacucgagcagaugcagagaaaacauggcgggaugcuuguuaggaauccucugucccgaaacucaacucacgagauguacuggguaagcugcggaaccggcaauaucgugucggccgucaacaugacaucucggauguuacugaaccguuucacuauggcccacagaaagcccaccuaugaacgcgacguggauuugggugcggggacaaggcauguugcuguggagccugaagucgcaaaucucgacauuaucggacaacggauugagaacaucaaaaaugaacacaagaguaccuggcauuacgaugaggacaacccauauaaaacuugggccuaccacggcuccuaugaggugaagcccagcggcucagcuuccucuaugguaaauggggugguuagacugcuaacgaagccuugggacgucauaccaauggugacacagauugccaugaccgauacuacccccuuuggacagcaacgcguguucaaagaaaaggucgacacaaggacgccgcgagcaaaacgggguaccgcccagaucauggagguuacugcuaaguggcuuuggggcuuucugagcagaaacaaaaagccuaggaucuguacacgcgaagaguucacccguaaggugcggaguaaugcggccauuggggcaguauuuguggaugaaaaccaguggaacuccgcuaaagaggccgucgaggacgaaagauucugggaucucguguacagggagcgcgaacugcacaagcagggaaaaugcgcaacuugcguuuacaacaugaugggcaagcgagagaaaaaguugggugaauuugggaaggccaaaggaagccgggcuauaugguauauguggcugggcgccagauuccucgaguucgaggcgcuuggcuuuaugaaugaagaccauugguucucuagggagaacucauuuagugggguggaaggagagggucugcacaaguuaggcuacauccugcgcgauauuuccaaaaucccagggggaaauauguaugcagacgauacagccggcugggacaccagaauuacagaggaugacuugcaaaacgaagcuaagaucacugauauaauggagcccgaacaugcccuccuggcaaccagcaucuucaaacuaacguaccagaauaaggucgugcggguacagaggccugcuaaaaacgguaccguuauggacgugauuucucgucgagaccagcgcgggucgggacaagucggcacauauggccuuaacacuuuuaccaauauggaggugcagcugaucagacagauggaaucagaggggauuuuccucccaagcgagcuggaaacacccaacuuggccgagcggguguuagauuggcuggaaaagcacggaacugagaggcucaagcgcauggcuaucuccggugacgauugugucguuaaaccgguggacgauagauuugccaccgcacuuauagcgcugaaugacaugggcaagguacggaaagauauuccucagugggaacccaguaagggguggaacgacuggcaacaggugccauucugcucucaucacuuucaccagcuaaucaugaaagauggaagggagaucgucgugccuugucgaaaucaggacgagcugguuggccgugccagagugagccaaggugcuggguggucccuccgcgaaacggccugcuugggaaagucauacgcacagauguggcagcugauguauuuccaucggagggaucuuagacuggcugccaacgcaauuuguagugccguccccguggacuggguaccaacaucucgcaccacuuggagcauacacgcgcaucaccaauggaugacaaccgaggacaugcucuccguuuggaaucggguguggaucgaagagaaccccuggauggaagauaagacucacgucucaagcugggaggaggugccuuacuuaggcaaaagggaagaccaguggugcggcucucugauuggguugaccgcucgagccacaugggcaacgaauauccagguugccauuaaccaggugagacggcugaucggaaaugagaacuaccucgauuauaugaccuccaugaagagguuuaaaaaugaaagugacccagagggugcucuuugguga

SEQ ID NO: 13485 - RNA, 9879 nt, Artificial Sequence
  derived and/or modified CDS sequence (opt3) from DENV-1__FJ547086__SS-prME
agcgugaccaugcugcucaugcuucugcccacagcauuggcuuuccacuuaacuacgagaggcggggaaccucauaugaucgucuccaagcaggaaagaggaaaaucucugcuguuuaagaccucagccgguguuaauaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcauuuuuccuggcccaugcuaucggcacaucgauuacccagaagggcaucauauuuauccucuuaaugcuggugacgccaucaauggccaugcggugcgucgggauuggaaaccgcgauuucguggagggucuuagcggcgcgacuuggguagacguuguguuggagcacgggaguugugucacaaccauggccaagaauaagcccacucuggauaucgaacuacucaaaacagaggugaccaacccugccgugcugagaaaacuuugcauugaagcuaaaaucuccaauacgaccacagacucuagguguccaacucaaggagaggccacccuggucgaagaacaggaugcaaacuuuguuugccggcgcacauucguggaccgaggcugggguaauggguguggauuguuuggcaagggcagccuccugacuugcgcuaaguucaaaugcguaaccaaguuagaggggaaaauagugcaguacgaaaaccugaaguauuccgucauugugacaguucacaccggagaucagcaucaaguggguaaugagacuacggaacacggcacaaucgccaccauuacuccccaggcgccuaccucagagauccagcucacagacuacggggcccuuacccuggacuguaguccaagaacuggauuggauuuuaacgaaaugguccuacugacaaugaaagaaaagagcuggcucgugcauaaacagugguuccuggaccuuccgcugcccuggacgucuggcgcauccaccucacaagagacuuggaauaggcaggauuugcucguaacauuuaagaccgcucacgccaagaaacaggaaguugugguccuggguagccaagagggggcuaugcacacagccuuaacuggcgcaaccgaaauccagacgaguggaaccacaacuauuuucgccggccaucugaagugccggcuaaaaauggacaagcucacccugaaagggaugucuuaugugauguguacaggauccuucaaacuugagaaggaagucgcugagacucagcacgguaccguguugguucaggugaaauacgagggcacggaugcgccuugcaagauaccauuuagcacacaagacgaaaaagggguaacccagaacggacgucugaucacugcaaaucccauugucacagauaaggagaaaccugugaacaucgaaaccgagccacccuucggcgagucguauauaaugguuggugccggggaaaaggcucucaagcugucuugguuuaaaaagggcuccucaauuggaaaaauguucgaggccacugcacgcggcgccagaaggauggcuauccuuggggacaccgccugggauuuuggaaguaucgguggcguguucacaagcgucgggaagcuggugcaucagguauuuggaacggcauacggcguguuguucuccgguguuucuuggaccaugaaaauugggaucggcauucuccugacuugguuaggacugaauagccggucagcgagucuauccaugacauguauagcugucggcauggugacccucuaccugggggugaugguccaggccgacagcggaugcgcaaucaacuggaagggccgagaacuuaagugugguucugggauuuuuguuacaaacgaggugcacacuuggaccgaacaauauaaauuccaggccgauucaccgaagcgcuugagugcugccaucggaaaagcaugggaggagggcgugugcgguaucagaagcgcuacgaggcuggaaaauauuauguggaagcagauauccaacgagcucaaucauauccuguuagaaaacgacaugaaauuuacaguagucgugggcgacgccaaugggauucuggcgcagggaaagaaaaugauccggccucaacccauggagcacaaguacucuuggaagucguggggcaaagccaagauuaucggggcugauauacagaacaccacuuucaucauugacggaccagauaccccugaaugucccgacgaucagcgcgcauggaauaucugggagguugaggacuauggcuuugguauuuucacaacuaacaucuggcuuaaauugagagauagcuacacccagaugugcgaccacaggcucauguccgccgcuauaaaggauucaaaagccgugcaugcagacaugggguauuggauugaaagugagaagaaugaaacauggaagcuggcgcgugccucuuucaucgaggucaaaacguguauuuggccaaagagccacacccuaugguccaacggagugcuggaaucagagaugaucauacccaaaaucuacggcgguccuauuagccaacauaauuaucggccaggcuacuuuacucagacagcugggccguggcaccucggaaagcuggagcuugauuucgacuugugcgaaggcaccacuguugugguagaugagcacugcgggaaccgaggacccucucugagaacaaccacggucacuggcaaaaucauucaugaaugguguugcagguccuguaccuuaccuccacuccgcuuucggggugaggacgggugcugguacggaauggagaucagacccgugaaggaaaaggaggaaaaucuggugaggaguauggucagcgccggcucuggugagguugacuccuucucacuuggcauacugugugugaguauuaugaucgaagagguaaugcgcagccgauggucgcggaaaauguugaugacagggacccucgcaguguuucugcuacugaucaugggacagcucacuuggaacgaucugauucgucuuugcaucauggucggcgcuaaugccuccgacagaauggggaugggaacaaccuauuuggcacugauggccacauucaagaugaggccuauguuugcugugggcuuacucuuccgccggcugacuucuagagagguucuucugcuaaccauuggucucagccugguggcgucagucgaauugccaaacagucuggaggaauuaggggauggacucgccaugggcauaaugaugcugaaacuucugacggaguuucaaccccaccaguuguggacaacccuccugucccuaacuuucaucaagaccacacugucucuugacuacgcauggaaaacuauggcuauggugcucagcauuguuucccuguuuccguugugucugucaaccacgagccagaagacaaccugguuaccugugcuccugggcaguuucgggugcaagccacuuacuauguuucugaucacagaaaacaaaauuuggggaaggaagucuuggcccuugaaugaggguaucauggccauaggcaucgucuccauucuccugagcucgcuacugaaaaacgauguaccucuugccgggccccucaucgcuggaggcaugcugauugcauguuaugugaucucagguucuagugccgacuuguccuuagagaaggcggcugaaguuagcugggaggaagaggccgaacauucugggaccagccacaauauacugguggagguccaggaugacggaacuaugaaaauuaaggaugaggaacgagacgauacacucaccauccugcuuaaagcaacgcuguuggccguguccggcguauacccaaugucaaucccugcuacucuauucgugugguauuucuggcaaaagaagaaacagcgcaguggcguccugugggacacccccagcccaccggagguugaacgggcagugcucgaugacgggauuuacagaauacugcagaggggacuuuuaggucguucucaggugggcgucgggguguuucaagacggaguuuuccauacaauguggcacguaacccgcggcgccgugcugauguaucaggguaagcggcucgagccuuccugggcgucagucaaaaaggauuugaucaguuacgggggaggcuggagauuucagggcagcuggaacacaggggaggaagugcagguuauugcuguggagcccggcaagaauccaaagaacguccaaacuacccccgguacguucaagacaccugaaggcgaggugggggccaucgcacuggacuuuaaaccaggaacuuccggcucucccauuguaaauagggaagguaagaucgucgggcucuacggaaacggcgugguuaccacaucgggcaccuaugugagcgccauagcucaggccaaagcaucacagcaagggccucugccggagaucgaggaugaagucuucaagaaacgaaaucuuacuauuauggaccugcacccaggauccgguaagacccggcgcuacuugcccgcuaucgugagagaggccauuaagaggaaacuacggacacugauccucgcgccuacgcgaguuguggccagugaaauggcagaggcuuuaaagggcaugccaauaagauaucagacuaccgccgucaaaucugaacauacagggcgcgagauuguggaucugaugugccacgcuaccuuuacuaugaggcuucugagccccguacgugugccuaacuacaauaugaucaucauggacgaggcacauuucacagauccggccuccauugccgcucggggauauaucucaaccagaguuggcaugggugaagcggcagccauauuuaugacggcuacucccccagggucugucgaggccuucccucagagcaacgcagugauucaggacgaagagagggauauccccgaacgcaguuggaacuccggauacgacuggauuacagauuuuccaggcaagaccgugugguucgucccuagcaucaaaucuggcaacgacauagccaauugucuccgaaagaacgggaagagaguaauucaauugucacggaaaaccuucgacacugaguaucagaagaccaaaaauaaugauugggacuacgugguuaccacagauaucuccgagaugggagcuaacuuuagggcggaccgcgugaucgauccccguagaugccugaagccagucauucucaaagacgguccggaacgggugauccuggccggcccuaugcccguuacuguggcaagugcugcccagaggcgcgggcgaauuggaagaaaucagaacaaggagggcgaucaauacgucuauaugggucagccacuuaauaacgacgaagaucacgcacauuggacggaggccaagaugcuacuggacaauauaaacacccccgaggggaucauuccugcuuuguucgaaccagagcgggagaaaagcgccgcgaucgauggcgaguacagguuacgcggagaagcaagaaagacauuuguggagcugaugaggcggggcgaccuccccguauggcugucguauaaaguggccucugagggguuccaguacuccgaucgucgcuggugcuuugacggagaacgaaauaaccagguucuugaggaaaauauggacgucgagaucuggacuaaggaaggugagaggaaaaagcugaggccucgguggcucgaugcucgcaccuauagcgacccguuggcccugagagaguucaaagaauuugcugcaggcaggcggucagugaguggggaucuaauucuggagauaggaaagcucccacaacaccuuacacugcgagcccagaacgcuuuagacaauuuggugaugcugcacaacucugaacagggcgguaaggccuacagacaugcaauggaggaacuccccgauaccaucgagacucugaugcuucuggcgcucauugccgucuugaccgggggaguuacgcuguucuuuuuauccggaaaaggccuagggaagacaagcaucggacugcucugugugauggcuucaagugcccuucuguggauggcaagcguagagccucacuggauugcugccuccaucauauuggaguucuuucugauggugcuccugauccccgagccagaccgccagaggacuccucaagauaaucagcuugcauaugucgugauuggucuccuguucaugaucuugaccguugccgcuaacgaaaugggccuguuagagacaaccaaaaaggaccuagggauuggacauguggcggccgagaaccaccaccaugcaacuaugcuggaugucgaccuccggcccgcuucugccuggacacuuuacgccguagcaacgaccgugaucacuccaaugaugcgucacacaauagaaaauaccaccgcuaacauuagccugacagccaucgcgaaucaggcugccauuuugaugggccuggauaaagguuggccuaucuccaagauggacauagggguuccgcuccuggcacuuggcugcuacucacaagugaaccccuuaacucugacggccgcuguccucauguugguggcacauuaugccaucauuggaccaggccugcaggcgaaggcuaccagagaggcccagaaaaggacagcagccgggaucaugaagaauccuacugucgauggaauuguggcuaucgaccuagaccccguuguguacgaugccaaauuugaaaagcagcugggccaaauaaugcuccuuauucuguguaccucucagaucuugcugaugcgcacaaccugggcacucugcgagaguaucacucuggcuacggguccauuaacaacccuuugggaagggucgccuggaaaauucuggaacacuaccauugccguaagcauggcgaauaucuuccggggcuccuaucuggccggugcaggccucgcuuuuucucuaaugaagucacuagggggaggccgaagagggacaggagcccagggcgagacuuugggugagaaguggaaaaggcagcugaaccaacucagcaaguccgaguucaauaccuacaaacgcagugggauaauggagguggaccggucugaagcaaaggagggacuuaaaagaggcgaaacaacgaagcacgcugucagccgugguaccgccaagcugaggugguuuguugagcggaacuuggugaaacccgagggcaaggucauugaucugggguguggacgcggcggguggucauauuacugcgccggacucaaaaaggugacugaaguaaaaggcuauacaaagggugggccgggacaugaggaaccaaucccuauggcgaccuacggcuggaauuuagugaaacugcacuccggcaaggacguuuucuuuacucccccagagaagugugauacacuucugugcgacauuggggaaaguagccccaacccuaccaucgaggagggacgaacgcuaagagugcucaaaauggucgaaccguggcugagggguaaucaguucuguauaaagaucuugaaccccuacaugccaucuguggucgagacccuggaacagaugcagcggaaacacggcgggaugcucgugcgcaauccucuuuccagaaacucaacacaugagauguauuggguuagcugcggaacuggcaauauuguaucggcugugaacaugaccucuaggaugcuguuaaaccgauuuacaauggcacaccggaagcccacuuacgagcgugaugucgaccugggugccgggaccagacauguggcuguugaaccugagguggccaauuuggauaucauuggacaacgcaucgaaaacauuaaaaaugagcacaagaguacauggcacuaugacgaagauaacccauacaagaccugggcauaucauggcuccuacgaggucaaacccagcggcucagccuccucuauggugaaugggguagugaggcuccugacuaagccuugggacguuaucccaauggucacgcagauagcuaugacagacaccacucccuucggacagcaacggguguuuaaagagaagguggauaccagaacaccgcgcgcgaaaagggguacggcccagauuauggaagucaccgcaaaguggcuauggggcuuccuuagccgaaacaagaaaccucggaucuguacuagagaggaauuuacaaggaagguucgcaguaaugcugccaucggggcaguguucguagacgagaaccaguggaacuccgccaaagaagcuguggaggaugagcguuuuugggaccugguccaccgggaaagagagcuccauaagcagggaaaaugcgcaacaugcguguauaacaugaugggcaagagggaaaagaaacugggugaguucgggaaggcgaaaggaagccgcgcaauuugguacaugugguugggcgcccgauuccuggaauuugaggcucucggcuucaugaaugaggaucacugguuuucucgggaaaacucacuuagugggguugagggagaaggucugcauaaguuaggcuacauacugagagacaucuccaaaauuccagggggaaauauguaugccgaugacacugcaggcugggauacaaggaucaccgaggacgauuugcaaaacgaggcuaagauuacagacaucauggaacccgagcacgcccuccuggcuacuagcauauucaaacuaaccuaccagaauaaggugguccgcgugcagagaccugccaagaacgguacgguaauggauguuaucucucggagggaccagcgugggucgggacaagugggcaccuauggccuuaacacauuuacuaauauggaaguccagcugauucgacagauggagucagaagggaucuuccucccaugugagcuggagacccccaacuuggcagaacgcguguuagacuggcuggagaaacacggagcggaaagacucaagcggauggccauuagcggugaugacugcguggucaaaccgaucgaugacagguuugcuacagcccuuauagcacugaaugauaugggcaagguucgcaaagacauuccucagugggagcccuccaagggguggaacgauuggcaacaggugccauucuguagucaucacuuucaucagcuaaucaugaaggacggaagagaaaucguagugccuugccggaaucaggaugagcuggucggcagggcucgagugucucaaggugccggguggagccuccgugagacugcauguuugggaaaauccuacgcccagauguggcagcugauguauuuccacagacgcgaccuucggcuggcggcuaacgccauuugcucagcaguucccguggauugggucccaaccaguaggacgacauggucuauacacgcccaucaccaauggaugaccacugaagacaugcucagcguguggaauagaguauggaucgaggaaaaccccuggauggaggacaagacacauguuuccucaugggaagaggugccuuacuuaggcaaacgcgaggaucagugguguggcagccugauuggguugaccgcucgggccacuugggcaaccaauauccaggucgcuauuaaccaggugaggcgacugaucggaaaugaaaacuaucucgacuacaugacaucuaugaagagauuuaaaaaugaguccaacccagaaggugcccuuugguga

SEQ ID NO: 13486 - RNA, 9879 nt, Artificial Sequence
  derived and/or modified CDS sequence (opt3) from DENV-1__FJ410183__SS-prME
agcgugaccaugcugcucaugcuucugcccaccgccuuggcuuuccacuuaacuacgagaggaggggagccucauaugaucgucuccaagcaggaaaggggaaagucucugcuguuuaagaccucagcagguauuaacaugugcacacucauagccauggaccugggagagcuuugugaagauacuaugaccuacaaaugcccacggaucaccgaggcggaaccggacgauguugacuguuggugcaaugcuaccgauacuugggugaccuaugggaccuguagucaaacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcauuuuuccuggcccaugcuaucggcaccucgauuacgcagaagggcaucauauuuauccucuuaaugcugguuacuccaucaauggccaugcggugcguggggauuggaaaccgcgauuucgucgagggucuuagcggcgcgacauggguggacguaguuuuggagcacgggaguugugugaccacuauggcaaaagauaagcccacacuggacaucgaacuacucaaaaccgaggucacgaauccugccgugcugagaaaacuuugcauugaagcuaaaaucuccaacaccacaacugauucuagguguccaacccaaggagaggccacacugguggaagaacaggacagcaauuuugucugccggcgcacuuucguugaucgaggcugggguaacggguguggauuguuuggcaagggcucccuccugaccugcgcaaaguucaaaugcgugacaaaguuagaggggaaaauaguacaguacgaaaaucugaaguauucagugauugucaccgugcacacuggagaccagcaucaaguugguaacgagacgacagaacacggcaccaucgcuacuauuacaccccaggccccuacaagugagauccagcucaccgacuacggggcgcuuacucuggauuguagcccaagaacaggauuggacuuuaaugaaauggugcuacugacgaugaaagagaagucuuggcucguccauaaacagugguuccuggaucuuccgcugcccuggaccuccggcgccucaacuagccaagagacauggaacaggcaggacuugcucgugaccuuuaagacagcacacgcuaagaaacaggaaguaguugugcuggguagucaagagggggccaugcacacugcuuuaaccggcgccacggaaauccagaccucuggaacaacuaccauuuucgcaggccaucugaagugccggcuaaaaauggauaagcucacacugaaagggauguccuaugucauguguacuggcagcuucaaacuugagaaggaaguggccgagacccagcacgguacggucuuggugcagguuaaauacgagggcacagacgcuccuugcaagauaccauuuucggcgcaagaugaaaaaggggugacccagaauggacgucugaucacugcaaaccccauuguaacagacaaggagaaaccugucaauaucgaaaccgagccacccuucggcgagucuuauauagugguuggugccggggaaaaggcucucaagcuguccugguuuaaaaagggcucaaguauuggaaaaauguucgaggccacugcacgcggcgccagaaggauggcuauccuuggggauaccgccugggacuuuggaagcaucgguggcguguucacauccgucgggaagcuggugcaucagguauuuggagcagcguacggcguguuguucucugguguuagcuggacgaugaaaauugggaucggcauucuccugaccugguuaggacugaacucacggaguacuucccuaagcaugacauguauagcugucggcauggugacccucuaccugggggugaugguccaggccgauucuggaugcguuaucaauuggaagggccgagaacuuaagugugguucagggauuuuugugacaaacgaggugcacacuuggaccgaacaauauaaauuccaggcagacaguccgaagcgcuugagcgccgcuaucggaaaagccugggaggagggcguaugcgguaucagauccgcaacgaggcuggaaaacauuauguggaagcagauaucuaaugagcucaaccauauccuguuagaaaaugacaugaaauuuacagucgugguuggcgaugcuaacgggauucuggcccagggaaagaaaaugauccggccucaacccauggagcaccgcuacucguggaaaagcuggggcaaggcgaagauuaucggggccgacauacagaauaccacuuucaucauugauggaccagacaccccugaaugucccgaugaccagagagcuuggaacaucugggagguggaggauuauggcuuugguauuuucacaacuaauaucuggcuuaaguugagggacuccuacacccagaugugcgaucaccgucucaugucagcagccauaaaagacaguaaggcuguccaugccgauaugggguauuggauugaaucugagaaaaacgaaacauggaagcuggcacgggcgagcuucaucgaggugaagacguguauuuggccaaaaucccacacccuauggucaaauggaguucuggaaagcgagaugaucauacccaagauguacggcgguccuacuucucaacauaacuaucgaccaggcuacuuuacacagaccgccgggccguggcaccucggaaaacuggagcuugacuucgauuugugcgaaggcacuacagugguagucgacgagcacugcgggaauagaggacccucccugaggaccacgacugugaccggcaagaucauucaugaaugguguugccgcaguuguacauuaccuccacuccgguuuagaggugaggacgggugcugguacggaauggagaucaggcccgugaaagaaaaggaggaaaaccugguccgcagcaugguuucugcuggcuccggugagauggauucauucagucuuggcauucugugugugagcaucaugauagaagagguaaugcgaucgcgguggucccguaagauguugaugaccgggacucucgccguguuucugcuacugauuaugggacagcucacauggaaugaccugaucagacuuugcaucauggucggcgcaaacgcuucugauaggauggggaugggaaccacauauuuggcccugauggcaacuuucaaaaugcgcccuauguuugccgugggcuuacucuuccggagacugaccagcagggagguucuucugcuaacgauuggucucucacugguggcuagugucgaauugccaaauucccuggaggaauuaggggacggacucgcgaugggcaucaugaugcugaaacuucugacagaguuucaaccccaccaguuguggaccacucuccugucucuaaccuucauuaaaacaacucugagccuugauuacgccuggcgaaccauggcaauggugcucuccauaguuucacuguuuccguugugucugagcacgacaagucagaagaccacuugguuaccugugcuccugggcucuuucgggugcaaaccacuuacaauguuucugaucaccgaaaacaagauuuggggacgcaaguccuggcccuugaacgaggguaucauggcuauuggcaucgucagcauacuccugucgucacuacugaaaaaugacguaccucuugccgggccccucaucgccggaggcaugcugauugcuuguuaugugaucucugguaguuccgcagauuugagcuuagagaaggccgcggaaguuucuugggaggaagaggcugaacauagcgggacuucccacaacauucugguggagguccaggacgauggaacaaugaaaaucaaggacgaggaacgggaugacacccucacgauacugcuuaaagccacucuguuggcagugucaggcguauacccaaugaguauuccugccacccuauucgugugguauuucuggcaaaagaaaaagcagagaagcggcguccugugggauacacccucuccaccggagguugaaagggcugugcucgacgacgggaucuaccguauccugcagcgcggacuuuuaggucggucccaggugggcgucgggguguuucaagauggaguuuuccauaccauguggcacguaacaagaggcgcagugcugauguaucaggguaagaggcucgagccuucaugggccagugucaaaaaggacuugauuagcuacgggggaggcuggcgauuucagggcuccuggaauacuggggaggaagugcagguuauagcgguggagcccggcaagaacccaaagaauguccaaaccacgcccgguacauucaaaacuccugaaggcgaggugggggcuaucgcccuggauuuuaagccaggaaccucuggcucgcccauuguaaaccgggaagguaagaucgucgggcucuacggaaauggcgugguuacaaccagcggcacuuaugugucagcaauugcccaggcuaaaaccucccaggaggggccucugccggagaucgaagacgaggucuucaagaaacgcaaccuuacaauaauggaucugcacccaggaagugguaagacgagaagguacuugcccgccaucgugcgggaagcaauuaaacgaaagcuaagaacucugauccucgcuccuacccgcguuguggccucugagauggcggaagccuuaaagggcaugccaauuagguaucaaacaaccgcagucaaaagcgagcauacugggcgugagaucguggaccugaugugccacgcuacauuuaccaugcggcuucugucccccguaagagugccuaauuacaacaugauaauuauggaugaagcccauuucacggacccggcuucaaucgcagccaggggauauaucucuacucgcguuggcaugggugaggccgcugcgauuuuuaugacagcaacacccccagggagcgucgaagccuucccucagaguaaugcugugauccaggaugaggaacgagacauacccgagagauccuggaacagcggauacgauuggauuaccgacuuuccaggcaagacugugugguucgucccuucuaucaaaucaggcaaugacauugccaacugucuccggaagaaugggaaaaggguaauccaguugucccgcaagacauucgauaccgaguaucaaaagacuaagaacaacgacugggauuacgugguuacuacggacauaagugaaaugggagcaaauuuucgugccgauagagugauugacccccggaggugccugaagccagucauccucaaagaugguccggagcgcgugauccuggcuggcccuaugcccguuaccguggcgagcgccgcacagcgaagagggcggauuggaaggaaccagaauaaggaaggcgaccaguacgucuauaugggucaaccacuuaacaaugaugaggaccacgcucauuggacagaggccaaaaugcuacuggauaacaucaauacucccgaagggauuauaccugcauuguucgagccagaacgcgagaagucggccgcuaucgacggcgaauacagauuaaggggagaggcccggaagaccuuuguggagcugaugcgucgcggcgaucuccccguauggcugucuuauaaaguggcguccgaaggguuccaguacagcgaccgaagauggugcuuugacggagagaggaacaaucagguucuugaagagaacauggaugucgaaauuuggacaaaggagggugagcggaaaaagcugcgcccuagauggcucgacgcaaggaccuauucagauccguuggcccugcgggaguucaaagaguuugcugccggccgaagaagugugucuggggaccuaauccuggaaaucggaaagcucccacagcaccuuacucugcgcgcucaaaaugcauuagauaacuuggugaugcugcacaauuccgagcagggcgguaaagccuacaggcaugcuauggaagaacuccccgacacgauugagacccugaugcuucuggcccucauagcagucuugacagggggcguuacucuguucuuuuuaagcggaaagggccuagggaagaccucaaucggacugcucugugugauggcgaguagcgcccuucuguggauggcuaacguagaaccucacuggauugccgcauccaucauuuuggaguucuuucugauggugcuccugauccccgaaccagaucggcagcguacaccucaggacaaucaacuugcuuaugucgugauaggucuccuguucaucauuuugaccguugccgcaaacgagaugggccuguuagagacuacuaagaaggaucuagggaucggacauguggccgcugaaucucagcaccacgcgacgaugcuggacgucgaucucagacccgccagcgcauggacccuuuacgcuguagccacuacagugauuaccccaaugaugaggcauaccaucgagaacacaacugccaauauaucccugacggcaauugcuaaccaggccgcgaucuugaugggccuggacaaagguuggccuauuucaaagauggauaucgggguuccgcuccuggcucuuggcugcuacucucaagugaaucccuuaacccugacagccgcaguccucauguugguggcccacuaugcuauaaucggaccaggccugcaggcaaaagccacucgcgaagcgcagaagcggaccgcugccgggauuaugaagaacccuacagucgacggaaucguggcaauugaccuagaucccguuguguacgacgccaaauuugagaagcagcugggccaaaucaugcuccuuauacuguguaccagucagauuuugcugaugcgaacuacgugggcucucugcgaaucgaucacacuggccaccgguccauuaacuacccuuugggaggggagcccuggaaaauucuggaauacaacuaucgcaguauccauggcuaacauuuucagaggcucuuaucuggccggugcgggccucgccuuuucacuaaugaaaagccuagggggaggcaggcgcgggaccggagcacagggcgagacauugggugaaaaauggaagcggcagcugaaucaacucuccaagagugaguucaacacguacaaaagaucugggaucauggaaguggaucguagcgaggcuaaggaaggacuuaaaaggggcgagaccacuaagcaugccgucucacgggguacagcaaaacugcgcugguuuguugagcgaaauuuggugaagcccgaaggcaaggucauagaccugggguguggaagaggcgggugguccuauuacugcgcuggacucaaaaaggugaccgagguaaaaggcuauacuaagggugggccgggacacgaggaaccaauuccuauggccacauacggcuggaacuuagugaaacuguacaguggcaaggauguuuucuuuacacccccagaaaaaugugacacgcuucugugcgauaucggggagagcucucccaauccuaccauugaggaaggaaggacacuacgggugcucaagauggucgagccguggcugcgcgguaaccaguucuguaucaagauauugaaucccuauaugccauccguggucgaaacucuggagcagaugcagagaaaacauggcgggaugcucgugaggaacccucuuucacgaaauagcacccacgagauguacuggguuucgugcggaacaggcaacaucguaucugccgugaauaugacaagucggaugcuguuaaaccguuuuaccauggcgcacagaaagcccacauaugaacgcgacgucgaucugggugcugggaccaggcauguggcaguugagccugaaguggccaacuuggacauuaucggacaacggauugagaauaucaaaaacgaacacaaguccacuuggcauuacgaugaggacaauccauauaaaacgugggcuuaccacggcagcuaugaggucaagcccucaggcuccgccucuagcauggugaacgggguagugagacuccugacaaagccuugggacguuauuccaauggucacccagaucgcaaugacugauaccacacccuucggacagcaacgcguguuuaaagaaaagguggacacgaggaccccgcgagccaaacgggguacugcucagauaauggaggucacagcgaaguggcuauggggcuuccuuaguagaaauaaaaagccuaggauuuguacccgcgaagaguuuacucguaagguucgguccaacgccgcaaucggggcuguguucguagaugaaaaucaguggaacagcgccaaagaggcaguggaggacgaaagauuuugggaucugguccacagggagcgcgaacuccauaagcagggaaaaugcgccacaugcguguacaauaugaugggcaagcgagagaaaaagcugggugaguucgggaaggcuaaaggaucucgggccaucugguacaugugguugggcgcgagauuccuggaguuugaggcacucggcuucaugaacgaagaccacugguuuucaagggagaauaguuucuccgggguugaaggagagggucuucauaagcugggcuauauuuuacgcgauauaagcaaaaucccagggggaaacauguacgccgacgauaccgcuggcugggacacaagaauuacugaggaugaccugcaaaaugaagccaagaucaccgauauuauggagcccgaacacgcauugcucgcuacgucuaucuuuaaacugaccuaucagaacaaggugguccgggugcagaggccugccaaaaaugguacaguaauggacguuauaucgcgucgagaccagcgcgggucaggacaagugggcacuuacggccuaaacaccuucacaaacauggagguccagcuuaucagacagauggaaagcgaggggauuuuucugccauccgagcucgaaacucccaaucuggcugagcggguguuggauugguuagaaaagcauggaaccgagaggcugaagcgcauggccaucaguggugacgauuguguggucaaaccgguugacgauagauucgcaacggcgcucauugcccuuaacgacaugggcaaggugcggaaagauaucccucagugggaacccucuaagggguggaaugacuggcaacagguaccauuuugcagccaccacuuccaucagcugauaaugaaagauggaagggagauuguggucccuugucgaaaccaggacgagcuagugggccgugcuagaguuucccaaggugccggguggucacugcgcgaaacagcaugccucggaaagaguuaugcucagauguggcaguugauguacuuucaccggagggaucugagacuugccgcaaaugccaucuguucugcggugcccgucgacugggugccaaccagccgcacuacaugguccauccaugcucaccaccaauggaugaccacugaggacaugcugucaguauggaaccggguuuggauugaagagaaucccuggauggaagauaagacccaugugagcucuugggaggaggucccuuaucucggcaaaagggaagaccaguggugcggcuccuuaauagggcugacagcccgagcaacgugggccaccaacauccagguggcuauuaaucagguuagacgguugaucggaaacgagaauuaccuggauuacaugacaaguaugaagagguucaaaaacgaaagcgacccagagggugcccucugguga

SEQ ID NO: 13487 - RNA, 9879 nt, Artificial Sequence
  derived and/or modified CDS sequence (opt3) from DENV-1__FJ410184__SS-prME
agcgugaccaugcugcucaugcuucugccaacugccuuggcuuuccacuuaacuacgagaggcggggagccucauaugaucgucuccaagcaagaaaggggaaaaucucugcuauuuaagaccucagcagguauuaacaugugcacucucauagccauggaccugggcgagcuuugugaagauacuaugaccuacaaaugcccacggaucacagaggcggaaccggacgauguugacuguuggugcaaugcuaccgauacuugggugacauaugggaccuguagucaaacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugaucgcacuguuucucgcccaugcuauuggcacaucgaucacccagaagggcauuaucuucauuuuacugaugcuuguuacgccaucaauggccaugcggugcguggggaucggaaaccgcgauuuugucgaggguuugagcggcgcgacuuggguggacguaguucuggagcacgggaguugugugacaaccauggcaaaagauaagcccacucuagacauugaacuccugaaaacagaggucaccaauccugccgugcuuagaaagcugugcaucgaagcuaaaauauccaacacgaccacagauucuagguguccaacucaaggagaggccaccuugguggaggaacaagacgcaaauuucgucugccggcgcacauuuguugaucgaggcugggguaacggguguggacucuucggcaagggcagccuguuaacuugcgcuaaguuuaaaugcgugaccaagcuggaggggaaaauuguacaguacgaaaaucucaaguauuccgugaucgucacagugcacaccggagaccagcaucaaguugguaacgagacuacggaacacggcacaauugccaccaucacuccccaggcgccuaccucagagauccagcuuacagacuacggggcccugaccuuggauuguaguccaagaacuggacuagacuucaaugaaauggugcugcucacaaugaaagaaaagagcuggcugguccauaaacagugguuucuugaucugccguugcccuggacgucuggcgcauccaccucacaagagacuuggaacaggcaggaccuccuggugacauucaagaccgcucacgccaagaaacaggaaguaguuguguuagguagccaagagggggcuaugcacacagcccugacuggcgcaaccgaaauucagacgaguggaaccacaacuauauuugccggccaucuaaagugccggcucaaaauggauaagcugacccuuaaagggaugucuuaugucauguguacaggauccuucaaguuggagaaggaaguggcugagacucagcacgguaccguccuggugcagguuaaauacgagggcacggacgcgccuugcaagaucccauucagcgcacaagaugaaaaaggggugacacagaauggacgucucauuaccgccaaccccaucguaacugacaaggagaaaccugucaauauagaaacagagccacccuuuggcgagucguauauugugguuggugcuggggaaaaggcccugaaacuuucuugguucaaaaagggcuccucaaucggaaaaauguuugaggcaaccgcccgcggcgcuagaaggauggccauccugggggauacugcaugggacuucggaaguauugguggcguguuuaccagcgucgggaaguuggugcaucagguauucggaacagcguacggcgugcucuuuuccgguguuucuuggacgaugaaaaucgggauuggcauacuguuaaccuggcugggacuaaacagccggucaacaagucucuccaugacauguaucgcugucggcauggugacccuguaccuuggggugaugguccaggccgauagcggaugcguuauuaauuggaagggccgagaauugaagugugguucugggaucuucgugacaaacgaggugcacacuuggaccgaacaauauaaauuucaggcagacucaccgaagcgccugagugccgcuaucggaaaagccugggaggagggcguaugcgguauuagaagcgcaacgaggcucgaaaacauaauguggaagcagaucuccaaugagcugaaccauauuuuacuggaaaaugacaugaaauucacagucgugguuggcgaugcuaacgggauccuugcccagggaaagaaaaugauucggccucaacccauggagcaccgcuacucuuggaagucguggggcaaggcgaaaaucauaggggccgacauccagaauaccacuuuuauuaucgauggaccagacaccccugaaugucccgaugaccagagagcuuggaacauuugggagguggaggauuauggcuucgguaucuuuacaacuaauauaugguugaagcucagggacagcuacacccagaugugcgaucaccgucugauguccgcagccauuaaagacucaaaggcuguccaugccgauaugggguauuggaucgaaagugagaaaaacgaaacauggaagcuagcacgggcgucuuucauugaggugaagacguguaucuggccaaaaagccacacccugugguccaauggaguucucgaaucagagaugauaauccccaagauuuacggcgguccuaucagccaacauaacuaucgaccaggcuacuucacucagacagccgggccguggcaccugggaaaacuugaguuggacuuugaucugugcgaaggcaccacugugguagucgacgagcacugcgggaauagaggacccucuuuaaggacaaccacggugacuggcaagauuauccaugaaugguguugccgcuccuguacccucccuccacugcgguucagaggugaggacgggugcugguacggaauggagauaaggcccgugaaagaacgcgaggaaaaccuugucaagaguaugguuagcgcuggccugggugagguggauucuuuuuccuugggcauucucuguguaucaaucaugaucgaagaggugaugcgaagucgguggagccguaagaugcugaugacagggacccuagccgucuuccugcuccugauuaugggacagcuuacuuggaaugacuugaucagacugugcauuauggugggcgcaaacgcuucggauaggauggggaugggaacaaccuauuuagcccucauggcaacauuuaaaaugcgcccuauguucgccguuggccugcuuuuucggagacugacuuccagggaggugcuacuccugaccauagguuugucucuggucgcuagcguggaauuaccaaauucacucgaggaacugggggacggacuugcgaugggcaucaugaugcugaaguugcucacggaguuccaaccccaccagcuguggacaacccuacugagucuuacuuuuauuaaaaccacacucucccuggauuacgccuggaagacuauggcaaugguuuugucuaucgugagccuguucccguuaugucucuccaccacgucacagaaaacaaccuggcugccuguccuucugggcagcuuggggugcaagccacucacuauguuucugauuacagaaaacaagaucuggggacgaaaaaguuggccccuaaacgaggguauaauggcuaucggcauuguaucuauccugcuuuccagccuccugaagaaugacgugccuuuggccgggcccuuaauugccggaggcaugcugaucgcuuguuauguuauaucggguucaucugcagaucucagucuggagaaagccgcggaaguguccugggaggaagaggcugaacauagcgggaccucucacaacauucuugucgaggugcaggacgauggaacuaugaagaucaaagacgaggaacgcgaugacacacugaccaucuugcuaaaggccacgcugcucgcaguaagcggcguguacccaauguccauuccugccacucuguucgucugguauuuuuggcagaagaagaagcagcggucaggcguucuuugggauacccccaguccaccggagguggaaagagcuguguuagacgacgggauauacaggauccugcagcguggacucuugggucgcagccaggucggcguggggguuuuccaagauggaguauuccauacaauguggcacgugacccggggcgcaguccugauguaucaggguaaaagacucgagccuucuugggccuccgugaagaaagaccugauuucauacgggggaggcuggagguuucagggcgcguggaauacaggggaggaaguucaggugaucgcugucgagcccggaaagaaccccaaaaaugugcaaacuacccccgguacguucaagacaccugaaggcgagguaggggccauugcacuugauuuuaagccaggaacaaguggcagccccaucgucaaccgagaagguaaaauaguggggcuguacggaaauggcguugugaccacauccggcaccuaugucucugccaucgcucaggccaagacuucgcaggaggggagcuugccugagauugaagacgagguguucaaaaagcggaaccuaaccaucauggaucugcacccgggaucagguaaaacacgcagauaccucccagcaauuguuagggaagcuaucaagcggaaguuacgaacgcugauacuugcccccacuagaguggucgcguccgagauggccgaagcacugaaaggcaugccuauucgcuaucaaaccacagcugugaagagugagcauaccgggagggagaucguagaccucaugugccacgccacuuuuacaaugcguuugcugucuccagugcggguucccaauuacaacaugaucauuauggaugaagcucauuucaccgacccugcaagcaucgccgccagaggauauauauccacgagggucggcaugggugaggcugcggcaauuuuuaugacugccacaccgcccgggucaguggaggcuuucccacagucuaaugccgugauccaggaugaagaacgcgacauuccugagcgaagcuggaacaguggauacgauuggaucaccgacuuucccggcaaaaccgucugguucguaccauccauaaagagcggcaaugacauugcaaacugucucaggaaaaaugggaagcgggugauccagcugucuaggaagacuuuugauacagaguaucagaaaaccaagaacaacgacugggauuacguugugacaacugacaucucagaaaugggagccaauuuccgcgcugaucgugucauugacccuagacggugccuuaaacccgugauccuaaaggaugguccagagaggguuauucuggcgggcccgaugccugugacggucgccuccgcagcucagcgccgagggagaauaggacggaaccagaauaaagaaggcgaccaguacguguauaugggucaacccuugaacaaugaugaggaccacgcccauuggaccgaggcaaagauguuacuggauaacaucaauacaccagaagggauuauccccgcccucuucgagccugaaagggagaagagugcugccaucgacggcgaauaccgccugagaggagaggcgaggaaaacuuuuguagagcuuaugcggcguggcgaucugccaguguggcucagcuauaagguugcaucggaaggguuccaguacucugaccgccgauggugcuuugacggagagagaaacaaucaggucuuggaagagaacauggauguggaaauuuggaccaaagagggugagaggaagaaacugcggccccgcuggcuagacgccagaacauauuccgauccucuggcucucagggaguucaaggaguuugccgcuggccggcgaagcgugucaggggaccuuauacuggaaaucggaaaauuaccgcagcacuugacccugagagcacaaaaugcccucgauaaccuggucaugcuucacaauagugagcagggcgguaaggcuuaccgccaugccauggaggaacugccagacacuauugagacgcucauguugcuggcauuaaucgcgguucuaaccgggggcgugacacuguucuuucucucuggaaagggccuugggaaaacuuccauuggacuguuguguguaauggccagcucagcucugcucuggauggccaguguggaaccccacuggaucgcagcuagcauaauccuggaguucuuucuuaugguccuccugauuccugaacccgauaggcagcggaccccacaggacaaccaauuggccuaugugguuaucggucuguuauucaugauucuaacaguggcagccaaugagaugggccugcucgagaccacuaagaaagaucuugggaucggauacgucgcugcggaaaaccaucaccacgccacaaugcuggacguagauuugcguccugcauccgcuuggacgcuguacgccguggccaccacuguuauaacacccaugaugagacauaccauugagaacaccacagcaaauaucucucucacugcuauugccaaccaggcggcuauccugaugggccuugacaaggguuggccaauaagcaaaauggauaucggggugccuuuacuggcccucggcugcuauucccaggucaauccguugacgcugaccgcagccgugcuaaugcuggucgcucacuacgcaauuaucggacccggccuccaagccaaggcgacaagggaagcucagaagcgcacugccgcagggauuaugaaaaacccaaccguggacggaaucguugccauagaccuugauccugugguauaugacgcuaaguuugagaaacagcugggccagauuauguugcugauccucuguacaucacaaauccuguuaaugcggaccacuugggcccuuugcgaaucuauuacgcuggcaacagguccccucaccacucuaugggaggggaguccaggaaaguucuggaauaccacaaucgcugugucgauggccaacauauuucgaggcagcuaccuggcgggugccggcuuggcauucucccugaugaaaucucucgggggaggcagaagggggacuggagcucagggcgagacccuuggugaaaaguggaagcgccagcugaaucaguugucaaaaagcgaguucaacacauauaagcgguccgggauuauggaagucgauagaagugaggccaaagaaggacugaagcguggcgagacgaccaaacaugcaguuucuagggguacugcuaagcuccggugguuuguggagcgcaauuuagucaagccugaaggcaaagugaucgaccugggguguggacgaggcggguggagcuacuauugcgccggacuuaagaaaguaacagaggugaagggcuacaccaaaggugggcccggacacgaggaaccgauuccaauggccacuuacggcuggaaccugguuaagcuacauucaggcaaagauguguucuuuacaccucccgaaaagugugacacccuccugugcgauaucggggaguccaguccaaaucccacgauagaggaaggaagaaccuugaggguccugaagaugguggagccuuggcuccgggguaaccaauucuguaucaaaauucuuaauccguauaugcccagcgucguggaaacacuggagcagaugcagcgcaagcacggcgggauguuaguuagaaacccacugucuagaaauuccacucacgagauguacuggguaucaugcggaaccggcaacaucgugagcgcggucaauaugacaucgcgaauguugcucaaccgguuuacuauggcucaucguaaaccuaccuaugaaagagacguggaucugggugcagggacacgccacguugccguggagcccgaagucgcuaaccuagacauuaucggacagaggauugagaauaucaagaacgaacauaaaucuaccuggcacuacgaugaggacaauccuuauaagacuugggccuaccacggcaguuaugaggugaagccauccggcagcgcaucauccaugguaaacggggugguucggcuucugacgaaacccugggacgucauaccuauggugacacaaauugccaugaccgauacuaccccauucggacagcagagaguguuuaaggaaaaagucgacacacgcacgcccagggcuaagcgagguaccgcgcaaaucauggagguuacugccaaauggcucuggggcuuccugucucggaauaagaagccgagaaucuguacaagggaagaguuuacccgcaaagugcguagcaacgcagcuauuggggccguauucguggaugaaaaucaguggaacagugcaaaggaggccgucgaggacgaacgguuuugggauuuggugcauagagagagggaacugcacaaacagggaaagugcgcuacuugcguuuacaauaugaugggcaaacgcgagaagaagcucggugaguucgggaaagccaagggaucccgagcgauaugguacauguggcuuggcgcacgguuucuggaguucgaggccuuaggcuucaugaacgaagaccauugguuuagcagagaaaauucuuucucagggguggaaggagagggucugcacaaauugggcuauauccucagggauauuaguaagaucccugggggaaacauguacgcugacgauacagccggcugggacacccgcauuacagaggaugaccugcagaaugaagcaaaaaucacugauauaauggagccagaacaugcucuacuugccaccuccaucuuuaagcugacguaucaaaacaaagucgugagaguacagcggcccgcuaagaaugguaccguuauggacgugauuagcaggcgugaccagcgagggucuggacaggucggcacauacggccucaacacuuucaccaacauggaggugcaacugauccgccagauggaaucggaggggauauuuuugccuucagaguuagaaacaccaaaucuggccgagagagugcucgauuggcuugaaaagcacggaacugagcggcugaaaaggauggcaaucagcggugacgauugugucguuaagcccguggacgaucgcuucgcgaccgcccuaauagcucugaacgacaugggcaaaguaagaaaggauauuccgcagugggaaccuuccaaaggguggaaugacuggcagcaagugcccuuuugcagucaccauuuccaccagcucaucaugaaggauggacgggagaucgucgugccauguaggaaccaggacgaguugguuggccgagcccgugugucucagggugcaggguggagccugagagaaacggcuugccuuggaaaguccuaugcccaaauguggcagcugauguacuuucaucgccgggaucucagguuagcagccaaugcgauuuguucagcugucccuguggacuggguacccacaaguagaaccacuuggucuauacacgcccaccaucaguggaugacaaccgaggacaugcugagcguuuggaaccgcguguggaucgaagagaauccauggauggaagauaaaacucacgucuccucaugggaggaggugcccuauuugggcaagcgggaagaccaauggugcggcagccugauugggcucaccgcaagggccacaugggcuacgaacauccagguugccauuaaucaggugcgaagacuuaucggaaacgagaauuaccuggauuacaugaccucuaugaaacgguucaagaacgaauccgacccugagggugcacuaugguga

SEQ ID NO: 13488 - RNA, 9879 nt, Artificial Sequence
  derived and/or modified CDS sequence (opt3) from DENV-1__FJ410185__SS-prME
agcgugacaaugcugcucaugcuucugcccacagccuuggcuuuccacuuaacuacgagaggaggggaaccucauaugaucgucuccaagcaggaaaggggaaaaucucuguuauuuaagaccucaguugguauuaacaugugcacacucauagcaauggaccugggagagcuuugugaagauacuaugaccuacaaaugcccacggaucacagaggccgaaccggacgauguggacuguuggugcaaugcgaccgauacuuggguaacauaugggaccuguagucaaacgggagagcaccgccgagacaagcguagcguggcucuggcaccccaugucggcuugggucucgagacuagaaccgaaacauggauguccucugagggggcauggaaacagauucagaagguggaaacuugggcccugaggcacccuggauucaccguuaucgcucuguuucucgcacaugccauuggcacaucgaucacccagaagggcauaaucuucauuuuacugaugcuugugacgccaucaauggcuaugcggugcgucgggaucggaaaccgcgauuuuguggaggguuugagcggcgccacuuggguagacguugugcuggagcacgggaguugugucacaaccauggcgaaagauaagcccacucuagacauugaacuccugaaaacagaggugaccaauccugcagugcuuagaaagcugugcaucgaagccaaaauauccaacacgaccacagauucuagguguccaacucaaggagaggcuaccuuggucgaagaacaggacagcaauuucguuugccggcgcacauuuguggaucgaggcugggguaacggguguggacucuucggcaagggcucccuguuaacuugcgccaaguuuaaaugcguaaccaagcuggaggggaaaauugugcaguacgaaaaucucaaguauucagucaucgugacaguucacaccggagaccagcaucaaguggguaacgagacuacggaacacggcacaauugcaaccaucacuccccaggcuccuaccagugagauccagcuuacagacuacggggcccugaccuuggauuguagcccaagaacuggacuagacuucaaugaaaugguccugcucacaaugaaagagaagucuuggcuggugcauaaacagugguuucuugaucugccguugcccuggacguccggcgcgucaaccagccaagagacuuggaacaggcaggaccuccugguaacauucaagaccgcccacgcaaagaaacaggaaguuguggucuuagguagucaagagggggcuaugcacacagcccugacuggcgcuaccgaaauucagacgucuggaaccacaacuauauuugccggccaucuaaagugccggcucaaaauggauaagcugacccuuaaagggauguccuaugugauguguacaggcagcuucaaguuggagaaggaagucgcagagacucagcacgguaccgugcugguucaggugaaauacgagggcacggacgccccuugcaagaucccauucucggcucaagaugaaaaagggguaacacagaauggacgucucauuaccgcgaaccccaucgucacugacaaggagaaaccugugaauauagaaacagagccacccuuuggcgagucuuauauuguuaucggugcaggggaaaaggcccugaaacuuuccugguucaaaaagggcucaaguaucggaaaaauguuugaggcuaccgcccgcggcgcaagaaggauggccauucugggggauacugcuugggacuucggaagcaucgguggcguguuuaccuccgucgggaaguuggugcaucagguauucggagccgcauacggcgugcucuuuucugguguuagcuggacaaugaaaauugggauaggcauccuguuaacguggcugggacuaaacucacggaguaccucccucagcaugacuuguauugcggucggcauggugacacuguaccuuggggugaugguccaggcugauucuggaugcguuaucaauuggaagggccgagaauugaagugugguucagggaucuucgugaccaacgaggugcacacauggacugaacaauauaaauuucaggccgacaguccgaagcgccugagcgcagccauuggaaaggcuugggaggagggcguaugcgguauaagauccgccaccaggcucgaaaacaucauguggaagcagauuucuaaugagcugaaccauaucuuacuggaaaaugacaugaaauucacggucgugguuggcgaugcaaacgggauucuugcucagggaaagaaaaugauccggccucaacccauggagcaccgcuacucguggaaaagcuggggcaaggccaaaauaaucggggcggacauucagaauacaaccuuuaucauugauggaccagacacuccugaaugucccgaugaccagagagccuggaacaucugggagguggaggauuauggcuucgguauauuuaccacaaauauuugguugaagcucagggacuccuacacucagaugugcgaucaccgucugaugucagcugcaaucaaagacaguaaggccguccaugcugauaugggguauuggauugaaucugagaaaaacgaaaccuggaagcuagcccgggccagcuucaucgaggugaagacauguauauggccaaaaucccacacgcuguggucaaauggaguucucgaaagcgagaugaucauucccaagaucuacggcgguccuauuucucaacauaacuaucgaccaggcuacuucacccagacugcggggccguggcaccugggaaaacuugaguuggacuuugaucugugcgaaggcacaaccgugguagucgacgagcacugcgggaauagaggacccuccuuaaggacuacaaccgugacgggcaagaucauacaugaaugguguugccgcaguuguacucucccuccacugcgguucagaggugaggacgggugcugguacggaauggagauuaggcccgugaaagaaaaggaggaaaaccuuguccgcagcaugguuucugccggcuccggugagguggauucauuuagucugggcaucuuguguguaagcaucaugauugaagaggugaugcgaucgcgguggucccguaagaugcucaugaccgggacacuggcugucuuccuacugcucaucaugggacagcugaccuggaaugaccuuauuagauugugcauaauggugggcgccaacgcaucugauaggauggggaugggaacuacauaucuggcuuuaauggccaccuuuaaaaugcgcccuauguucgcaguuggccuccuguuucggagacuuacaagcagggaggugcugcuacucacuaucggucugucauuggucgccaguguggaacugccaaauuccuuagaggaacucggggacggacuggcuaugggcauuaugaugcuuaagcuguugaccgaguuccaaccccaccagcucuggacgacacugcuaucucugaccuuuaucaaaacuacccuuagccucgauuacgcguggcgaacaauggccaugguucuguccauugugucauuguucccgcuguguuuaagcacuaccagucagaagacgacauggcucccuguccugcuuggcucuuuugggugcaaaccacugaccauguucuugaucacugaaaacaagauauggggacgcaaguccuggccccucaacgaggguaucauggcaauuggcaucguaagcauucugcuaucgucacugcuuaaaaaugacgugccucucgcugggccccugaucgccggaggcauguugauagccuguuauguuauuucugguaguuccgcugauuuaagccuggagaaggcagccgaagugucuugggaggaagaggcggaacauagcgggacaucccacaacauccucgucgaggugcaggacgauggaaccaugaaaaucaaggacgaggaacgggaugacacucugacaauucuucugaaagcuaccuugcuagccguaucaggcguguacccaaugaguauaccugcaacgcuguuugucugguauuucuggcaaaagaaaaagcagagaagcggcguucucugggauacucccucuccaccggagguggaaagggccgugcuggacgacgggaucuaccguauucuucagcgcggauuacugggucggucccaggucggcguggggguuuuccaagauggaguauuucauaccauguggcacgugacaagaggcgcuguccucauguaucaggguaagagguuggagccuucaugggcaagugugaaaaaggaccugaucagcuacgggggaggcuggcgauuccagggcuccuggaauaccggggaggaaguucaggugauugccgucgagcccggcaaaaauccaaagaaugugcaaacaacucccgguaccuuuaaaacgccugaaggcgagguaggggcgaucgcucucgauuucaagccaggaacaucuggcucgcccauagucaaccgggaagagaagaucgugggucuguacgggaauggaguugugacuaccagcggcacauaugucucagccauugcacaggccaaaaccucccaggagggcccucuuccggaaaucgaggacgaaguguuuaagaaacgcaaccugacuauuauggauuugcacccagggaguggaaagaccagaagguaccuacccgcuaucguucgggaggccauaaaacgaaagcugagaacacucauuuuagcaccuacgcgcguggucgcuucugaaauggccgaggcgcugaaggguaugccaaucagguaucaaacuaccgccgugaaaagcgagcauacaggccgugaaaucguagaccuuaugugccacgcaaccuucacuaugcggcugcucucccccgugagaguuccuaauuacaacaugauuaucauggaugaggcucauuuuacagacccggccucaauagcugcaaggggguauauuucuacccgcgucggaaugggcgaagccgccgcuaucuucaugacggcgacucccccagguagcguggaggcauuuccucagaguaaugccgugauucaggaugaagaacgagacauccccgagagauccuggaacagcggguacgauuggauaacagacuucccaggaaagaccgucugguuuguaccuucuauuaaaucaggcaaugacaucgcuaacuguuugcggaagaauggcaaaagggugauccagcugucccgcaagaccuucgauacugaauaucaaaagaccaaaaacaacgacugggauuacguugugaccacagacauuagugagaugggggccaauuuccgugcagauagagucaucgacccccggaggugccucaagccagugauucugaaagauggaccggaacgcguuauacuugccgguccuaugcccgugacugucgcuagcgcggcccagcgaagaggccggaucgggaggaaccagaauaaggagggagaccaguacguguauaugggccaaccacuaaacaaugaugaggaccacgcacauuggacggaagcuaaaaugcuguuggauaacauuaauacccccgaggguaucaucccugccuuauuugaaccagagcgcgaaaagucggcagccauugacggggaguacagacugaggggcgaggcucggaagacauucguagaacucaugcgucgcggagaucugcccguguggcuuucuuauaaaguugccuccgagggcuuucaguacagcgaccgaagauggugcuucgacggggaaaggaacaaucagguccuggaggaaaacauggauguggagauauggacuaaggagggagaacggaaaaagcuccgcccuagaugguuggacgcgaggaccuauucagauccgcuggcacuacgggaguuuaaagaguucgccgcuggucgaagaagugugucuggcgaccugauccucgagauugggaaacuuccacagcaccugacauuacgcgcccaaaaugcuuuggauaaccuggucaugcuccacaauuccgaacagggaggcaaagcauacaggcaugccauggaggagcugcccgacaccaucgaaacucuuaugcugcucgcuuugauugccguucugacggguggggugaccuuauuuuuccuaagcggcaagggacugggcaagacaucaaucgggcuccuuuguguaauggcaaguagcgcgcuguuguggauggccaacguggagccucacuggauagcugccuccaucauucuggaauuuuuccucaugguccugcuuauccccgagccagaucggcagcguacuccucaggacaaucaacucgcauaugugguuauuggacuguuguuuaugauccugaccguggcugccaacgagauggguuuacuagaaacaaccaaaaaggaucugggcauagggcaugucgcagccgagaaccagcaccacgcuacuaugcucgacguagaucuuagacccgcgucugccuggacacuguacgcaguggcuacgaccguuauuacuccaaugaugaggcauacaaucgaaaauaccaccgccaacauuagcuugacagccaucgcaaaucaggcugccauacugaugggacucgacaaaggcuggccuaucuccaagauggauauuggugugccgcugcuugcguuagggugcuacucacaagucaacccccugacucucacggcugccguguugaugcuggucgcacacuaugccaucauuggcccaggacuacaggcuaaagcaacccgcgaggcccagaagcggacagcggcuggcaucaugaagaauccuacuguggacgggauaguugccauugaccuggaucccgugguauacgacgcaaaauucgaaaagcagcucggacaaaucaugcuucugaucuuguguaccucucagauucugcucaugcgaacaaccugggcccugugcgagaguaucacuuuagcuacgggcccacuuacaacccugugggaggguucgccugggaaauuuuggaacacuaccauagccgugagcauggcaaauauuuucagaggauccuaucucgcuggcgccggucuagcguucucucugaugaagucauugggcgggggaaggcgcggcacaggggcccagggagaaacucugggcgagaaauggaagcggcagcucaaccaacuuagcaaguccgaauuuaauaccuacaaaagaagugguaucauggaggucgaucguucugaagcaaaggaggggcugaaaaggggagagacaacgaagcaugcuguuagccggggcaccgccaaauugcgcugguucguggaacgaaaccuggucaagcccgaggguaaggugauugaccucggcugugggagaggaggcuggucauauuacugcgcagggcuaaagaagguaacugaagugaaaggauauacaaagggcgguccggggcacgaggaaccaaucccuauggcuaccuacggauggaaucugguuaaacuuuacuccggcaaggauguguuuuucacucccccagagaaaugugacacacugcuaugcgauauaggcgagaguagccccaacccuaccaucgaagaggggaggacgcuccggguccugaagaugguggaaccgugguugcgcggaaaucaguuuuguauuaagauccugaaccccuauaugccaucugucguggagacccucgagcagaugcagagaaaacaugguggcaugcuuguuaggaauccucugucccgaaacucaacacacgaaauguacuggguaagcugcgggacuggaaauauugugucggccgucaacaugaccucucggauguuacugaaccguuucacaauggcccacagaaagcccacuuaugagcgcgacguggauuugggcgcggguaccaggcauguugcuguggaaccugaggucgcaaaucucgacaucauugggcaacggaucgaaaacauaaagaaugagcacaagaguacauggcauuacgaugaggacaacccauauaaaaccugggccuaccacggauccuaugaagugaagcccagcggcucagcuuccucuaugguaaauggcgugguuagacugcuaacuaagccuugggacgucauuccaauggugacgcagaucgccaugacagauaccacucccuuugggcagcaacgcguguucaaagagaaggucgacaccaggacaccgcgagcaaaacggggaacggcccagaucauggaaguuaccgcuaaguggcuuugggguuuucugagcagaaacaaaaagccuaggauuuguacucgcgaggaguucacacguaaggugcggaguaaugcggccauaggcgcaguauuuguggaugagaaccaguggaacuccgcuaaagaggccgucgaagacgagagauucugggaucucgugcacagggaacgcgagcugcauaagcaggggaaaugcgcaaccugcguuuacaacaugaugggaaagcgagagaaaaaguugggcgaguuugguaaggccaaagggagccgggcuaucugguacauguggcugggagccagauuccucgaguucgaagcgcuuggcuuuaugaaugaggaccacugguucucuagggaaaacucauuuaguggcguggagggggagggacugcauaaguuagguuauauucugcgcgauaucuccaaaauuccaggcgggaauauguacgcagacgauacugccggaugggacacaagaaucaccgaagaugacuugcaaaacgaggcuaagauaacagauaucauggaacccgagcacgcccuccuggcaacuagcauuuucaaacuaaccuaucagaauaaggucgugcggguacagaggccugcuaaaaacggcacgguuauggacgugaucucucgucgagaccagcgcgguucggggcaagucggaaccuacggccuuaacacauuuacuaauauggaagugcagcugauuagacagauggagucagagggcaucuuccucccaagcgaacuggagacccccaacuuggccgaacggguguuagauuggcuggagaagcaugggacagaaaggcucaagcgcauggcuauauccggagacgauugugucguuaaaccgguggacgauagauuugccacugcacuuauugcgcugaaugacauggguaagguacggaaagauaucccucagugggagcccaguaagggcuggaacgacuggcaacaggugccauucugcucucaccacuuucaucagcuaaucaugaaagaugggagggagauugucgugccuugucgaaaucaggacgaacugguuggacgugccagagugagccaaggcgcugguuggucccuccgcgagaccgccugcuuggggaagucauaugcacagauguggcagcugauguacuuccaccggagggaucuuagacuggcugccaacgcaauauguagugccguccccguggacuggguaccaacgucucgcacaaccuggagcauccaugcgcaccaccaauggaugacuacagaagacaugcucuccguuuggaaucggguguggauugaggaaaaccccuggauggaggauaagacccaugucucaagcugggaggaagugccuuauuuaggaaaaagggaggaccaguggugcggcucucugaucggcuugacugcucgagccaccugggcaacaaauauucagguugccaucaaccaggugagacggcugauagggaaugaaaacuaccucgauuacaugacguccaugaagagguuuaaaaaugagagugacccagagggagcucuuugguga

SEQ ID NO: 13489 - RNA, 9879 nt, Artificial Sequence
  derived and/or modified CDS sequence (opt3) from DENV-1__FJ547087__SS-prME
agcgugacaaugcugcucaugcuucugcccacagcauuggcuuuccacuuaacuacgagaggcggggaaccucauaugaucgucuccaagcaggaaagaggaaaaucucugcuguuuaagaccucagcugguguuaauaugugcacacucauugccauggaccugggcgaacuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacucuagauaucgaacuccugaaaacagaggugaccaacccugccgugcuuagaaagcugugcauugaagcuaaaaucuccaauacgaccacagacucuagguguccaacucaaggagaggccaccuuggucgaagaacaggaugcaaacuucguuugccggcgcacauuuguggaccgaggcugggguaauggguguggacucuucggcaagggcagccuguuaacuugcgcuaaguuuaaaugcguaaccaagcuggaggggaaaauagugcaguacgaaaaccucaaguauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaagaacuggacuagauuucaacgaaaugguccugcucacaaugaaagaaaagagcuggcuggugcauaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcacacagcccugacuggcgcaaccgaaauccagacgaguggaaccacaacuauuuuugccggccaucuaaagugccggcucaaaauggacaagcugacccuuaaagggaugucuuaugugauguguacaggauccuucaaguuggagaaggaagucgcugagacucagcacgguaccgugcugguucaggugaaauacgagggcacggaugcgccuugcaagauaccauucagcacacaagacgaaaaagggguaacccagaacggacgucucaucacugcaaaucccauugucacagauaaggagaaaccugugaacaucgaaaccgagccacccuuuggcgagucguauauaaugguuggugccggggaaaaggcucugaaacuuucuugguucaaaaagggcuccucaauuggaaaaauguuugaggccacugcacgcggcgccagaaggauggcuauccugggggacaccgccugggauuucggaaguaucgguggcguguuuacaagcgucgggaaguuggugcaucagguauucggaacggcauacggcgugcucuuuuccgguguuucuuggaccaugaaaauugggaucggcauucuguuaacuuggcugggacuaaauagccggucagcgagucucuccaugacauguauagcugucggcauggugacccuguaccuuggggugaugguccaggccgacagcggaugcguuaucaacuggaagggccgagaauugaagugugguucugggauuuucgugacaaacgaggugcacacuuggaccgaacaauauaaauuucaggcagauucaccgaagcgccugagugccgcuaucggaaaagccugggaggagggcguaugcgguaucagaagcgcaacgaggcucgaaaauauuauguggaagcagauauccaacgagcugaaucauaucuuacuggaaaacgacaugaaauucacagucgugguuggcgacgcuaaugggauucuugcccagggaaagaaaaugauccggccucaacccauggagcacaaguacucuuggaagucguggggcaaagcgaagauuaucggggccgauauacagaacaccacuuuuaucauugacggaccagauaccccugaaugucccgacgaucagcgcgcuuggaauaucugggagguggaggacuauggcuucgguauuuuuacaacuaacaucugguugaaacucagagauagcuacacccagaugugcgaccacaggcugauguccgcagccauaaaggauucaaaagcuguccaugccgacaugggguauuggauugaaagugagaagaaugaaacauggaagcuagcacgugcgucuuucaucgaggugaaaacguguauuuggccaaagagccacacccugugguccaacggaguucucgaaucagagaugaucauacccaaaaucuacggcgguccuauuagccaacauaauuaucggccaggcuacuucacucagacagccgggccguggcaccugggaaaacuugaguuggauuuugaccugugcgaaggcaccacugugguagucgaugagcacugcgggaaccgaggacccucuuuaagaacaaccacggugacuggcaaaaucauucaugaaugguguugcagguccuguacccucccuccacugcgcuuccggggugaggacgggugcugguacggaauggagaucagacccgugaaggaaaaggaggaaaaucuugucaggaguaugguuagcgcuggcucuggugagguggacuccuuuucacugggcauauuguguguaaguauuaugaucgaagaggugaugcgcagccgauggucgcggaaaaugcucaugacagggacccuggccgucuuccuacugcucaucaugggacagcugacuuggaacgaucuuauucguuugugcaucauggugggcgcaaaugcuuccgacagaauggggaugggaacaaccuaucuggccuuaauggcaacauuuaagaugaggccuauguucgccguuggccuccuguuucgccggcuuacuucuagagaggugcugcuacucaccauuggucugagcuuggucgcuucaguggaacugccaaacaguuuagaggaacucggggauggacuggcgaugggcauaaugaugcuuaaacuguugacggaguuccaaccccaccagcucuggacaacccugcuaucccugacuuuuaucaagaccacacuuucucucgacuacgccuggaaaacuauggcaaugguucugagcauuguguccuuguucccgcuguguuuaucaaccacgagccagaagacaaccuggcucccuguccugcuuggcaguuuugggugcaagccacugacuauguucuugaucacagaaaacaaaauuuggggaaggaagucuuggccccucaaugaggguaucauggcuauaggcaucguauccauucugcuaagcucgcugcuuaaaaacgaugugccucucgccgggccccugaucgccggaggcauguugauugcuuguuauguuaucucagguucuagugcagacuuaucccuggagaaggccgcggaagugagcugggaggaagaggcugaacauucugggaccagccacaauauacucgucgaggugcaggaugacggaacuaugaaaauuaaggaugaggaacgagacgauacacugaccauccuucugaaagccacguugcuagcaguauccggcguguacccaaugucaaucccugccacucuguuugucugguauuucuggcaaaagaagaaacagcgcaguggcguucucugggacacccccagcccaccggagguggaacgggcugugcuggaugacgggauuuacagaauacuucagaggggauuacugggucguucucaggucggcguggggguuuuccaagacggaguauuucauacaauguggcacgugacccgcggcgcaguccucauguaucaggguaagcgguuggagccuuccugggccucagugaaaaaggaucugaucaguuacgggggaggcuggagauuccagggcagcuggaacacaggggaggaaguucaggugauugcggucgagcccggcaagaauccaaagaacgugcaaacuacccccgguacguuuaagacaccugaaggcgagguaggggcuaucgcccucgacuucaaaccaggaacuuccggcucucccauugucaauagggaagguaagaucguggggcuguacggaaacggcguugugaccacaucgggcaccuaugucagcgcaauagcccaggcuaaagccucacaggaugggccucuuccggagaucgaggacgaaguguuuaagaaacgaaaucugacuauuauggauuugcacccaggauccgguaagacccggcgcuaccuacccgcaaucguuagagaggcuauuaagaggaaacugcggacacucaucuuagccccuacgcgaguggucgcgagugaaauggccgaggcacugaagggcaugccaauaagauaucaaacuaccgcugugaaaucugaacauacagggcgcgagauuguagaccuuaugugccacgccaccuucacuaugaggcugcucagccccgugcguguuccuaacuacaauaugaucaucauggaugaggcucauuuuacagacccggcauccauugccgcccggggauauaucucaaccagagucggcaugggugaagcugcggcaauauucaugacggccacucccccagggucuguggaggcuuuuccucagagcaacgccgugauucaggaugaagagagggacauccccgaacgcaguuggaacuccggauacgauuggauuacagacuucccaggcaagaccgucugguuuguaccuagcaucaaaucuggcaacgacauagcaaauuguuugcgaaagaacgggaagagagugauucagcugucacggaaaaccuucgauacugaguaucaaaagaccaagaauaaugacugggauuacguugugaccacagacaucuccgagaugggagccaacuucagggcugaucgcgucaucgacccccguagaugccucaagccagugauucugaaagaugguccggaacggguuauccuugcgggcccuaugcccgugacugucgccagugcagcucagaggcgcgggcgaauuggaagaaaucagaacaaggagggcgaccaguacguguauaugggucaaccacuaaauaacgaugaagaccacgcccauuggacggaggcaaagaugcuguuggauaauauaaacacccccgaggggaucauuccugccuuauuugaaccagagcgggagaaaagcgcugccaucgacggcgaguacaggcugcgcggagaagcgagaaagacauucguagagcucaugaggcggggcgaucugcccguguggcuuucguauaaaguugcaucugagggguuucaguacuccgaccgucgcuggugcuucgacggagaacgaaauaaccagguccuggaggaaaauauggauguggagaucuggacuaaggaaggugagaggaaaaagcucaggccucggugguuggacgcccgcaccuauagcgauccgcuggcucuaagagaguuuaaagaguucgccgcuggcaggcggucagugaguggggaccugauucucgagauaggaaaacuuccacagcaccugacaauccgagcacaaaacgccuuagauaauuuggucaugcugcacaacucugaacagggcgguaaggcuuacagacaugccauggaggaacuccccgacaccauugagacucugaugcuucuggcacucaucgcgguuuugaccgggggagugacgcuguuuuucuuauccggaaaaggccuagggaagacaagcauuggacugcucuguguaauggccucaagugcacuucuguggauggccagcguggagccucacuggaucgcagcuuccauaaucuuggaauuuuuccugaugguccuccugauucccgagccagaucgccagaggacuccucaggacaaucaacuugccuaugugguuaucggucuccuguuuaugauuuugaccguggcagccaacgaaaugggccuguuagagacaaccaaaaaggaucuagggaucggacaugucgcugcggagaaccaccaccaugccacuaugcuggacguagaucuccggcccgcaucugcuuggacacuuuacgccguggccacgaccguuauaacuccaaugaugcgucacacaauugaaaauaccaccgcaaacaucagccugacagcuauugccaaucaggcggcuaucuugaugggccuggacaaagguuggccuauauccaagauggauaucggggugccgcuccuggcccuuggcugcuacucacaggucaaccccuuaacucugacggcagccgugcucauguuggucgcucauuaugcaauuaucggaccaggccugcaagccaaggcgaccagagaggcucagaaaaggacagccgcagggauuaugaagaauccuacuguggacggaaucguugccauagaccuagaucccgugguauacgacgcuaaauucgaaaagcagcugggccagauuaugcuccuuauccuguguaccucucaaaucuugcugaugcgcacaaccugggcccucugcgagaguauuacucuggcaacggguccauuaacaacccuuugggaagggucgccuggaaaauuuuggaacacuaccaucgcugugagcauggccaauauauuccggggcuccuaucuggcgggugccggccucgcauucucucuaaugaagucacuagggggaggccgaagagggacaggagcucagggcgagacuuugggugagaaguggaaaaggcagcugaaccagcucagcaaguccgaauuuaauaccuacaaacgcagugggauuauggaggucgaucggucugaagccaaggagggacuuaaaagaggcgaaacaacgaagcacgcaguuagccgugguaccgcuaagcugaggugguucguggagcggaacuuggucaaacccgagggcaaggugaucgaccugggguguggacgcggcggguggucauauuacugcgccggacucaaaaagguaacugaagugaaaggcuauacaaagggugggccgggacaugaggaaccaauuccuauggccaccuacggcuggaauuuaguuaaacugcacuccggcaaggauguguuuuucacucccccagagaagugugacacacuucugugcgauaucggggaaaguagccccaacccuaccauagaggagggacgaacgcuaagaguccucaaaaugguggaaccguggcugagggguaaucaauuuuguaucaagauuuugaaccccuacaugccaucugucguggagacccuggaacagaugcagcggaaacacggcgggaugcucguucgcaauccucuuuccagaaacucaacacaugagauguauuggguaagcugcggaacuggcaauaucgugucggcggucaacaugaccucuaggaugcuguuaaaccgauucacaauggcucaccggaagcccacuuacgagcgugacguggaucugggugcagggaccagacauguugccguggaaccugaggucgcuaauuuggacauuaucggacagcgcauugaaaacaucaaaaaugagcacaagaguacauggcacuaugaugaagacaacccauacaagaccugggccuaucauggcuccuacgaggugaaacccagcggcucagcauccucuaugguaaauggggugguuaggcuccugacuaagccuugggacgucauaccaauggugacgcaaauugccaugacagauaccacucccuuuggacagcagcggguguucaaagagaaggucgacaccagaacaccgcgcgcuaaaagggguacggcgcaaaucauggaaguuaccgccaaguggcuauggggcuuucuuagccgaaacaagaaaccucggaucuguacuagagaggaguucacaaggaaggugcgcaguaaugcagcuauuggggccguauuuguggaugagaaccaguggaacuccgcaaaagaagccgucgaggacgagcguuucugggaucuggugcaccgggaaagagagcuccauaagcagggaaaaugcgcuaccugcguuuauaacaugaugggcaagagggaaaagaaacugggugaguuugggaaggccaaaggaagccgcgcgauaugguacaugugguugggcgcacgauuccuggaguucgaggcccucggcuuuaugaaugaggaccacugguucucucgggaaaacucacuuagugggguggagggagaaggucugcauaaguuaggcuacauccugagagauauuuccaaaaucccagggggaaauauguaugcugacgauacugccggcugggacacaaggauuaccgaggaugacuugcagaacgaggcaaagaucacagauauaauggaacccgagcacgcucuccuggccacuagcaucuuuaaacuaaccuaccaaaauaaggucgugcgcguacagagaccugcuaagaacgguacgguuauggacgugauuucucggagggaccagcgugggucgggacaggucggcaccuauggccuuaacacauucacuaauauggaagugcaacugauccgacagauggagucagaagggauuuuucucccaugugagcuggagacccccaacuuggccgaacgcguguuagauuggcuggagaaacacggagcagaaagacucaagcggauggcgaucagcggugacgauugcgucguuaaaccgauagacgauagguucgccacagcucuuauugcccugaaugacaugggcaaggugcgcaaagauaucccucagugggagcccuccaagggguggaacgacuggcagcaaguaccauuuuguagucaucacuuccaucagcuaaucaugaaggauggaagagaaauuguggucccuugccggaaucaggacgagcuggugggcagggcacgaguuucucagggugcuggguggagccuccgugagacugccuguuugggaaaauccuacgcacaaauguggcagcugauguauuuucacagacgcgaucuucggcuggccgcgaacgcuauaugcucagccgugcccgucgacugggugccaaccaguaggacgacauggucuauccacgcacaucaccaguggaugaccacugaagacaugcucagcguauggaauagaguuuggauugaggaaaaccccuggauggaggauaagacacauguguccucaugggaagaggucccuuacuuaggcaaacgcgaggaccaaugguguggcagccugaucggguugaccgcccgggcuacuugggccaccaauauucagguggcaaucaaccagguuaggcgacugauaggaaaugaaaacuaucucgauuacaugacaucuaugaagagauucaaaaaugaguccgacccagaaggugcucuuugguga

SEQ ID NO: 13490 - RNA, 9879 nt, Artificial Sequence
  derived and/or modified CDS sequence (opt3) from DENV-1__FJ410186__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagagguggaaccggacgauguagacuguuggugcaaugcgaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaagguugaaacuugggcccugaggcacccuggauucaccgugauugcuuuuuuccuggcacaugccaucggcacaucgauuacccagaagggcaucauauuuauccucuuaaugcuggucacgccaucaauggcuaugcggugcguggggauuggaaaccgcgauuucguagagggucuuagcggcgccacuuggguugacguggucuuggagcacgggaguugugugacaaccauggcgaaaaauaagcccacucuggauaucgaacuacucaaaacagaggugaccaacccugcaguccugagaaagcuuugcauugaagccaaaaucuccaauacgaccacagacucuagguguccaacucaaggagaggcuacccugguugaagagcaggaugccaacuuugugugccggcgcacauucguagaccgaggcugggguaauggguguggauuguuuggcaagggcagccuccugacuugcgcaaaguucaaaugcgugaccaaguuagaggggaaaauaguccaguacgaaaaccugaaguauuccgugauuguuacagugcacaccggagaucagcaucaagucgguaaugagacuacggaacacggcacaaucgcuaccauuacuccccaggccccuaccucagagauccagcucacagacuacggggcgcuuacccuggacuguaguccaagaacuggauuggauuuuaacgaaauggugcuacugacaaugaaagagaagagcuggcucguacauaaacagugguuccuggaccuuccgcugcccuggacgucuggcgccuccaccucacaagagacuuggaauaggcaggauuugcucguuacauuuaagaccgcacacgcuaagaaacaggaaguggucgugcuggguagccaagagggggccaugcacacagcuuuaacuggcgccaccgaaauccagacgaguggaaccacaacuauuuucgcaggccaucugaagugccggcuaaaaauggacaagcucacccugaaagggaugucuuaugucauguguacaggauccuucaagcuugagaaggaaguggccgagacucagcacgguaccguuuuggugcagguaaaauacgagggcacggaugcuccuugcaagauaccauuuagcacacaagacgaaaaaggggucacccagaacggacgucugaucacugcgaaucccauugugacagauaaggagaaaccuguuaacaucgaaaccgagccacccuucggcgagucguauauaauugugggugcaggggaaaaggcccucaagcugucuugguuuaaaaagggcuccucaaucggaaaaauguucgaggcuacugcccgcggcgcaagaaggauggccauccuuggggacaccgcuugggauuuuggaaguauugguggcgucuucacaagcguggggaagcugguacaucagguguuuggaacggccuacggcguuuuguucuccggugucucuuggaccaugaaaaucgggauuggcauacuccugacuugguuaggacugaauagccggucagcaagucuauccaugacauguaucgcggugggcauggugacccucuaccugggggucaugguucaggcugacagcggaugcgugauuaacuggaagggccgagaacuuaagugugguucugggaucuuugugacaaacgagguacacacuuggaccgaacaauauaaauuccaggccgauucaccgaagcgcuugagugcagccaucggaaaagcuugggaggagggcgucugcgguauuagaagcgccacgaggcuggaaaauauaauguggaagcagaucuccaacgagcucaaucauauucuguuagaaaacgacaugaaauuuacagugguugugggcgacgcaaaugggauccuggcucagggaaagaaaaugauucggccucaacccauggagcacaaguacucuuggaagucguggggcaaagccaagaucauaggggcggauauccagaacaccacuuucauuaucgacggaccagauaccccugaaugucccgacgaucagcgcgccuggaauauuugggaggucgaggacuauggcuuugguaucuucacaacuaacauauggcuuaaauugagagauagcuacacccagaugugcgaccacaggcucauguccgcugcaauuaaggauucaaaagccgugcaugcugacaugggguauuggaucgaaagugagaagaaugaaacauggaagcuggcccgugcaucuuucauugagguuaaaacguguaucuggccaaagagccacacccuaugguccaacggagugcuggaaucagagaugauaauccccaaaauuuacggcgguccuacuagccaacauaauuaucggccaggcuacuuuacacagaccgcggggccguggcaccucggaaagcuggagcuugauuucgacuugugcgaaggcacuacaguagucguggaugagcacugcgggaaccgaggacccucucugagaaccacgacugugaccggcaaaaucauucaugaaugguguugcagguccuguacauuaccuccacuccgcuuucggggugaggacgggugcugguacggaauggagaucagacccgucaaggaaaaggaggaaaaucugguuaggaguauggugagcgccggcucuggugagguagacuccuucucacuuggcauacugugugugaguauuaugaucgaagaggucaugcgcagccgauggucgcggaaaauguugaugaccgggacucucgcuguguuucugcuacugaucaugggacagcucacauggaacgaucugauucgucuuugcaucaugguuggcgccaaugcauccgacagaauggggaugggaaccacauauuuggcucugauggccacuuucaagaugaggccuauguuugcagugggcuuacucuuccgccggcugaccucuagagagguccuucugcuaacgauuggucucagccugguggccucaguugaauugccaaacagucuggaggaauuaggggauggacucgcuaugggcauaaugaugcugaaacuucugacagaguuucaaccccaccaguuguggaccacucuccugucccuaaccuucaucaagacaacucugucucuugacuacgcguggaaaaccauggccauggugcucagcauugucucccuguuuccguugugucugucaacgacaagccagaagaccacuugguuaccuguacuccugggcaguuucgggugcaagccacuuacaauguuucugaucaccgaaaacaaaauuuggggaaggaagucuuggcccuugaaugaggguaucauggcaauaggcaucguguccauucuccugagcucgcuacugaaaaacgauguuccucuugcugggccccucaucgccggaggcaugcugauugccuguuaugugaucucagguucuagugcugacuuguccuuagagaaggcagccgaagucagcugggaggaagaggcggaacauucugggacuagccacaauauacugguggagguacaggaugacggaacaaugaaaauuaaggaugaggaacgagacgauacccucacgauccugcuuaaagcuacucuguuggccguguccggcgucuacccaaugucaaucccugcaacccuauucguuugguauuucuggcaaaagaagaaacagcgcaguggcgugcugugggacacacccagcccaccggagguggaacgggccguccucgaugacgggauuuacagaauacugcagaggggacuuuuaggucguucucaggugggcguugggguauuucaagacggaguguuccauaccauguggcacgucacacgcggcgcugugcugauguaucaggguaagcggcucgagccuuccugggcaucaguuaaaaaggauuugaucaguuacgggggaggcuggagauuucagggccuguggaacacuggggaggaagugcaggucauugccguggagcccggaaaaaauccaaagaacguacaaaccacgcccgguacauucaagacuccugaaggcgaggucggggcgaucgcucucgacuuuaaaccaggaaccagcggcucccccauugugaauagggaagguaagaucguugggcuguacggaaacggcguggucacaaccucuggcacuuaugugucggccauagcacaggccaaagcuagccaggaggggccucuuccggagaucgaagaugagguuuucaagaaacgaaaucugaccauuauggacuugcacccaggaucagguaagacacggcgcuaccuacccgccaucgugagagaagcaauuaagaggaaacugcggacgcucaucuuagcuccuacucgagucguggccuccgagauggcggaagcccugaagggcaugccaauaagauaucaaaccacagcaguaaaaagugagcauaccgggcgcgagauuguggaucuuaugugccacgcuacuuuuacaaugaggcugcucucucccguucgugucccuaacuacaauaugaucaucauggacgaagcccauuucaccgauccggcuagcauugcagcccggggauauaucuccacgagagugggcaugggugaggccgcugcgauauuuaugacugcaacacccccagggucaguggaagccuucccucagucuaacgcugucauucaggacgaggaaagggauauccccgagcgcagcuggaauaguggauacgacuggauuaccgauuuuccaggcaagaccguaugguucgugccuuccaucaaaagcggcaacgacauagccaauuguuugcgaaagaacgggaagagaguuauucagcugucucggaaaacuuucgacacagaguaucaaaagaccaaaaacaaugauugggacuacguggucacaacugauaucucagaaaugggagcaaacuuuagggccgaccgcgugaucgauccccguagaugccucaagccaguuauucugaaagacgguccggagcgggugauccuugcuggcccuaugcccgucacgguggcguccgccgcacagaggcgcgggcgaauuggaagaaaucagaacaaggaaggcgaucaguacguauauaugggucaaccacuaaauaacgacgaggaucacgcucauuggaccgaggccaagaugcuguuggacaauauaaacacacccgaagggaucauuccugcauuauucgagccagaacgggagaaaagugccgcuaucgauggcgaauacaggcugcgcggagaggccagaaagacuuuuguggagcucaugaggcggggcgaccugcccguuuggcuuagcuauaaagucgcgucggaaggguuccaguacucugaucgucgcuggugcuuugacggagagcgaaauaaccaggugcuggaagagaauauggacguggaaaucuggaccaaggagggugagagaaaaaagcucaggccucggugguuggaugcacgcacauauuccgacccgcuggcccuaagagaauucaaagaguuugcugccggcaggcggagcgucucaggggaucugauucucgaaauaggaaagcuuccacagcaccugaccuuacgagcucaaaacgcauuggacaaucugguuaugcuccacaacagugagcagggcgguaaggccuacagacaugcuauggaagagcugcccgauacuaucgagacgcuuaugcugcucgccuugauugcagugcugaccgggggcguaacauuauucuuucuaucuggaaaaggccuggggaagacuuccaucggacuccuuugugugauggcgagcucagcccuguuguggauggcuagugucgaaccucacuggauugccgcaagcaucauacuggaguucuuucucauggugcugcuuauccccgaaccagaccgccagaggaccccucaggauaaucaacucgcuuauguugugauuggucuguuguucaugauccugacagucgccgcaaacgagaugggcuuacuagagaccacuaaaaaggaccuggggauuggacauguagccgcugaaaaccaccaccaugcgacaaugcucgauguggaccuucggcccgccuccgcauggacgcuguacgcuguugccaccacugugaucacaccaaugaugcgucacaccauagagaauaccacagccaacauuucuuugacugcaaucgcuaaucaggccgcgauucugaugggccucgauaaagguuggccuaucagcaagauggacauaggggucccgcugcuugcuuuaggcugcuacucccaggugaacccccugacgcucaccgccgcagucuugaugcugguggcccauuaugcuaucauuggaccaggccuacaagcaagagccacaagggaagcgcagaagcgcacugcugccgggaucaugaaaaauccuaccguugauggaauuguggcaaucgaccuggaccccguaguguacgaugccaaguuugagaaacagcucggccagauaaugcuucugauuuuguguacaucacaaauccugcucaugcggaccacuugggcucugugcgaaucuaucacguuagccacagguccacuuaccacucugugggaggggaguccuggaaaguucuggaacaccacaauugcagucucgauggcuaauaucuuccgaggcagcuaucucgccggugcgggccuagccuuuucccugaugaaaucuuuggggggaggcagaagggggacuggagcacagggcgagacccugggugaaaaguggaagcgccagcucaaccagcuuucaaaaagcgaguucaauacauacaagcgguccgggauaauggaaguugacagaagugaggcuaaagaaggacugaagcguggcgagacgaccaaacacgccgugucuagggguacugcaaaguugcggugguuugucgagcgcaaccuggugaagcccgaaggcaaaguaauugaucucggguguggacgaggcggguggagcuauuacugcgcuggauuaaagaaagugacagagguuaagggcuauaccaaaggugggccgggacaugaagagccaaucccuauggccacuuacggcuggaaucuggugaagcuucacucaggcaaagacgucuucuuuacacccccagaaaagugugauacccugcuaugcgacauuggggaguccagucccaacccuacgaucgaggaaggaagaacccucagggugcugaagauggucgagccgugguugcgggguaaucaauucuguauaaaaauccugaaccccuacaugccaagcgugguugaaacacucgagcagaugcagcgcaagcacggcgggaugcuuguaagaaauccucugucuaggaacuccacucaugagauguauugggugucaugcggaaccggcaauauugucagcgccgugaacaugacaucgcgaauguuacugaaccgguuuacuauggcgcaccguaaacccaccuacgaaagagauguugacuugggugcugggacacgccauguggcagucgagccugaaguggccaaucucgauaucauuggacagaggaucgagaacauuaagaaugaacacaaaucuaccuggcacuaugacgaggauaacccauacaagacuugggcuuaucauggcaguuacgagguaaagcccuccggcagcgccucauccauggugaaugggguuguccggcugcuaacgaaaccuugggacgugaucccaauggugacacaaauagcaaugaccgacacuacccccuucggacagcagagagucuuuaaggaaaaaguugauacacgcacgccgagggccaagcgagguaccgcucaaauuauggaggugacugcgaaauggcuuuggggcuuccugucucggaacaagaagccuagaaucuguacaagggaagaguuuacccgcaaaguacguagcaaugccgcaaucggggcuguguucgucgacgaaaaccaguggaauagugccaaggaggcaguggaggaugaacgguuuugggaccucguuagaagggagcgcgaacugcacaaacagggaaagugcgccacuugcguguauaacaugaugggcaaacgagagaagaaguugggugaauucgggaaagcuaagggaucccgggccauuugguacauguggcugggcgcgagauuccucgaguuugaggcacuuggcuucaugaaugaagaucauugguuuagcagggagaacucucugucaggggucgaaggagaggguuuacacaaacugggcuacauauugcgcgacaucaguaagauuccagggggaaauauguaugccgaugacacagcuggcugggauaccagaaucacagaggacgaucuccagaacgaagccaaaauuacugacaucauggagcccgaacaugcacugcuagcuaccuccauauucaagcuuacguaccaaaauaaagugguacggguucagaggccugccaagaacgguaccgugauggaugucaucagccgucgagaccagcgcgggucuggacaggugggcacauauggccugaacacuuuuaccaauauggaggugcaacucauuagacagauggaaucggaggggaucuuccugccaucagaguuggaaacacccaacuuagcugagcggguccuggacuggcucgaaaagcacggagccgagaggcuuaaacgcauggcaauuagcggugaugacuguguugugaagccgguagaugacagauuugcgacugcccugaucgcucuaaaugauaugggcaaagugcggaaggacauaccucagugggaacccuccaaaggguggaacgauuggcagcaagucccauucugcagucaccauuuucaccagcugauuaugaaggacggaagggagaucgugguuccuugucgaaaucaggaugagcucgugggccgugccagagucucucagggugcaggguggagcuugcgcgaaaccgcuugccugggaaaguccuacgcccaaauguggcagcuuauguauuuccaucggagggaccugagacucgcagccaacgcgaucuguucagcugaucccguggacuggguaccaacgagucgcacaaccuggucuauucacgcccaccaucaguggaugacuacagaggacauguuaagcguuuggaaucggguguggauagaagagaaccccuggauggaagauaaaacccacgucuccucaugggaggaggugccuuaccugggcaagagggaagaccaauggugcggcagcuugaucgggcugacugcacgagccaccugggcuacaaauauucagguugccaucaaccaggugagacggcucauuggaaaugagaacuaucuugauuacaugaucucuaugaaaagguuuaagaaugaauccgacccagagggugcacugugguga

SEQ ID NO: 13491 - RNA, 9879 nt, Artificial Sequence
  derived and/or modified CDS sequence (opt3) from DENV-1__FJ410187__SS-prME
agcgugaccaugcugcucaugcuucugcccaccgccuuggcuuuccacuuaacuacgagaggaggggagccucauaugaucgucuccaagcaggaaaggggaaaaucucuguuguuuaagaccucagcagguauuaacaugugcacacucauagccauggaccugggcgagcuuugugaagauacuaugaccuacaaaugcccacggaucacagaggcggaaccggacgauguugacuguuggugcaaugcuaccgauacuugggugacauaugggaccuguagucagacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcacuguuucucgcccaugcuaucggcaccucgauuacgcagaagggcaucauauucaucuuacugaugcuuguuacuccaucaauggccaugcggugcguggggauuggaaaccgcgauuuugucgaggguuugagcggcgcgacauggguggacguaguucuggagcacgggaguugugugaccacuauggcaaaagauaagcccacacuagacaucgaacuccugaaaaccgaggucacgaauccugccgugcuuagaaagcugugcauugaagcuaaaaucuccaacaccacaacugauucuagguguccaacccaaggagaggccacauugguggaagaacaggacagcaauuucgucugccggcgcacuuuuguugaucgaggcugggguaacggguguggacucuucggcaagggcucccuguuaaccugcgcaaaguuuaaaugcgugacaaagcuggaggggaaaauaguacaguacgaaaaucucaaguauucagugauugucaccgugcacacuggagaccagcaucaaguugguaacgagacgacagaacacggcaccaucgcuacuauuacaccccaggccccuacaagugagauccagcuuaccgacuacggggcgcugacuuuggauuguagcccaagaacaggacuagacuucaaugaaauggugcugcucacgaugaaagagaagucuuggcugguccauaaacagugguuucuugaucugccguugcccuggaccuccggcgccucaacuagccaagagacauggaacaggcaggaccuccuggugaccuucaagacagcacacgcuaagaaacaggaaguaguuguguuagguagucaagagggggccaugcacacugcucugaccggcgccacggaaauccagaccucuggaacaacuaccauuuuugcaggccaucuaaagugccggcucaaaauggauaagcugacacuuaaagggauguccuaugucauguguacuggcagcuucaaguuggagaaggaaguggccgagacccagcacgguacgguccuggugcagguuaaauacgagggcacagacgcuccuugcaagauaccauucucggcgcaagaugaaaaaggggugacccagaauggacgucucaucacugcaaaccccauuguaacagacaaggagaaaccugucaauaucgaaaccgagccacccuuuggcgagucuuauauagugguuggugccggggaaaaggcucugaaacuuuccugguucaaaaagggcucaaguauuggaaaaauguuugaggccacugcacgcggcgccagaaggauggcuauccugggggauaccgccugggacuucggaagcaucgguggcguguuuacauccgucgggaaguuggugcaucagguauucggagcagcguacggcgugcucuuuucugguguuagcuggacgaugaaaauugggaucggcauucuguuaaccuggcugggacuaaacucacggaguacuucccucagcaugacauguauagcugucggcauggugacccuguaccuuggggugaugguccaggccgauucuggaugcguuaucaauuggaagggccgagaauugaagugugguucagggauuuucgugacaaacgaggugcacacuuggaccgaacaauauaaauuucaggcagacaguccgaagcgccugagcgccgcuaucggaaaagccugggaggagggcguaugcgguaucagauccgcaacgaggcucgaaaacauuauguggaagcagauaucuaaugagcugaaccauaucuuacuggaaaaugacaugaaauucacagucgugguuggcgaugcuaacgggauucuugcccagggaaagaaaaugauccggccucaacccauggagcaccgcuacucguggaaaagcuggggcaaggcgaagauuaucggggccgacauacaaaauuccaccuuuaucauugauggaccagacacuccugaaugucccgaugaccagagagcuuggaacaucugggagguggaggauuauggcuucgguauuuuuaccacaaauaucugguugaagcucagggacucauacacucagaugugcgaucaccgucugaugagugcagccauaaaagacucuaaggcuguccaugccgauaugggguauuggauugaaagcgagaaaaacgaaaccuggaagcuagcacgggcguccuucaucgaggugaagacauguauuuggccaaaaucacacacgcuguggagcaauggaguucucgaaucugagaugaucauacccaagaucuacggcgguccuauuucccaacauaacuaucgaccaggcuacuucacccagacugccgggccguggcaccugggaaaacuugaguuggacuuugaucugugcgaaggcacaaccgugguagucgacgagcacugcgggaauagaggacccaguuuaaggacuacaaccgugacgggcaagaucauucaugaaugguguugccgcagcuguacucucccuccacugcgguucagaggugaggacgggugcugguacggaauggagaucaggcccgugaaagaaaaggaggaaaaccuuguccgcucuaugguuuccgcuggcucaggugagguggauaguuuuagccugggcauauuguguguaucgauuaugaucgaagaggugaugcgaucccgguggucucguaagaugcucaugaccgggacacuggccgucuuccuacugcucaucaugggacagcugaccuggaaugaccuuauuagauugugcaucauggugggcgcaaacgcuagcgauaggauggggaugggaacuacauaucuggccuuaauggcaaccuuuaaaaugcgcccuauguucgccguuggccuccuguuucggagacuuacaucaagggaggugcugcuacucacuauuggucugaguuuggucgcuuccguggaacugccaaauucuuuagaggaacucggggacggacuggcgaugggcauaaugaugcuuaagcuguugaccgaguuccaaccccaccagcucuggacgacacugcuaagccugaccuuuaucaaaacuacccuuucccucgauuacgccuggcgaacaauggcaaugguucugucaauugugagcuuguucccgcuguguuuaaguacuaccucucagaagacgacauggcucccuguccugcuuggcuccuuugggugcaaaccacugaccauguucuugaucacugaaaacaagauuuggggacgcaagagcuggccccucaacgaggguaucauggcuauaggcaucguaucgauucugcuaucaucucugcuuaaaaaugacgugccucucgccgggccccugaucgccggaggcauguugauugcuuguuauguuaucagugguuccagcgcagauuuaucucuggagaaggccgcggaagugagcugggaggaagaggcugaacauuccgggacaucacacaacauacucgucgaggugcaggacgauggaaccaugaaaauuaaggacgaggaacgggaugacacucugacaauccuucugaaagccaccuugcuagcaguaaguggcguguacccaaugagcaucccugccacgcuguuugucugguauuucuggcaaaagaaaaagcagagaucuggcguucucugggauacucccuccccaccggagguggaaagggcugugcuggacgacgggauuuaccguauacuucagcgcggauuacugggucggucacaggucggcguggggguuuuccaagauggaguauuucauaccauguggcacgugacaagaggcgcaguccucauguaucaggguaagagguuggagccuaguugggccagcgugaaaaaggaccugaucuccuacgggggaggcuggcgauuccagggcucuuggaauaccggggaggaaguucaggugauugcggucgagcccggcaagaacccaaagaaugugcaaacaacucccgguaccuuuaaaacgccugaaggcgagguaggggcuaucgcccucgauuucaagccaggaacaucgggcagccccauugucaaccgggaagguaagaucguggggcuguacggaaauggcguugugacuaccucaggcacauaugucuccgcaauagcccaggcuaaaaccagucaggaggggccucuuccggagaucgaagaggaaguguuuaagaaacgcaaccugacuauuauggacuugcacccaggaucugguaagaccagaagguaccuacccgccaucguucgggaggcaauuaaacgaaagcugagaacacucaucuuagcuccuacgcgcguggucgccagcgaaauggcggaggcccugaagggcaugccaauaagguaucaaacuaccgcagugaaauccgagcauacagggcgugaaauuguagaucuuaugugccacgcuaccuucacuaugcggcugcucucacccgugagaguuccuaauuacaacaugaucaucauggacgaggcccauuuuacagauccggcuucuauugcagccaggggauauaucagcacccgcgucggcaugggugaagccgcugcgauauucaugacggcaacucccccagggaguguggaggccuuuccucaguccaaugcugugauucaggacgaagaacgagauauccccgagagaagcuggaacucuggauacgacuggauuacagauuucccaggcaagaccgucugguuuguaccuucaaucaaauccggcaaugacauagccaacuguuugcggaagaaugggaaaagggugauucagcugagucgcaagaccuucgacacugaauaucaaaagacacguaacaacgauugggacuacguugugaccacagauaucagcgagaugggagcaaauuucagagccgaccgggucaucgaucccaggcgcugccucaaaccagugauucugaaggacgguccggaacgaguuauccuugcuggcccuaugcccgugacugucgcgucggccgcacagagacgggggaggauuggacgcaaccagaauaaagagggcgaucaguacguguauaugggucaaccacuaaacaaugacgaggaucacgcucauuggacggaagccaagaugcuguuggacaacauaaauacccccgaggggaucauuccugcauuauuugaaccagagagagaaaaaucugccgcuaucgauggcgaguacaggcugcggggagaggcccguaagacauucguagaacucaugcgccgaggcgaccugcccguguggcuuuccuauaagguugcgagcgagggguuucaguacucagauagaagguggugcuucgacggagaacggaacaaucagguccuggaggaaaacauggacguggagaucuggacuaaagagggugaacgcaagaaacucagaccuaggugguuggaugcacggaccuauagugacccgcuggcccuacgagaguuuaaggaguucgcugccggcagacgcucuguguccggggaucugauucucgagauaggaaaacuuccacagcaccugacauuaagggcucaaaaugcauuggacaaccuggucaugcuccacaauagcgaacagggcgguaaggccuaccggcaugcuauggaggagcugcccgauaccaucgaaacucuuaugcugcucgccuugauugcaguucugaccgggggagugacguuauuuuuccuaucaggaaaaggccuggggaagacaaguaucggacuccuuuguguaauggcgagcuccgcccuguuguggauggcuaacguggagccucacuggauugccgcaucuaucauacuggaauuuuuccucaugguccugcuuauccccgagccagaccgucagagaacuccucaggauaaucaacucgcuuaugugguuauuggucuguuguuuaugauccugaccguggccgcaaacgagaugggcuuacuagaaacaaccaagaaagaccuggggauuggacaugucgccgcugagaaccagcaccacgcgacuaugcucgauguagaccuuaggcccgccagcgcauggacacuguacgcuguggccacgaccguuaucacuccaaugaugcgccauacaauagaaaauaccaccgccaacauuuccuugacagcaaucgcuaaucaggccgcgauucugaugggccucgauaaggguuggccuaucucaaaaauggacauaggggugccgcugcuugcuuuaggcugcuacucucaagucaacccccugacucucacggccgcaguguugaugcuggucgcccacuaugcuaucauuggaccaggccuacaggcaaaggccacccgggaggcgcagaaacgaacagcugccgggaucaugaagaauccuacuguggauggaauuguugcaaucgaccuggaccccgugguauacgaugccaaguucgaaaaacagcucggccaaauaaugcuucugauuuuguguaccagucagauccugcucaugagaacaaccugggcucugugcgagucgaucacuuuagccacggguccacuuacaacccugugggaggggagcccuggaaaguuuuggaacacuaccauugcaguguccauggcuaauaucuucaggggcucuuaucucgccggugcgggccuagccuucucacugaugaaaagccuagggggaggccgccgggggacaggagcacagggcgaaacucugggugagaaguggaagagacagcucaaccaacuuuccaagagugaauuuaauaccuacaagcguucugggauaauggaggucgacaggagcgaagcuaaagagggacugaagcggggcgagacaacgaaacaugccguuucacgcgguaccgcaaaguugcgaugguucguggaaagaaaccuggucaaacccgagggcaaggugauugaucucggguguggaaggggcgggugguccuauuacugcgcuggauuaaagaaaguaacugaagugaagggcuauacaaaaggugggccgggacacgaggaaccaaucccuauggccaccuacggcuggaaucugguuaaacuuuacaguggcaaagacguguuuuucacucccccagagaagugugauacacugcuaugcgacauuggggagagcucucccaacccuaccaucgaagagggacggacgcuccgcguccugaaaaugguggaaccgugguugagagguaaucaguuuuguauaaagauccugaaccccuauaugccauccgucguggagacccucgagcagaugcagaggaagcauggcgggaugcuuguucgaaauccucugucacggaacagcacacacgaaauguacuggguaucgugcggaacuggcaauauugugucugccgucaacaugaccagucguauguuacugaacagauucacaaugacucaccgcaaacccaccuaugagagggauguggacuugggugcggggacacggcauguugcuguggaaccugaggucgcaaaucucgauaucauuggacaaagaaucgaaaacauuaagaaugagcacaaauccaccuggcauuacgacgaggauaacccauauaagacuugggccuaccacggcagcuaugaagugaaacccucaggcuccgcuucuagcaugguaaauggggugguucgccugcuaacgaagccuugggacgucaucccaauggugacacagauagccaugaccgacacuacccccuuuggacagcaaaggguguucaaggagaaagucgauacacgaacgccgcgggcaaagagagguaccgcccagauuauggaaguuacugcuaaauggcuuuggggcuuucugaguaggaacaagaaaccucgcaucuguacacgugaggaguucacccggaaggugagauccaaugcggccaucggggcaguauuuguggacgagaaccaguggaauagcgcuaaggaggccgucgaagaugagagguucugggaccucgugcaccgcgaacgagagcugcauaaacagggaaagugcgcaacuugcguuuacaacaugaugggcaaacgggaaaagaaauugggugaguuugggaaggccaagggaucuagagcuauuugguacauguggcugggcgccagguuccucgaguucgaagcgcuuggcuuuaugaaugaggaucacugguucucacgcgaaaacaguuuuuccgggguggagggagagggucugcauaaauuaggcuauauacugagagacaucagcaagauuccagggggaaauauguacgcagaugacacagccggcugggauacccggaucacagaagacgauuugcaaaacgaggcuaaaauuacugacaucauggaacccgagcacgcccuccuggcaaccucuauauucaagcuaacguaucagaauaaagucgugaggguacagcguccugcuaagaacgguaccguuauggaugugaucucgcgacgcgaccagagagggucaggacaagucggcacauacggccuuaacacuuuuaccaauauggaagugcagcugauucggcagauggagagcgaggggaucuuccucccauccgaacuggagacacccaacuuggccgaaaggguguuagacuggcuggagaaacauggaacugaacgccucaagagaauggcuauuaguggugaugacugugucguuaagccgguggaugaccgguuugccaccgcacuuaucgcgcugaaugauaugggcaaaguaaggaaggacauaccucagugggagcccucuaaaggguggaacgauuggcaacaggugccauucugcagccaccacuuucaucagcuaauuaugaaggacggacgagagaucgucgugccuugucguaaucaggaugaacugguuggcagagcccgcgugucccaaggugcuggguggucacuccgggagacggccugcuugggaaaaaguuaugcacagauguggcagcugauguacuuccacaggagagaccuucgccuggcugccaacgcaaucuguucugccguccccguggauuggguaccaacaagccggaccacuugguccauucaugcgcaccaccaauggaugacaaccgaagacaugcucucaguuuggaauaggguguggauagaggaaaaccccuggauggaggacaagacucaugucagcucuugggaggaagugccuuauuuaggcaagcgagaggaucaguggugcggcucccugaucggguugaccgcuagagccacaugggcaacgaauauucagguugccaucaaccaggugcggaggcugauuggaaaugaaaacuaccucgacuacaugaccaguaugaaacgcuuuaagaaugagagcgauccagagggugcucuuugguga

SEQ ID NO: 13492 - RNA, 9879 nt, Artificial Sequence
  derived and/or modified CDS sequence (opt3) from DENV-1__FJ478457__SS-prME
agcgugaccaugcugcucaugcuucugcccacugcauuggcuuuccacuuaacuacgaggggaggggagccucauaugaucgucuccaagcaggaaaggggaaaaucucugcucuuuaagaccucagccgguguuaacaugugcacacucauugcaauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaagguggaaacuugggcucugaggcacccuggauucaccguuauugcacuguuucucgcccaugcuaucggcacaucgauuacccagaagggcaucauauucaucuuacugaugcuugugacgccaucaauggccaugcggugcgucgggauuggaaaccgcgauuuuguggaggguuugagcggcgcgacuuggguagacguugugcuggagcacgggaguugugucacaaccauggccaagaauaagcccacuuuggauaucgaacuccugaaaacagaggugaccaacccugccgugcuuagaaagcugugcauugaagcuaaaaucuccaauacgaccacagacucuagguguccaacucaaggagaggccaccuuggucgaggaacaagaugcaaacuucguuugccggcgcacauuuguggaccgaggcugggguaauggguguggacucuucggcaagggcagccuguuaacuugcgcuaaguuuaaaugcguaaccaagcuggaggggaaaauagugcagcacgaaaaccucaaguacuccgucauugugacaguucauaccggagaucagcaccaaguggguaaugagacuacggaacauggcacaaucgccaccauuacuccccaggcgccuaccucagagauccagcuuacagacuauggggcccugaccuuggacuguaguccaagaacuggacuagauuucaacgaaaugguccugcucacaaugaaagaaaagagcuggcuggugcacaaacagugguuucuugaccugccguugcccuggacgucuggcgcauccaccucacaagagacuuggaauaggcaggaucuccugguaacauucaagaccgcucacgccaagaaacaggaaguuguggucuuagguagccaagagggggcuaugcauacagcccugacuggcgcaaccgaaauccagacgaguggaaccacaacuauuuuugccggccaccuaaagugccggcucaaaauggacaagcugacccuuaaagggaugucuuacgugauguguacaggauccuucaaguuggagaaggaagucgcugagacucagcaugguaccgugcugguucaggugaaauaugagggcacggaugcgccuugcaagauaccauucagcacacaagacgaaaaagggguaacccagaacggacgucucaucacugcaaaucccauugucacagauaaggagaaaccugugaacaucgaaaccgagccacccuuuggcgagucguacauaguugugggugccggggaaaaggcucugaaacuuucuugguucaaaaagggcuccucaauuggaaaaauguuugaggccacugcacgcggcgccagaaggauggcuauccugggggacaccgccugggauuucggaaguaucgguggcauguuuacaagcgucgggaaguuggugcaccagguauucggaacggcauauggcgugcucuuuuccgguguuucuuggaccaugaaaauugggaucggcauucuguuaacuuggcugggacuaaauagccggucaacaagucucuccaugaccuguauagcggucggcauggugacacuguaccuuggggugaugguccaggcugacagcggaugcguuaucaacuggaagggccgagaauugaagugugguucugggauuuucgugacuaacgaggugcauaccuggacggaacaauacaaauuucaggccgauucaccgaagcgccugagugcagccaucggaaaggcuugggaggagggcguaugcgguaucagaagcgccacaaggcucgaaaauauuauguggaagcagauauccaacgagcugaaucacaucuuacuggaaaacgacaugaaauucaccgucgugguuggcgacgcaucugggauucuugcucagggaaagaaaaugauccggccucaacccauggagcacaaguauucguggaaaagcuggggcaaagccaagauuaucggggcggauauacagaauacuaccuuuaucauugacggaccagauacaccugaauguuccgacgaucagcgcgccuggaacaucugggagguggaggacuacggcuucgguauuuuuacuaccaauaucugguugaaacucagagauucauauacacagaugugcgaccauaggcugaugagugcugcaauaaaggauucuaaagccguccacgcugacaugggguacuggauugaaagcgagaagaacgaaacguggaagcuagcccgugcauccuucaucgaggugaaaaccuguauuuggcccaagucacauacucuguggagcaauggaguucucgaaucugagaugaucauaccaaaaaucuauggcggucccauuucccaacacaacuaccggccuggcuauuucacacagaccgcggggccauggcaccugggaaaacuugaguuggauuuugaccugugcgaaggcacuacagugaucguagaugagcauugcgggaaucgaggaccgaguuuaagaaccacgacugucaccggcaaaauuauccacgaaugguguugcaggagcuguacacuacccccucugcgcuuccggggugaggacgggugcugguacggaauggagauaagaccagugaaggaaaaggaggaaaaccuugugaggucuauggucuccgccggcucaggugagguugacaguuuuagccugggcauuuugugugugucgaucaugaucgaagagguaaugcgcucccgauggucucggaaaaugcucaugaccgggacucuggcuguguuccuacugcucauuaugggacagcugacauggaaugaucuuauccguuugugcauuauggucggcgccaacgcaagcgacagaauggggaugggaaccacauaccuggcuuuaauggccacuuuuaagaugaggcccauguucgcagugggccuccuguuucgccggcuuaccucaagagagguucugcuacucacgauaggucugaguuugguggccuccgucgaacugccuaauucuuuagaggaacucggggauggacuggcuaugggcaucaugaugcuuaaacuguugacagaguuccaaccacaucagcucuggaccacucugcuaagccugaccuuuauuaagacaacucuuucccucgacuaugcguggaaaaccauggccauggcacugucaaucgugagcuuguucccccuguguuuaaguacgacaucucagaagaccacuuggcucccgguucugcuuggcuccuuugggugcaagccucugacaauguucuugauuaccgaaaacaaaaucuggggaagaaaguccuggccacucaacgaggguauaauggcuaucggcauugugucgauccugcuaucaucucugcuuaaaaaugaugucccccucgccgggccucugauugccggaggcauguugaucgcuuguuacguaauaagugguuccagcgcagacuuaucucuggagaaggccgcggaagugagcugggaggaagaggcugaacacuccgggacuucacauaacaugcucguugaggugcaggaugacggaacaaugaaaauuaaggaugaggaacgagacgauacccugacgauccuucugaaagccacuuugcuagcagucaguggcguguaucccaugagcaucccagccacccuguuuguaugguacuucuggcaaaagaagaaacagcgcucuggcgugcucugggacacaccuucacccccagaggucgaacgggcuguucuggaugacgggauuuauagaauacuucagaggggauuacugggucguagccaggugggcgugggggucuuccaagacggaguguuucacaccauguggcacguuacacgcggcgcaguacucauguaccaggguaagcgguuggagccgaguugggccagcgugaaaaaggaucugaucuccuaugggggaggcuggagauuccagggcucuuggaauacuggggaggaaguccaggugauugcgguugagccuggcaagaaccccaagaaugugcaaaccacgccagguacauuuaagacucccgaaggcgaggucggggcuaucgcccucgacuucaaaccuggaaccucgggcagcccaauugugaacagggaagguaagaucguagggcuguacggaaauggcgucgugacaaccucaggcacuuacguuuccgcaauagcccaggcuaaagccagucaggaggggccccuuccugagaucgaagaugagguguuucgaaagcggaaccugaccauuauggacuugcauccgggaucugguaaaacacgcagauaucuaccagcaaucgucagggaagcuauuaagcggaagcugcgaacgcucaucuuagcccccacuagagugguugcgagcgagauggccgaagcacugaaaggcaugccuauacgcuaccaaaccacagcugugaaguccgagcacaccgggagggagauugucgaucuuaugugccaugccacuuucacaaugcgucugcucucaccagugcggguacccaauuauaacaugaucaucauggacgaagcucacuuuaccgauccugcaucuauugccgccagaggauacaucagcacgagggugggcaugggugaggcugcggcaauauucaugacugccacaccgcccgggaguguugaggcuuuuccacaguccaaugccgucauucaggacgaagaacgcgauaucccugagcgaagcuggaacucuggauaugacuggauuaccgauuuccccggcaaaaccgugugguuugugccaucaaucaaguccggcaaugacauagcaaacuguuugaggaagaaugggaagcgggucauucagcugaguaggaagacuuucgacacagaguaccagaaaaccaagaacaacgauugggacuauguagugacaacugauaucagcgaaaugggagccaauuuccgcgcugaccguguuaucgauccuagacggugccucaaacccgugauucugaaggacgguccagagagggucauccuugcgggcccgaugccugugacgguugccucggcagcucagcgccgagggagaauuggacggaaccagaauaaagaaggcgaucaguacguguacaugggucaaccccuaaacaaugacgaggaucaugcccacuggaccgaggcaaagaugcuguuggacaacauaaauacaccagaagggaucauucccgccuuauuugagccugaaagggagaagucugcugccaucgauggcgaauaucgccugagaggagaggcgaggaaaacuuucgucgagcucaugcggcguggcgaccugccaguguggcuuuccuacaagguagcaagcgaaggguuucaguauucagaucgccgauggugcuucgacggagagagaaacaaucaggugcuggaagagaacauggacguugaaaucuggaccaaagagggugagaggaagaaacuccggccccgcugguuggaugccagaacauacagugacccucuggcucuaagggaauuuaaggaguucgccgcuggccggcgaucugucuccggggaucugauucucgaaauaggaaaacuuccgcagcaccugaccuuaagagcacaaaaugccuuggacaaccuggugaugcuccauaauagcgagcagggcgguaaggcuuaucgccacgccauggaggagcugccagauacuaucgagacgcuuaugcugcucgcauugauugcggugcugaccgggggcgucacauuauuuuuccuaucaggaaagggccuggggaaaacaaguaucggacuccuuuguguuauggccagcuccgcucuguuguggauggccucuguggaaccccauuggauugcagcuagcaucauacuggaguuuuuccucaugguacugcuuaucccugaacccgacaggcagcggaccccacaggauaaccaacucgccuacguggucauuggucuguuguuuaugauccugacaguggcagccaaugagaugggcuuacuagagaccacuaagaaagaccuggggauuggacacguugcugcggaaaaccaccaucacgccacaaugcucgauguggaccuucguccugcauccgcuuggacgcuguaugccgucgccaccacuguaaucacacccaugaugagacauaccauagagaacaccacagcaaauauuucauugacugcuaucgccaaccaggcggcuauucugaugggccucgauaaggguuggccaaucucuaaaauggacauaggggugccucugcuugccuuaggcugcuacagucagguuaauccgcugacgcucaccgcagccguguugaugcuggucgcucacuacgcaaucauuggacccggccuacaagccaaggcgacaagggaagcucagaagcgcacugccgcagggaucaugaaaaacccaaccguggauggaauugucgccaucgaccuggacccugugguuuaugaugcuaaguucgagaaacagcucggccagauaaugcuucugauuuuguguacaucgcaaauccugcucaugcggaccacuugggcccugugcgaaagcaucacguuagcaacagguccccuuaccacucugugggagggguccccaggaaaguuuuggaauaccacaauugcugugucuauggccaacaucuuccgaggcucauaccucgcgggugccggccuagcauucagccugaugaaaucccuagggggaggcagaagggggacuggagcucagggcgagacccugggugaaaaguggaagcgccagcucaaucagcuuaguaaaucugaguuuaacacauauaagcggagcgggauaauggaaguagacagaucagaggccaaagaaggacugaagcguggcgagacgaccaaacaugcaguguccagggguacugcuaaguugcggugguucgucgagcgcaaucugguuaagccugaaggcaaagugauugaucucggguguggacgaggcggguggaguuacuauugcgccggauuaaagaaagucacagaggugaagggcuacaccaaaggugggcccggacacgaggagccgaucccaauggccacuuauggcuggaaccugguaaaacuucacagcggcaaagacguguuuuucacaccucccgaaaagugugauacccugcuaugcgacauuggggagucuuccccaaaucccacgaucgaggaaggaagaacccucaggguucugaagaugguggagccuugguugcgggguaaccaauuuuguauaaaaauccugaauccguacaugcccucagucguggaaacacucgagcagaugcagcgcaagcauggcgggaugcuugucagaaacccacugagcagaaauucgacucacgagauguacugggugucuugcggaaccggcaacauuguuagugcgguaaauaugacaucccgaauguuacugaaccgguucacuauggcucaucguaaaccuaccuaugaaagagauguggacuugggugcagggacacgccacgucgccguggagcccgaaguugcuaaccucgauaucauuggacagaggaucgagaauauuaagaacgaacacaaaagcaccuggcauuacgacgaggauaauccuuauaagacuugggccuaccacggcucauaugaggugaagccauccggcucugcaagcaguauggucaacggggugguacggcugcuaacgaaacccugggacgugaucccuaugguuacacaaauagccaugaccgacacuaccccauuuggacagcagagagucuucaaggaaaaaguggauacacgcacgcccagggcuaagcgagguaccgcgcaagugauggaggucacugccaaauggcuuuggggcuuucugucccggaauaagaagccgagaauuuguacaagggaagaguucacccgcaaaguucguagcaacgcagcuaucggggccguguuuguagacgaaaaucaguggaacucugcaaaggaggccguggaggaugaaaaauucugggaccucguccaucgggagagagaacugcacaagcagggaaaaugcgcuacuugcguguacaauaugaugggcaagagggagaagaaauugggugaauuugggaaggccaaaggaucacgcgcgaucugguauauguggcugggcgcacgauuccucgaguucgaggcccuuggcuuuaugaacgaagaucauugguucagucgggaaaauucccugagcgggguugaaggagaggguuuacacaagcugggcuacauuuugagagacauaucuaaaaucccugggggaaacauguacgcugaugacacagccggcugggauaccaggauuacagaggacgaucuccagaaugaagcaaagaucacugacauuauggagccagaacacgcucugcuagccaccucgaucuuuaaacuuacguaucaaaacaaggugguccgcgugcagagacccgcuaagaaugguaccguaauggauguuauaucacggagggaccagcgugggagcggacaggugggcacauacggccugaacacuuucaccaacauggagguccaacucauccgacagauggaauccgaggggauuuuucugccuagugaguuggaaacaccaaauuuagccgagcgcgugcuggacuggcucgaaaaacauggaacugagagacuuaagcggauggcaaucucuggugaugacuguguggucaaacccauugaugacagguucgcgaccgcccugaucgcucuaaacgauaugggcaagguucgcaaagacauaccgcagugggaaccuagcaagggguggaaugaguggcagcaagugcccuuuugcucccaccauuuccaccagcugauuaugaaggauggaagagagaucguagugccaugucggaaccaggacgaacucgucggcagggcccgagugucacagggugcaggguggaguuugcgugagacggcuugccugggaaaaucuuaugcccaaauguggcagcuuauguacuuucacagacgcgaucugcggcucgcagccaaugcgaucuguagcgcuguuccuguggacuggguccccacauccaggaccacuuggucaauucaugcccaccaucaguggaugacaaccgaagauauguuaagcguguggaacagaguauggauagaggaaaauccauggauggaggacaagacucacguuucuuccugggaggaagugcccuaucugggcaaacgcgaggaccaauggugcggcaguuugaucgggcugaccgcacgggccacaugggcuacgaacauucaggucgccaucaaucaggugaggcgacucauuggaaacgaaaauuaccuugauuauaugaccagcaugaagagauucaaaaacgagucggacccugagggugcacugugguga

SEQ ID NO: 13493 - RNA, 9879 nt, Artificial Sequence
  derived and/or modified CDS sequence (opt3) from DENV-1__FJ410188__SS-prME
agcgugaccaugcugcucaugcuucugcccacugucuuggccuuccacuuaacuacgaggggaggggagccucauaugaucguuuccaagcaggaaaggggaaaaucucugcucuuuaagaccucagcuggugugaacaugugcacacucauugccauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggcaccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguugaggguuugagcggcgccacuuggguugacgugguccuggagcacgggaguugugugacaaccauggcgaaaaauaagcccacuuuggauaucgaacuccugaaaacagaggugaccaacccugcaguccuuagaaagcugugcauugaagccaaaaucuccaauacgaccacagacucuagguguccaacucaaggagaggcuaccuugguugaggaacaagaugccaacuucgugugccggcgcacauuuguagaccgaggcugggguaauggguguggacucuucggcaagggcagccuguuaacuugcgcaaaguuuaaaugcgugaccaagcuggaggggaaaauaguccagcacgaaaaccucaaguacuccgugauuguuacagugcauaccggagaucagcaccaagucgguaaugagacuacggaacauggcacaaucgcuaccauuacuccccaggccccuaccucagagauccagcuuacagacuauggggcgcugaccuuggacuguaguccaagaacuggacuagauuucaacgaaauggugcugcucacaaugaaagaaaagagcuggcugguacacaaacagugguuucuugaccugccguugcccuggacgucuggcgccuccaccucacaagagacuuggaauaggcaggaucuccugguuacauucaagaccgcacacgcuaagaaacaggaaguggucguguuagguagccaagagggggccaugcauacagcucugacuggcgccaccgaaauccagacgaguggaaccacaacuauuuuugcaggccaccuaaagugccggcucaaaauggacaagcugacccuuaaagggaugucuuacgucauguguacaggauccuucaaguuggagaaggaaguggccgagacucagcaugguaccguucuggugcagguaaaauaugagggcacggaugcuccuugcaagauaccauucagcacacaagacgaaaaaggggucacccagaacggacgucucaucacugcgaaucccauugugacagauaaggagaaaccuguuaacaucgaaaccgagccacccuuuggcgagucguacauaguggucggugcaggggaaaaggcccugaaacuuucuugguucaaaaagggcuccucaauuggaaaaauguuugaggcuacugcccgcggcgcaagaaggauggccauccugggggacaccgcuugggauuucggaaguaucgguggcauguuuacaagcguggggaaguugguacaccagguguucggaacggccuauggcguucucuuuuccggugucucuuggaccaugaaaauugggaucggcauucuguuaacuuggcugggacuaaauagccggucaacaagucucuccaugaccuguauagcagugggcauggugacacuguaccuuggggucaugguucaggcggacagcggaugcgugaucaacuggaagggccgagaauugaagugugguucugggauuuucgugacuaacgagguacauaccuggacggaacaauacaaauuucaggcugauucaccgaagcgccugagugccgcaaucggaaaagccugggaggagggcgucugcgguaucagaagcgcuacaaggcucgaaaauauuauguggaagcagauauccaacgagcugaaucacaucuuacuggaaaacgacaugaaauucaccgugguugugggcgacgccucugggauucuugcacagggaaagaaaaugauccggccucaacccauggagcacaaguauucguggaaaagcuggggcaaggcuaagauuaucggggccgauauacagaauacuaccuuuaucauugacggaccagauacaccugaauguuccgacgaucagcgcgcguggaacaucugggaggucgaggacuacggcuucgguauuuuuacuaccaauaucugguugaaacucagagauucauauacacagaugugcgaccauaggcugaugagugccgcuauaaaggauucuaaagcagugcacgccgacaugggguacuggauugaaagcgagaagaacgaaacguggaagcuagcucgugccuccuucaucgagguuaaaaccuguauuuggcccaagucacauacucuguggagcaauggagugcucgaaucugagaugaucauaccaaaaaucuauggcggucccauuucccaacacaacuaccggccuggcuauuucacacagaccgcagggccauggcaccugggaaaacuugaguuggauuuugaccugugcgaaggcacuacaguaaucgucgaugagcauugcgggaaucgaggaccgaguuuaagaaccacgacugugaccggcaaaauuauccacgaaugguguugcaggagcuguacacuacccccucugcgcuuccggggugaggacgggugcugguacggaauggagauaagaccagugaaggaaaaggaggaaaaccuugucaggucuaugguuuccgcgggcucaggugagguggacaguuuuagccugggcauuuuguguguaucgaucaugaucgaagaggugaugcgcucccgauggucucggaaaaugcucaugaccgggacucuggccgucuuccuacugcucauuaugggacagcugacauggaaugaucuuauccguuugugcauuauggugggcgcuaacgccagcgacagaauggggaugggaaccacauaccuggcauuaauggcuacuuuuaagaugaggcccauguucgccguuggccuccuguuucgccggcuuaccucaagagaggugcugcuacucacgauaggucugaguuuggucgcauccguggaacugccuaauucuuuagaggaacucggggauggacuggccaugggcaucaugaugcuuaaacuguugacagaguuccaaccacaucagcucuggaccacucugcuaagccugaccuuuauuaagacaacucuuucccucgacuaugcuuggaaaaccauggcgauggcccugucaaucguuagcuuguucccccuguguuuaaguacgacaucucagaagaccacuuggcucccggugcugcuuggcuccuuugggugcaagccucugacaauguucuugauuaccgaaaacaaaaucuggggaagaaaguccuggccacucaacgaggguauaauggcaaucggcauugucucgauccugcuaucaucucugcuuaaaaaugauguaccccucgcugggccucugauugccggaggcauguugaucgccuguuacgugauaagugguuccagcgcugacuuaucucuggagaaggcagccgaaguuagcugggaggaagaggcggaacacuccgggacuucacauaacaugcucguggagguccaggaugacggaacaaugaaaauuaaggaugaggaacgagacgauacccugacgauccuucugaaagcuacuuugcuagccgugaguggcguauaucccaugagcaucccagcaacccuguuugugugguacuucuggcaaaagaagaaacagcgcucuggcguccucugggacacaccuucacccccagagguugaacgggccgugcuggaugacgggauuuauagaauacuucagaggggauuacugggucguagccaggugggcgucgggguguuccaagacggaguuuuucacaccauguggcacguaacacgcggcgcugugcucauguaccaggguaagcgguuggagccgaguugggcaagcgucaaaaaggaucugaucuccuaugggggaggcuggagauuccagggcucuuggaauacuggggaggaagugcagguuauugccguggagccuggcaagaaccccaagaauguccaaaccacgccagguacauuuaagacucccgaaggcgaggugggggcgaucgcucucgacuucaaaccuggaaccucgggcagcccaauuguaaacagggaagguaagaucgucgggcuguacggaaauggcgugguuacaaccucaggcacuuacguguccgccauagcacaggccaaagcuagucaggaggggccccuuccugagaucgaagaugaggucuuucgaaagcggaaccugaccauuauggacuugcauccgggaucugguaaaacacgcagauaucuaccagccaucgugagggaagcaauuaagcggaagcugcgaacgcucaucuuagcucccacuagaguuguggccagcgagauggcggaagcccugaaaggcaugccuauacgcuaccaaaccacagcagucaaguccgagcacaccgggagggagauuguggaucuuaugugccaugcuacuuucacaaugcgucugcucucaccaguacgggugcccaauuauaacaugaucaucauggacgaagcccacuuuaccgauccugcuucuauugcagccagaggauacaucagcacgaggguuggcaugggugaggccgcugcgauauucaugacugcaacaccgcccgggagugucgaagccuuuccacaguccaaugcugugauucaggacgaggaacgcgauaucccugagcgaagcuggaacucuggauaugacuggauuaccgauuuccccggcaaaaccgugugguuugucccaucaaucaaguccggcaaugacauagccaacuguuugaggaagaaugggaagcggguaauucagcugaguaggaagacuuucgacacagaguaccagaagaccaagaacaacgauugggacuaugugguuacaacugauaucagcgaaaugggagcaaauuuccgcgccgaccgugugaucgauccuagacggugccucaaacccgucauucugaaggacgguccagagagggugauccuugcuggcccgaugccuguuacgguggcgucggccgcacagcgccgagggagaauuggacggaaccagaauaaagaaggcgaucaguacgucuacaugggucaaccccuaaacaaugacgaggaucaugcucacuggaccgaggccaagaugcuguuggacaacauaaauacaccagaagggaucauucccgcauuauuugagccugaaagggagaagucugccgcuaucgauggcgaauaucgccugagaggagaggccaggaaaacuuucguggagcucaugcggcguggcgaccugccaguauggcuuuccuacaagguggcgagcgaaggguuucaguauucagaucgccgauggugcuucgacggagagagaaacaaucagguucuggaagagaacauggacgucgaaaucuggaccaaagagggugagaggaagaaacuccggccccgcugguuggaugcaagaacauacagugacccucuggcccuaagggaauuuaaggaguucgcugccggccggcgaucuguguccggggaucugauucucgaaauaggaaaacuuccgcagcaccugaccuuaagagcucaaaaugcauuggacaaccuggugaugcuccauaauagcgagcagggcgguaaggccuaucgccacgcuauggaggagcugccagauacuaucgagacgcuuaugcugcucgccuugauugcaguccugaccgggggcguuacauuauuuuuccuaucaggaaagggccuggggaaaacaaguaucggacuccuuugugugauggcgagcuccgcccuguuguggauggcuucuguagaaccccauuggauugccgcaagcaucauacuggaguuuuuccucauggugcugcuuaucccugaacccgacaggcagcggaccccacaggauaaccaacucgcuuacgucgugauuggucuguuguuuaugauccugacaguugccgcaaaugagaugggcuuacuagagaccacuaagaaagaccuggggauuggacacguggccgcugaaaaccaccaucacgcgacaaugcucgaugucgaccuucguccugccuccgcauggacgcuguaugcuguagccaccacugugaucacacccaugaugagacauaccauagagaacaccacagccaauauuucauugacugcaaucgcuaaccaggccgcgauucugaugggccucgauaaggguuggccaaucucuaaaauggacauagggguuccucugcuugcuuuaggcugcuacagucaggugaauccgcugacgcucaccgccgcagucuugaugcugguggcccacuacgcuaucauuggacccggccuacaagcaaaggccacaagggaagcgcagaagcgcacugcugccgggaucaugaaaaacccaaccgucgauggaauuguggcaaucgaccuggacccuguuguguaugaugccaaguucgagaaacagcucggccagauaaugcuucugauuuuguguacaucgcaaauccugcucaugcggaccacuugggcucugugcgaaagcaucacguuagccacagguccccuuaccacucugugggagggguccccaggaaaguuuuggaauaccacaauugcaguaucuauggcuaacaucuuccgaggcucauaccucgccggugcgggccuagccuucagccugaugaaaucccuagggggaggcagaagggggacuggagcacagggcgagacccugggugaaaaguggaagcgccagcucaaucagcuuaguaaaucugaguuuaacacauauaagcggagcgggauaauggaaguggacagaucagaggcuaaagaaggacugaagcguggcgagacgaccaaacaugccgucuccagggguacugcaaaguugcggugguucguugagcgcaaucuggugaagccugaaggcaaagucauugaucucggguguggacgaggcggguggaguuacuauugcgcuggauuaaagaaagugacagagguaaagggcuacaccaaaggugggcccggacacgaggagccgaucccaauggccacuuauggcuggaaccuggugaaacuucacagcggcaaagacguauuuuucacaccucccgaaaagugugauacccugcuaugcgacauuggggagucuuccccaaaucccacgaucgaggaaggaagaacccucagggugcugaagauggucgagccuugguugcgggguaaccaauuuuguauaaaaauccugaauccguacaugcccucaguggucgaaacacucgagcagaugcagcgcaagcauggcgggaugcuugugagaaacccacugagcagaaauucgacucacgagauguacuggguuucuugcggaaccggcaacauuguaagugccgugaauaugacaucccgaauguuacugaaccgguucacuauggcgcaucguaaaccuaccuaugaaagagaugucgacuugggugcugggacacgccacguggcaguugagcccgaaguggccaaccucgauaucauuggacagaggaucgagaauauuaagaacgaacacaaaagcaccuggcauuacgacgaggauaauccuuauaagacuugggcuuaccacggcucauaugaggucaagccauccggcucugccagcaguauggugaacgggguagugcggcugcuaacgaaacccugggacguuaucccuauggucacacaaauagcaaugaccgacacuaccccauuuggacagcagagaguguucaaggaaaaaguggauacacgcacgcccagggccaagcgagguaccgcucaagucauggagguuacugcgaaauggcuuuggggcuuucugucccggaauaagaagccgagaauuuguacaagggaagaguucacccgcaaagugcguagcaacgccgcaaucggggcuguauuuguggacgaaaaucaguggaacucugccaaggaggcagucgaggaugaaaaauucugggaccucgugcaucgggagagagaacugcacaagcagggaaaaugcgccacuugcguuuacaauaugaugggcaagagggagaagaaauugggugaauuugggaaggcuaaaggaucacgcgccaucugguauauguggcugggcgcgcgauuccucgaguucgaggcacuuggcuuuaugaacgaagaucauugguucagucgggaaaauucccugagcgggguggaaggagaggguuuacacaagcugggcuacauuuugagagacauaucuaaaaucccugggggaaacauguacgccgaugacacagcuggcugggauaccaggauuacagaggacgaucuccagaaugaagccaagaucacugacauuauggagccagaacacgcacugcuagcuaccucgaucuuuaaacuuacguaucaaaacaaggucgugcgcguacagagacccgccaagaaugguaccguuauggaugugauaucacggagggaccagcgugggagcggacaggucggcacauacggccugaacacuuucaccaacauggaggugcaacucauccgacagauggaauccgaggggauuuuucugccuagugaguuggaaacaccaaauuuagcugagcgcgugcuggacuggcucgaaaaacauggaacugagagacuuaagcggauggccaucucuggugaugacugugucguuaaacccauugaugacagguucgcaaccgcgcugaucgcccuaaacgauaugggcaaggugcgcaaagacauaccgcagugggaaccuagcaagggguggaaugaguggcagcaaguacccuuuugcucccaccauuuccaccagcugauuaugaaggauggaagagagaucguggucccaugucggaaccaggacgaacucgugggcagggcucgaguuucacagggugccggguggaguuugcgugagacggcaugccugggaaaaucuuaugcucaaauguggcagcuuauguacuuucacagacgcgaucugcggcucgccgcaaaugccaucuguagcgcggugccugucgacugggugcccacauccaggaccacuuggucaauucaugcucaccaucaguggaugacaaccgaagauauguuaagcguauggaacagaguuuggauagaggaaaauccauggauggaggacaagacucacgugucuuccugggaggaaguccccuaucugggcaaacgcgaggaccaauggugcggcaguuugaucgggcugaccgcccgggcaacaugggccacgaacauucagguggcuaucaaucagguuaggcgacucauuggaaacgaaaauuaccuugauuauaugaccagcaugaagagauucaaaaacgagucggacccugagggugcccugugguga

SEQ ID NO: 13494 - RNA, 9879 nt, Artificial Sequence
  derived and/or modified CDS sequence (opt3) from DENV-1__FJ478458__SS-prME
agcgugaccaugcugcucaugcuucugcccaccgccuuggcuuuccacuuaacuacgagaggaggggaaccucauaugaucgucuccaagcaggaaaggggaaaaucucuguuauuuaagaccucagcagguauuaacaugugcacacucauagccauggaccugggagagcuuugugaagauacuaugaccuacaaaugcccacggaucacagaggcggaaccggacgauguugacuguuggugcaaugcuaccgauacuugggugacauaugggaccuguagucaaacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcacuguuucucgcccaugcuaucggcaccucgauuacgcagaagggcaucauauucaucuuacugaugcuuguuacuccaucaauggccaugcggugcguggggauuggaaaccgcgauuuugucgaggguuugagcggcgcgacauggguggacguaguucuggagcacgggaguugugugaccacuauggcaaaagauaagcccacauuggacaucgaacuccugaaaaccgaggucacgaauccugccauucuuagaaagcugugcaucgaagcuaaaauauccaacaccacaacugauucuagguguccaacccaaggagaggccacauugguggaagaacaggacagcaauuucgugugccggcgcacuuuugucgaucgaggcugggguaacggguguggacucuucggcaagggcucccuguuaaccugcgcaaaguuuaaaugcguuacaaagcuggaggggaaaauugugcaguacgaaaaucucaaguauucaguaaucgugaccguccacacuggagaccagcaucaaguggguaacgagacgacagaacacggcaccauugcuacuaucacaccccaggccccuacaagugagauccagcuuaccgacuacggggcgcugacuuuggauuguagcccaagaacaggacuagacuucaaugaaaugguucugcucacgaugaaagagaagucuuggcuggugcauaaacagugguuucuugaucugccguugcccuggaccuccggcgccucaacuagccaagagacauggaacaggcaggaccuccuggucaccuucaagacagcacacgcuaagaaacaggaagugguaguuuuagguagucaagagggggccaugcacacugcucugaccggcgccacggaaauucagaccucuggaacaacuaccauauuugcaggccaucuaaagugccggcucaaaauggauaagcugacacuuaaagggauguccuaugugauguguacuggcagcuucaaguuggagaaggaagucgccgagacccagcacgguacggugcugguccaggugaaauacgagggcacagacgcuccuugcaagaucccauucucggcgcaagaugaaaaagggguuacccagaauggacgucucauuacugcaaaccccaucgugacagacaaggagaaaccuguaaauauagaaaccgagccacccuuuggcgagucuuauauugucgugggugccggggaaaaggcucugaaacuuuccugguucaaaaagggcucaaguaucggaaaaauguuugaggccacugcacgcggcgccagaaggauggcuauccugggggauaccgccugggacuucggaagcauugguggcguuuuuacauccguggggaaguugguccaucagguguucggagcagcguacggcguacucuuuucuggugugagcuggacgaugaaaaucgggauuggcauacuguuaaccuggcugggacuaaacucacggaguacuucccucagcaugacauguaucgcuguuggcauggucacccuguaccuuggggugauggugcaggccgauucuggaugcgucauuaauuggaagggccgagaauugaagugugguucagggaucuucguuacaaacgaggugcacacuuggaccgaacaauauaaauuucaggcagacaguccgaagcgccugagcgccgcuaucggaaaagccugggaggagggcgugugcgguauuagauccgcaacgaggcucgaaaacauaauguggaagcagaucucuaaugagcugaaccauauuuuacuggaaaaugacaugaaauucacaguagucgugggcgaugcuaacgggauccuugcccagggaaagaaaaugauucggccucaacccauggagcaccgcuacucguggaaaagcuggggcaaggcgaaaaucauaggggccgacauccagaauaccacuuuuauuaucgauggaccagacaccccugaaugucccgaugaccagagagcuuggaacauuugggagguugaggauuauggcuucgguaucuuuacaacuaauauaugguugaagcucagggacuccuacacccagaugugcgaucaccgucugaugucagcagccauuaaagacaguaaggcugugcaugccgauaugggguauuggaucgaaucugagaaaaacgaaacauggaagcuagcacgggcgagcuucauugaggucaagacguguaucuggccaaaaucccacacccuguggucaaauggagugcucgaaagcgagaugauaauccccaagauuuacggcgguccuaucucucaacauaacuaucgaccaggcuacuucacucagacagccgggccguggcaccugggaaaacuugaguuggacuuugaucugugcgaaggcaccacuguugugguagacgagcacugcgggaauagaggacccuccuuaaggacaaccacggucacuggcaagauuauccaugaaugguguugccgcaguuguacccucccuccacugcgguucagaggugaggacgggugcugguacggaauggagauaaggcccgugaaagaaaaggaggaaaaccuugugcgcagcauggucucugcuggcuccggugagguugauucauuuagucugggcauuuugugugugagcaucaugaucgaagagguaaugcgaucgcgguggucccguaagaugcucaugacagggacccuggccguguuccuacugcucauuaugggacagcugacuuggaaugaccuuaucagauugugcauuauggucggcgcaaacgcuucugauaggauggggaugggaacaaccuaucuggccuuaauggcaacauuuaaaaugcgcccuauguucgccgugggccuccuguuucggagacuuacuagcagggagguucugcuacucaccauaggucugucauugguggcuagugucgaacugccaaauuccuuagaggaacucggggacggacuggcgaugggcaucaugaugcuuaagcuguugacggaguuccaaccccaccagcucuggacaacccugcuaucucugacuuuuauuaaaaccacacuuagccucgauuacgccuggcgaacuauggcaauggugcuguccaucgcuucauuguucccgcuguguuuaagcaccacgagucagaagacaaccuggcucccuguucugcuuggcucuuuugggugcaaaccacugacuauguucuugauuacagaaaacaagaucuggggacgcaaguccuggccccucaacgaggguauaauggccaucggcauugugagcauccugcuaucgucacugcuuaaaaaugacgucccucucgccgggccccugauugcuggaggcauguugaucgcauguuauguaauaucugguaguuccgccgauuuaagccuggagaaggcggcugaagugucuugggaggaagaggccgaacauagcgggaccucccacaacauucucguugaggugcaggacgauggaacuaugaaaaucaaggacgaggaacgggaugacacacugaccauccuucugaaagcaacguugcuagccgucucaggcguguacccaaugaguauuccugcuacucuguuuguaugguauuucuggcaaaagaaaaagcagagaagcggcgugcucugggauacccccucuccaccggaggucgaaagggcaguucuggacgacgggauauaccguauccuucagcgcggauuacugggucggucccaggugggcgugggggucuuccaagauggaguguuucauacaauguggcacguuaccagaggcgccguacucauguaucaggguaagagguuggagccuucaugggcgagugugaaaaaggaccugauuagcuacgggggaggcuggcgauuccagggcuccuggaauacaggggaggaaguccaggugaucgcuguugagcccggcaagaauccaaagaaugugcaaacuacccccgguacguuuaaaacaccugaaggcgaggucggggccauugcacucgauuucaagccaggaacuucuggcucgcccaucgugaaccgggaagguaagauaguagggcuguacggaaauggcgucgugaccacaagcggcaccuauguuucagccaucgcucaggccaaaacuucccaggaggggccucuuccggagauugaagaggaaguguuuaagaaacgcaaccugaccaucauggacuugcacccaggaagugguaagacaagaagguaccuacccgcaauuguccgggaggcuaucaaacgaaagcugagaacgcucauauuagccccuacucgcgugguugcgucugaaauggccgaggcacugaagggcaugccaauuagguaucaaaccacagcugugaaaagcgagcauaccgggcgugaaaucgucgaucuuaugugccacgccacuuucacaaugcggcugcucucccccgugagaguaccuaauuacaacaugaucauuauggacgaggcucauuuuaccgauccggcaucaaucgccgccaggggauauauaucuacgcgcgugggcaugggugaagcugcggcaauuuucaugacugccacacccccagggagcguugaggcuuuuccucagaguaaugccgucauccaggacgaagaacgagauauucccgagagauccuggaacagcggauacgacuggaucaccgauuucccaggcaagaccgugugguuugugccuucuauaaaaucaggcaaugacauugcaaacuguuugcggaagaaugggaaaagggucauccagcugucccgcaagacuuucgacacagaauaucaaaagaccaaaaacaacgauugggacuacguagugacaacugauaucagugagaugggagccaauuuccgugcugacagaguuauugauccccggaggugccucaagccagugauccugaaagacgguccggaacgcgucauucuugcgggcccuaugcccgugacgguugccagcgcagcucagcgaagagggcggauaggaaggaaccagaauaaggagggcgaucaguacguguauaugggucaaccacuaaacaaugacgaggaucacgcccauuggaccgaagcaaaaaugcuguuggacaacaucaauacacccgaggggauuaucccugccuuauuugaaccagagcgcgaaaagucggcugccaucgauggcgaguacagacugaggggagaggcgcggaagacuuucgucgaacucaugcgucgcggcgaccugcccguguggcuuucuuauaaaguagcauccgagggguuucaguacagcgaucgaagauggugcuucgacggagaaaggaacaaucaggugcuggaggaaaacauggacguugagauuuggaccaaggagggugaacggaaaaagcuccgcccuagaugguuggaugccaggacauauucagacccgcuggcucuacgggaguuuaaagaguucgccgcuggccgaagaagugucucuggggaucugauacucgagaucggaaaacuuccacagcaccugaccuuacgcgcacaaaaugccuuggacaaccuggugaugcuccacaauuccgaacagggcgguaaggcuuacaggcaugccauggaggagcugcccgauacuauugaaacgcuuaugcugcucgcauugaucgcggugcugaccgggggcgucacauuauuuuuccuaagcggaaagggccuggggaagacuucaauuggacuccuuuguguuauggccaguagcgcucuguuguggauggccaacguggagccucacuggaucgcagcuuccauaauccuggaauuuuuccucaugguacugcuuauucccgagccagaccggcagcguaccccucaggauaaucaacucgccuauguggucaucggucuguuguuuaugauucugacaguggcagccaacgagaugggcuuacuagaaaccacuaaaaaggaccuggggaucggacauguugcugcggagaaccagcaccacgccacaaugcucgauguggaccuuagacccgcaucugcuuggacgcuguacgccgucgccaccacuguaauaacaccaaugaugaggcauaccauugaaaauaccacagcaaacaucagcuugacugcuauugccaaucaggcggcuauccugaugggccucgauaaagguuggccuauauccaagauggacaucggggugccgcugcuugccuuaggcugcuacucacaaguuaacccccugacgcucaccgcagccguguugaugcuggucgcucacuaugcaauuaucggaccaggccuacaggccaaagcgacacgcgaggcucagaagcggacugccgcagggauuaugaagaauccuaccguggauggaaucgucgccauagaccuggaccccgugguuuacgaugcuaaauucgaaaagcagcucggccaaauuaugcuucugaucuuguguacaucucagauccugcucaugcgaaccacuugggcccugugcgagaguauuacguuagcaacagguccacuuaccacucugugggaggggucgccuggaaaauuuuggaacaccacaaucgcugugagcauggccaauauauucagaggcuccuaucucgcgggugccggccuagcauucucucugaugaagucacuagggggaggcaggcgcgggacuggagcucagggcgaaacccugggugagaaauggaagcggcagcucaaccaacuuagcaaguccgaauuuaauacauacaaaagaagugggauuauggagguagaccguucugaagccaaggagggacugaaaaggggcgagacgaccaagcaugcagugagccgggguacugcuaaauugcgcugguucgucgaacgaaaccugguuaagcccgagggcaaggugaucgaucucggguguggaagaggcggguggucauauuacugcgccggacuaaagaaggucacagaagugaaaggcuauaccaagggugggccgggacacgaggaaccaauuccuauggccacuuacggcuggaaucugguaaaacuuuacuccggcaaggacguguuuuucacacccccagagaaaugugauacccugcuaugcgacaucggggagaguagccccaacccuacgauagaagagggaaggacccuccggguucugaagaugguggaaccgugguugcgcgguaaucaguuuuguaucaagauucugaaccccuauaugccaucugucguggagacacucgagcagaugcagagaaaacauggcgggaugcuugucaggaauccucugucccgaaacucaacucacgaaauguacugggugagcugcggaaccggcaauaucguuucggcgguaaacaugacaucucggauguuacugaaccguuucacuaugacccacagaaagcccacauaugagcgcgauguggacuugggugcugggaccaggcaugucgcaguggaaccugagguugccaaucucgauauuaucggacaacggauugaaaacaucaaaaaugagcacaagaguacuuggcauuacgacgaggauaacccauauaaaacgugggcuuaccacggcuccuaugaagugaagcccagcggcucagccuccucuauggucaauggggugguaagacugcuaacaaagccuugggacgugauaccaaugguuacccagauugcaaugacugacaccacacccuuuggacagcaacgcgucuucaaagagaagguggauacgaggaccccgcgagccaaacgggguacugcucagaucauggaagugacagcgaaguggcuuuggggcuuucugagcagaaacaaaaagccuaggaucuguacccgcgaggaguucacucguaagguccggaguaaugccgcaauuggggcuguuuuuguggacgagaaccaguggaacuccgccaaagaggcaguagaagaugagagauucugggaccucgugcacagggaacgcgagcugcauaagcagggaaaaugcgccacaugcgucuacaacaugaugggcaagcgagagaaaaaguugggugaguuugggaaggcuaaaggaagccgggccauaugguacauguggcugggcgcgagauuccucgaguucgaagcacuuggcuuuaugaaugaggaucacugguucucuagggaaaacucauuuagugggguggagggagagggucugcauaaguuaggcuauauccugcgcgacauuuccaaaaucccagggggaaauauguacgccgaugacaccgcuggcugggauacaagaauuacugaagacgauuugcaaaacgaggccaagaucaccgacauaauggaacccgagcacgcacuccuggcuacgagcaucuucaaacuaaccuaucagaauaagguugugcggguccagaggccugccaaaaacgguacagugauggauguaauuucucgucgagaccagcgcgggucgggacaaguuggcacuuacggccuuaacaccuuuacaaauauggaagugcagcugaucagacagauggagucagaggggauuuuccucccaagcgaacuggagacucccaacuuggcugaacgggucuuagacuggcuggagaagcauggaaccgaaaggcucaagcgcauggccaucuccggugaugacuguguggugaaaccggucgaugacagauuugcaacggcgcuuauagcccugaaugauaugggcaagguucggaaagacauuccucagugggagcccaguaagggguggaacgauuggcaacaggugccauucugcucucaccacuuucaucagcuaaucaugaaagacggaagggagaucguagugccuugucgaaaucaggaugaacuggucggccgugcuagagugagccaaggugccggguggucccuccgcgagacagcaugcuugggaaagucauaugcucagauguggcagcugauguacuuccaccggagggaccuuagacuggccgcaaacgccauuuguagugcgguucccguggauugggucccaaccucucgcacuacauggagcauacaugcucaccaccaauggaugaccacugaagacaugcucuccguguggaaucggguauggaucgaggaaaaccccuggauggaggacaagacccauguuucaagcugggaggaagugccuuauuuaggcaaaagggaggaucaguggugcggcucucugauuggguugacagcccgagcaacgugggccaccaauauccaggucgcuauuaaccaggugagacggcugaucggaaaugaaaacuaccucgacuacaugacuuccaugaagagguuuaaaaaugagagugauccagagggugcccuuugguga

SEQ ID NO: 13495 - RNA, 9879 nt, Artificial Sequence
  derived and/or modified CDS sequence (opt3) from DENV-1__FJ410190__SS-prME
agcgugacaaugcugcucaugcuucugcccacagccuuggcuuuccacuuaacuacgagaggaggggaaccucauaugaucgucuccaagcaggaaaggggaaaaucucuguuauuuaagaccucaguugguauuaacaugugcacacucauagcaauggaccugggagagcuuugugaagauacuaugaccuacaaaugcccacggaucacagaggccgaaccggacgauguggacuguuggugcaaugcgaccgauacuuggguaacauaugggaccuguagucagacgggagagcaccgccgagacaagcguagcguggcucuggcaccccaugucggcuugggucucgagacuagaaccgaaacauggauguccucugagggggcauggaaacagauucagaagguggaaacuugggcccugaggcacccuggauucaccguuaucgcucuguuucucgcacaugccauuggcacaucgaucacccagaagggcauaaucuucauuuuacugaugcuugugacgccaucaauggcuaugcggugcgucgggaucggaaaccgcgauuuuguggaggguuugagcggcgccacuuggguagacguugugcuggagcacgggaguugugucacaaccauggcgaaagauaagcccacucuagacauugaacuccugaaaacagaggugaccaauccugcagugcuuagaaagcugugcaucgaagccaaaauauccaacacgaccacagauucuagguguccaacucaaggagaggcuaccuuggucgaagaacaggacagcaauuucguuugccggcgcacauuuguggaucgaggcugggguaacggguguggacucuucggcaagggcucccuguuaacuugcgccaaguuuaaaugcguaaccaagcuggaggggaaaauugugcaguacgaaaaucucaaguauucagucaucgugacaguucacaccggagaccagcaucaaguggguaacgagacuacggaacacggcacaauugcaaccaucacuccccaggcuccuaccagugagauccagcuuacagacuacggggcccugaccuuggauuguagcccaagaacuggacuagacuucaaugaaaugguccugcucacaaugaaagagaagucuuggcuggugcauaaacagugguuucuugaucugccguugcccuggacguccggcgcgucaaccagccaagagacuuggaacaggcaggaccuccugguaacauucaagaccgcccacgcaaagaaacaggaaguuguggucuuagguagucaagagggggcuaugcacacagcccugacuggcgcuaccgaaauucagacgucuggaaccacaacuauauuugccggccaucuaaagugccggcucaaaauggauaagcugacccuuaaagggauguccuaugugauguguacaggcagcuucaaguuggagaaggaagucgcagagacucagcacgguaccgugcugguucaggugaaauacgagggcacggacgccccuugcaagaucccauucucggcucaagaugaaaaagggguaacacagaauggacgucucauuaccgcgaaccccaucgucacugacaaggagaaaccugugaauauagaaacagagccacccuuuggcgagucuuauauuguuaucggugcaggggaaaaggcccugaaacuuuccugguucaaaaagggcucaaguaucggaaaaauguuugaggcuaccgcccgcggcgcaagaaggauggccauucugggggauacugcuugggacuucggaagcaucgguggcguguuuaccuccgucgggaaguuggugcaucagguauucggagccgcauacggcgugcucuuuucugguguuagcuggacaaugaaaauugggauaggcauccuguuaacguggcugggacuaaacucacggaguaccucccucagcaugacuuguauugcggucggcauggugacacuguaccuuggggugaugguccaggcugauucuggaugcguuaucaauuggaagggccgagaauugaagugugguucagggaucuucgugaccaacgaggugcacacauggacugaacaauauaaauuucaggccgacaguccgaagcgccugagcgcagccauuggaaaggcuugggaggagggcguaugcgguauaagauccgccaccaggcucgaaaacaucauguggaagcagauuucuaaugagcugaaccauaucuuacuggaaaaugacaugaaauucacggucgugguuggcgaugcaaacgggauucuugcucagggaaagaaaaugauccggccucaacccauggagcaccgcuacucguggaaaagcuggggcaaggccaaaauaaucggggcggacauucagaauacaaccuuuaucauugauggaccagacacuccugaaugucccgaugaccagagagccuggaacaucugggagguggaggauuauggcuucgguauauuuaccacaaauauuugguugaagcucagggacuccuacacucagaugugcgaucaccgucugaugucagcugcaaucaaagacaguaaggccguccaugcugauaugggguauuggauugaaucugagaaaaacgaaaccuggaagcuagcccgggccagcuucaucgaggugaagacauguauauggccaaaaucccacacgcuguggucaaauggaguucucgaaagcgagaugaucauucccaagaucuacggcgguccuauuucucaacauaacuaucgaccaggcuacuucacccagacugcggggccguggcaccugggaaaacuugaguuggacuuugaucugugcgaaggcacaaccgugguagucgacgagcacugcgggaauagaggacccuccuuaaggacuacaaccgugacgggcaagaucauacaugaaugguguugccgcaguuguacucucccuccacugcgguucagaggugaggacgggugcugguacggaauggagauuaggcccgugaaagaaaaggaggaaaaccuuguccgcagcaugguuucugccggcuccggugagguggauucauuuagucugggcaucuuguguguaagcaucaugauugaagaggugaugcgaucgcgguggucccguaagaugcucaugaccgggacacuggcugucuuccuacugcucaucaugggacagcugaccuggaaugaccuuauuagauugugcauaauggugggcgccaacgcaucugauaggauggggaugggaacuacauaucuggcuuuaauggccaccuuuaaaaugcgcccuauguucgcaguuggccuccuguuucggagacuuacaagcagggaggugcugcuacucacuaucggucugucauuggucgccaguguggaacugccaaauuccuuagaggaacucggggacggacuggcuaugggcauuaugaugcuuaagcuguugaccgaguuccaaccccaccagcucuggacgacacugcuaucucugaccuuuaucaaaacuacccuuagccucgauuacgcguggcgaacaauggccaugguucuguccauugugucauuguucccgcuguguuuaagcacuaccagucagaagacgacauggcucccuguccugcuuggcucuuuugggugcaaaccacugaccauguucuugaucacugaaaacaagauauggggacgcaaguccuggccccucaacgaggguaucauggcaauuggcaucguaagcauucugcuaucgucacugcuuaaaaaugacgugccucucgcugggccccugaucgccggaggcauguugauagccuguuauguuauuucugguaguuccgcugauuuaagccuggagaaggcagccgaagugucuugggaggaagaggcggaacauagcgggacaucccacaacauccucgucgaggugcaggacgauggaaccaugaaaaucaaggacgaggaacgggaugacacucugacaauucuucugaaagcuaccuugcuagccguaucaggcguguacccaaugaguauaccugcaacgcuguuugucugguauuucuggcaaaagaaaaagcagagaagcggcguucucugggauacucccucuccaccggagguggaaagggccgugcuggacgacgggaucuaccguauucuucagcgcggauuacugggucggucccaggucggcguggggguuuuccaagauggaguauuucauaccauguggcacgugacaagaggcgcuguccucauguaucaggguaagagguuggagccuucaugggcaagugugaaaaaggaccugaucagcuacgggggaggcuggcgauuccagggcuccuggaauaccggggaggaaguucaggugauugccgucgagcccggcaaaaauccaaagaaugugcaaacaacucccgguaccuuuaaaacgccugaaggcgagguaggggcgaucgcucucgauuucaagccaggaacaucuggcucgcccauagucaaccgggaagagaagaucgugggucuguacgggaauggaguugugacuaccagcggcacauaugucucagccauugcacaggccaaaaccucccaggagggcccucuuccggaaaucgaggacgaaguguuuaagaaacgcaaccugacuauuauggauuugcacccagggaguggaaagaccagaagguaccuacccgcuaucguucgggaggccauaaaacgaaagcugagaacacucauuuuagcaccuacgcgcguggucgcuucugaaauggccgaggcgcugaaggguaugccaaucagguaucaaacuaccgccgugaaaagcgagcauacaggccgugaaaucguagaccuuaugugccacgcaaccuucacuaugcggcugcucucccccgugagaguuccuaauuacaacaugauuaucauggaugaggcucauuuuacagacccggccucaauagcugcaaggggguauauuucuacccgcgucggaaugggcgaagccgccgcuaucuucaugacggcgacucccccagguagcguggaggcauuuccucagaguaaugccgugauucaggaugaagaacgagacauccccgagagauccuggaacagcggguacgauuggauaacagacuucccaggaaagaccgucugguuuguaccuucuauuaaaucaggcaaugacaucgcuaacuguuugcggaagaauggcaaaagggugauccagcugucccgcaagaccuucgauacugaauaucaaaagaccaaaaacaacgacugggauuacguugugaccacagacauuagugagaugggggccaauuuccgugcagauagagucaucgacccccggaggugccucaagccagugauucugaaagauggaccggaacgcguuauacuugccgguccuaugcccgugacugucgcuagcgcggcccagcgaagaggccggaucgggaggaaccagaauaaggagggagaccaguacguguauaugggccaaccacuaaacaaugaugaggaccacgcacauuggacggaagcuaaaaugcuguuggauaacauuaauacccccgaggguaucaucccugccuuauuugaaccagagcgcgaaaagucggcagccauugacggggaguacagacugaggggcgaggcucggaagacauucguagaacucaugcgucgcggagaucugcccguguggcuuucuuauaaaguugccuccgagggcuuucaguacagcgaccgaagauggugcuucgacggggaaaggaacaaucagguccuggaggaaaacauggauguggagauauggacuaaggagggagaacggaaaaagcuccgcccuagaugguuggacgcgaggaccuauucagauccgcuggcacuacgggaguuuaaagaguucgccgcuggucgaagaagugugucuggcgaccugauccucgagauugggaaacuuccacagcaccugacauuacgcgcccaaaaugcuuuggauaaccuggucaugcuccacaauuccgaacagggaggcaaagcauacaggcaugccauggaggagcugcccgacaccaucgaaacucuuaugcugcucgcuuugauugccguucugacggguggggugaccuuauuuuuccuaagcggcaagggacugggcaagacaucaaucgggcuccuuuguguaauggcaaguagcgcgcuguuguggauggccaacguggagccucacuggauagcugccuccaucauucuggaauuuuuccucaugguccugcuuauccccgagccagaucggcagcguacuccucaggacaaucaacucgcauaugugguuauuggacuguuguuuaugauccugaccguggcugccaacgagauggguuuacuagaaacaaccaaaaaggaucugggcauagggcaugucgcagccgagaaccagcagcacgcuacuaugcucgacguagaucuuagacccgcgucugccuggacacuguacgcaguggcuacgaccguuauuacuccaaugaugaggcacacaaucgaaaauaccaccgccaacauuagcuugacagccaucgcaaaucaagcugccauacugaugggacucgacaaaggcuggccuaucuccaagauggauauuggugugccgcugcuugcguuagggugcuacucacaggucaacccccugacucucacggcugccguguugaugcuggucgcacauuaugccaucauuggcccaggacuacaggcuaaagcaacccgcgaggcccagaagcggacagcggcuggcaucaugaagaauccuacuguggacgggauaguugccauugaccuggaucccgugguauacgacgcaaaauucgaaaagcaacucggacagaucaugcuucugaucuuguguaccucucagauucugcucaugcgaacaaccugggcccugugcgagaguaucacuuuagcuacgggcccacuuacaacccugugggaggguucgccugggaaauuuuggaacacuaccauagccgugagcauggcaaauauuuucagaggauccuaucucgcuggcgccggucuagcguucucucugaugaagucauugggcgggggaaggcgcggcacaggggcccagggagaaacucugggcgagaaauggaagcggcaacucaaccagcuuagcaaguccgaauuuaauaccuacaaaagaagugguaucauggaggucgaucguucugaagcaaaggaggggcugaaaaggggagagacaacgaagcacgcuguuagccggggcaccgccaaauugcgcugguucguggaacgaaaccuggucaagcccgaggguaaggugauugaccucggcugugggagaggaggcuggucauauuacugcgcagggcuaaagaagguaacugaagugaaaggauauacaaagggcgguccggggcaugaggaaccaaucccuauggcuaccuacggauggaaucugguuaaacuuuacuccggcaaggauguguuuuucacucccccagagaaaugugacacacugcuaugcgauauaggcgagaguagccccaacccuaccaucgaagaggggaggacgcuccggguccugaagaugguggaaccgugguugcgcggaaaucaguuuuguauuaagauccugaaccccuauaugccaucugucguggagacccucgagcagaugcaaagaaaacacgguggcaugcuuguuaggaauccucugucccgaaacucaacacaugaaauguacuggguaagcugcgggacuggaaauauugugucggccgucaacaugaccucucggauguuacugaaccguuucacaauggcccacagaaagcccacuuaugagcgcgacguggauuugggcgcggguaccaggcacguugcuguggaaccugaggucgcaaaucucgacaucauugggcagcggaucgaaaacauaaagaaugagcauaagaguacauggcacuacgaugaggacaacccauauaaaaccugggccuaccauggauccuaugaagugaagcccagcggcucagcuuccucuaugguaaauggcgugguuagacugcuaacuaagccuugggacgucauuccaauggugacgcagaucgccaugacagauaccacucccuuugggcaacagcgcguguucaaagagaaggucgacaccaggacaccgcgagcaaaacggggaacggcccagaucauggaaguuaccgcuaaguggcuuugggguuuucugagcagaaacaaaaagccuaggauuuguacucgcgaggaguucacacguaaggugcggaguaaugcggccauaggcgcaguauuuguggaugagaaccaguggaacuccgcuaaagaggccgucgaagacgagagauucugggaucucgugcacagggaacgcgagcugcacaagcaagggaaaugcgcaaccugcguuuacaacaugaugggaaagcgagagaaaaaguugggcgaguuugguaaggccaaagggagccgggcuaucugguacauguggcugggagccagauuccucgaguucgaagcgcuuggcuuuaugaaugaggaccauugguucucuagggaaaacucauuuaguggcguggagggggagggacugcacaaguuagguuauauucugcgcgauaucuccaaaauuccaggcgggaauauguacgcagacgauacugccggaugggacacaagaaucaccgaagaugacuugcagaacgaggcuaagauaacagauaucauggaacccgagcaugcccuccuggcaacuagcauuuucaaacuaaccuaucagaauaaggucgugcggguacagaggccugcuaaaaacggcacgguuauggacgugaucucucgucgagaccaacgcgguucggggcaggucggaaccuacggccuuaacacauuuacuaauauggaagugcagcugauuagacagauggagucagagggcaucuuccucccaagcgaacuggagacccccaacuuggccgaacggguguuagauuggcuggagaagcacgggacagaaaggcucaagcgcauggcuauauccggagacgauugugucguuaaaccgguggacgauagauuugccacugcacuuauugcgcugaaugacauggguaagguacggaaagauaucccucaaugggagcccaguaagggcuggaacgacuggcaacaggugccauucugcucucaucacuuucaccagcuaaucaugaaagaugggagggagauugucgugccuugucgaaaucaagacgaacugguuggacgugccagagugagccagggcgcugguuggucccuccgcgagaccgccugcuuggggaagucauaugcacagauguggcaacugauguacuuccaucggagggaucuuagacuggcugccaacgcaauauguagugccguccccguggacuggguaccaacgucucgcacaaccuggagcauccacgcgcaucaccaguggaugacuacagaagacaugcucuccguuuggaaucggguguggauugaggaaaaccccuggauggaggauaagacccacgucucaagcugggaggaagugccuuauuuaggaaaaagggaggaccaguggugcggcucucugaucggcuugacugcucgagccaccugggcaacaaauauucagguugccaucaaccaagugagacggcugauagggaaugaaaacuaccucgauuacaugacguccaugaagagguuuaaaaaugagagugacccagagggagcucuuugguga

SEQ ID NO: 13496 - RNA, 9879 nt, Artificial Sequence
  derived and/or modified CDS sequence (opt3) from DENV-1__EU482591__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaagcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuacgguggcccuauaagccaacauaauuauagaccaggguacuuuacccagacugcgggaccguggcaccucggcaagcuggaacuugauuucgacuugugcgaggggacaaccgucgugguggaugaacacugcggaaacaggggccccucucugcgcacgacuaccgucacagguaaaaucauucaugagugguguugccgguccuguaccuuaccuccacucagauuuaggggggaggacggaugcugguacggcauggaaauccgccccguuaaggagaaagaagagaaucuggugcgaaguaugguaagcgccgguucuggcgaaguggauuccuucucacuugggauucugugugucaguaucaugauagaggaggugaugcggagccguuggucgagaaagauguugaugacuggaacacucgcuguuuuucugcuacugauuaugggccagcucaccuggaacgaccugaucaggcuuugcaucauggugggggccaaugcauccgaccgcaugggaaugggcacaacuuauuuggcucugauggccaccuucaagaugcggccuauguuugcagucgguuuacucuucagaaggcugacgucucgagaagugcuucugcuaacaauugggcucagccugguugccucaguggaguugccaaacagucuggaagaguuaggagauggccucgcuaugggcaucaugaugcugaaacuucugaccgaauuucaaccccaccaguuguggacuacccuccugucccuaacauucgucaagacuacccugucucuugacuacgcguggaaaacgacagccauggcacucagcauuguaucccuguuuccguugugucugucaaccacuagccagaagacaaccugguuaccugugcuccuggggaguuucggaugcaaaccacuuacuauguuucugauaacagagaacaagaucuggggucgcaagucuuggcccuugaaugagggcauuauggcuaucgggauuguuuccauccuccugagcucgcuacugaaaaacgaugugccucuugccggaccccucauagccggcgguaugcugaucgcuuguuaugucauuucagggucuagugcagacuuguccuuagaaaaggccgcggaggugagcugggaacaggaggcugaacauucuggagccagccacuccauccugguagaggugcaagaugacggcaccaugaaaauuaaggaugaggaacgggacgauacgcucacuauccugcuuaaagcaacccuguuggccgucucaggcguuuacccaaugaguauaccugcuacacuauucgugugguauuucuggcagaagaaaaagcagagaagcggggugcugugggacacccccucuccaccggaggucgaaagggcagugcucgauaauggaauuuaccguauccugcagcgcggucuuuuaggccggucccaaguugggguaggaguguuucaggacggcgucuuccauacaauguggcacgugacuagaggugccguucugauguaucaggggaagaggcucgagccuucaugggcgagugugaaaaaggauuugaucagcuacggaggcggcuggcgauuucagggguccuggaacaccggagaggaaguccaagugauugcuguagagcccgguaaaaauccaaagaacguccagacgacacccggcacuuucaaaaccccugaaggggaggugggagccauagcacuggacuuuaagccaggcacaucugguucgcccaucguuaaucgggaagggaagauugugggacucuacggcaacggcgucgugaccacuagcgggaccuauguuucagccaucgcucaggccaaagcaucccaagagggaccucugccggagauugaagacgagguguucaagaaacgcaaucuuacaaucauggaucugcacccagguaguggcaagacgagaagguacuugcccgcuauaguccgggaagccaucaaacgaaagcuaagaacucugauucucgcgccuacccgcgugguagccucugagauggcagaagcuuuaaaggggaugccaaucagguaucagacaaccgccgugaaaagcgagcauacuggacgugagauuguugaccugaugugccacgcuacauuuaccaugcggcuucugucccccgucagagugccuaacuacaauaugaucauaauggaugaagcacauuucacggacccggccucaauugccgcuaggggcuauaucucuacucgcguggguaugggggaggcggcagccaucuuuaugacagcuacccccccaggaagcgucgaagccuucccucagaguaacgcaguaauucaggaugaggaacgagacauccccgagagauccuggaauagcggcuacgauuggauaaccgacuuuccaggcaagacugugugguucguuccuucuauuaaaucagggaacgauaucgccaauugucuccggaagaacggaaaaagggugauucaauugucccgcaagacauucgacaccgaguaucagaagacaaaaaacaaugauugggacuacgucgugacuacggacaucagugaaaugggugcuaacuuucgugcggauagaguuauagacccccggaggugccugaagccagugauucucaaagauggcccggagcgcgucauccuggccgggccuaugcccgugaccguagcaagcgcugcccagcgaagaggacggaucggcaggaaucagaacaaggaaggugaccaauacguguauauggggcagccacuuaauaacgaugaggaccacgcacauuggacagaggccaaaaugcuacuggauaauauuaacacucccgaaggcaucauuccugcuuuguucgagccagaacgcgagaagucggccgcgauagacggagaauacagauuaaggggcgaggcacggaagaccuuuguugagcugaugcgucgcggggaucuccccgucuggcugucuuauaaaguggccuccgaaggauuccaguacagcgaccgaagauggugcuuugauggugagaggaauaaccaggugcuugaagagaauauggacgucgaaaucuggacaaaggagggcgagcggaaaaagcugcgcccuagauggcucgaugcuaggaccuauucagacccguuggcccugcgggaauucaaagaguuugcugcagggcgaagaaguguuucuggagaccuaauucuggaaaucggcaagcucccacaacaccuuacucugcgcgcccagaacgcuuuagauaauuuggugaugcugcacaacuccgagcagggugggaaagccuacaggcaugcaauggaagagcuccccgacacgaucgagacccugaugcuucuggcgcucauugccguauugacaggcggagugacucuguucuuuuuaagcggcaaggggcuaggaaagaccucaauaggucugcucugugucacagcuaguagcgcccuucuguggauggcauccguggaaccucacuggaucgcugccucuauuaucuuggaguucuuucugaugguucuccugauucccgaaccagaucggcagcguaccccucaagacaaucagcuugcauauguggucaucggccuccuguucaugauauugacuguagccgcuaacgagauggggcuguuagagacaacgaaaaaggaucuaggaaucggcuacguggcggccgaaaaccaucagcacgcaaccaugcuggacguugaucuccaccccgcuagcgccuggacucuuuacgccguggcaacaaccgucauuaccccaaugaugagacauacaaucgagaauacuacggcuaacauuucccugaccgccaucgcgaaucaagcugccauauugaugggucuggacaaaggguggccuauuucaaagauggauaucggcgugccgcuccuggcacuuggaugcuauucucaggucaaccccuuaacacugacugccgcugugcucauguugguugcacacuacgccauuaucggcccagggcugcaggcgaaagcuaccagggaagcccagaagcgcacagcagccggaauaaugaagaauccuaccguggacggcaucguagcuauugaucuagaccccguggucuaugaugccaaauuugagaagcaacugggucagaucaugcuccuuauucuguguacuagucagaucuugcugaugcggacgacaugggcacucugcgaaucgauaacccuggcuacugggccauuaaccacacuuugggagggaagcccuggcaaauucuggaacacuaccauugccguuuccauggcgaauaucuuccgagguucuuaccuggccggcgcagggcucgcuuuuucacuaaugaagagccugggaggcgggagaaggggaacaggcgcccagggugagacguugggggaaaaauggaagcgccaacugaaccagcucuccaagagugaguucaauaccuauaaacggucuggaaucauggaaguggacagaagcgaggcaaaggaaggccuuaaacguggugagacuacaaagcaugcugucucaaggggcaccgccaaacugcggugguuuguggagcgcaacuugguaaagcccgaagggaaggugauugaccugggauguggccgagggggaugguccuacuauugcgccggccucaaaaagguuacugaggugaaagguuacacaaaggggggaccgggccacgaagagccaaucccuauggcgaccuacggcuggaauuuagucaaacugcauagugggaaggauguguucuuuaugcccccagaaaaaugugacacgcuucugugcgauauaggagagagcucucccaacccuaccauugaggaagguagaacacuaaggguccucaagaugguggagccguggcugcggggcaaucaguucuguaucaagauuuugaaccccuauaugccauccguuguagaaacucuggagcgcaugcagagaaaacacgggggaaugcucgugaggaauccucuuucacgaaacagcacccacgagauguacugggucucgugcggcacagguaauaucgugucugcuguuaacaugacuagucggaugcuguuaaaccguuuuaccauggcacauagaaagcccacauaugaacgcgacguggaucugggggccggaaccaggcacgucgcuguggagccugaaguagccaauuuggacauaaucggccaacggauugagaacaucaaaaaugaacauaaguccacuuggcacuacgaugaggacaacccauauaaaacgugggcauaccacggcagcuaugaggugaagcccucaggguccgccucuagcaugguuaauggagucgugagacuccugacaaagccuugggaugugauuccaauggucacccagaucgcuaugacugacaccacacccuucggucagcaacgcguuuuuaaagaaaagguggauacgaggaccccgcgagcgaaacggggcacuacacagauuauggagguaaccgccaaguggcuauggggguuccuuaguagaaacaaaaagccuaggaucuguacucgcgaagaguuuacacguaaggugcgguccaaugcagcuauaggagccgucuucguggacgaaaaccaguggaauagcgcaaaagaggccguugaggacgaaagauuuugggaucuggugcauagggagcgcgaacuccacaagcagggcaaaugcgcuaccugcgucuacaacaugauggguaagcgagagaaaaagcugggggaauucggaaaggccaaaggcucucgggcgauuugguacaugugguugggcgcaagauuccuggaguuugaggcccucggguucaugaaugaagaccauugguuuucaagggagaacagucuuuccggaguggaaggugagggccugcacaaguuaggguauauccugcgcgauaucagcaaaauuccaggaggcaauauguacgcugacgauacagccgguugggacacuagaauaaccgaggaugacuugcaaaacgaagcaaagaucacggauauuauggagcccgaacaugcucuccuggccaccucuaucuucaaacuaacauaucagaauaagguaguucgggugcagaggccugcuaaaaacgggacugucauggacgugauuucgcgucgagaucagcgcggaucaggccaagugggcaccuacgggcuuaacacauuuacuaauauggagguccagcugaucagacagauggaaagcgagggaauauuccucccauccgagcuggaaacccccaacuuggccgagcgggcauuagacuggcuggaaaagcacggugcggagaggcucaagcgcauggccaucaguggcgaugacuguguugugaaaccgauugacgauagauuugcuacggcccuuacagcacugaaugacauggggaagguacggaaagauaucccucagugggaacccucuaagggauggaacgacuggcaacaggugccauucugcagccaccauuuucaccagcuaauuaugaaagauggcagggagaucgucgugccuugucgaaaucaggacgagcugguuggucgugcuagagugucccaaggggccggauggucacuccgcgaaaccgcaugcuugggcaagaguuaugcccagauguggcagcugauguacuuccaucggagggaucuuagacuggcggcuaacgccauauguucugcaguccccguggacuggguaccaacuagccgcacaaccugguccauucacgcccaccaucaauggaugacuaccgaggauaugcucucaguuuggaaucggguguggaucgaagagaaccccuggauggaagacaagacacacgucagcucuugggaggaggugccuuauuuaggcaaaagggaagaucaguggugcgggucccugaucggauugacggcucgagccaccugggcaacuaauauucagguugcuauaaaccaggugagacggcugaucgguaaugagaacuaccucgacuacaugacaaguaugaagagguuuaaaaaugaaagcgacucggagggcgcccuuugguga

SEQ ID NO: 13497 - RNA, 9879 nt, Artificial Sequence
  derived and/or modified CDS sequence (opt3) from DENV-1__EU482592__SS-prME
agcgugaccaugcugcucaugcuucugcccaccgccuuggcuuuccacuuaacuacgagaggaggggagccucauaugaucgucuccaagcaggaaaggggaaaaucucuguuguuuaagaccucagcagguauuaacaugugcacacucauagccauggaccugggcgagcuuugugaagauacuaugaccuacaaaugcccacggaucacagaggcggaaccggacgauguugacuguuggugcaaugcuaccgauacuugggugacauaugggaccuguagucagacgggagagcaccgccgagacaagcguagcguagcccuggcaccccaugugggcuugggucucgagacuagaaccgaaacauggauguccucugagggggccuggaaacagauucagaaggucgaaacuugggcucugaggcacccuggauucaccgugacagcacuguuucucgcccaugcuaucggcaccucgauuacgcagaagggcaucauauucaucuuacugaugcuuguuacuccaucaauggccaugcggugcguggggauuggaaaccgcgauuuugucgaggguuugagcggcgcgacauggguggacguaguucuggagcacgggaguugugugaccacuauggcaaaagauaagcccacacuagacaucgaacuccugaaaaccgaggucacgaauccugccgugcuuagaaagcugugcauugaagcuaaaaucuccaacaccacaacugauucuagguguccaacccaaggagaggccacauugguggaagaacaggacagcaauuucgucugccggcgcacuuuuguugaucgaggcugggguaacggguguggacucuucggcaagggcucccuguuaaccugcgcaaaguuuaaaugcgugacaaagcuggaggggaaaauaguacaguacgaaaaucucaaguauucagugauugucaccgugcacacuggagaccagcaucaaguugguaacgagacgacagaacacggcaccaucgcuacuauuacaccccaggccccuacaagugagauccagcuuaccgacuacggggcgcugacuuuggauuguagcccaagaacaggacuagacuucaaugaaauggugcugcucacgaugaaagagaagucuuggcugguccauaaacagugguuucuugaucugccguugcccuggaccuccggcgccucaacuagccaagagacauggaacaggcaggaccuccuggugaccuucaagacagcacacgcuaagaaacaggaaguaguuguguuagguagucaagagggggccaugcacacugcucugaccggcgccacggaaauccagaccucuggaacaacuaccauuuuugcaggccaucuaaagugccggcucaaaauggauaagcugacacuuaaagggauguccuaugucauguguacuggcagcuucaaguuggagaaggaaguggccgagacccagcacgguacgguccuggugcagguuaaauacgagggcacagacgcuccuugcaagauaccauucucggcgcaagaugaaaaaggggugacccagaauggacgucucaucacugcaaaccccauuguaacagacaaggagaaaccugucaauaucgaaaccgagccacccuuuggcgagucuuauauagugguuggugccggggaaaaggcucugaaacuuuccugguucaaaaagggcucaaguauuggaaaaauguuugaggccacugcacgcggcgccagaaggauggcuauccugggggauaccgccugggacuucggaagcaucgguggcguguuuacauccgucgggaaguuggugcaucagguauucggagcagcguacggcgugcucuuuucugguguuagcuggacgaugaaaauugggaucggcauucuguuaaccuggcugggacuaaacucacggaguacuucccucagcaugacauguauagcugucggcauggugacccuguaccuuggggugaugguccaggccgauucuggaugcguuaucaauuggaagggccgagaauugaagugugguucagggauuuucgugacaaacgaggugcacacuuggaccgaacaauauaaauuucaggcagacaguccgaagcgccugagcgccgcuaucggaaaagccugggaggagggcguaugcgguaucagauccgcaacgaggcucgaaaacauuauguggaagcagauaucuaaugagcugaaccauaucuuacuggaaaaugacaugaaauucacagucgugguuggcgaugcuaacgggauucuugcccagggaaagaaaaugauccggccucaacccauggagcaccgcuacucguggaaaagcuggggcaaggcgaagauuaucggggccgacauacaaaauuccaccuuuaucauugauggaccagacacuccugaaugucccgaugaccagagagcuuggaacaucugggagguggaggauuauggcuucgguauuuuuaccacaaauaucugguugaagcucagggacucauacacucagaugugcgaucaccgucugaugagugcagccauaaaagacucuaaggcuguccaugccgauaugggguauuggauugaaagcgagaaaaacgaaaccuggaagcuagcacgggcguccuucaucgaggugaagacauguauuuggccaaaaucacacacgcuguggagcaauggaguucucgaaucugagaugaucauacccaagaucuacggcgguccuauuucccaacauaacuaucgaccaggcuacuucacccagacugccgggccguggcaccugggaaaacuugaguuggacuuugaucugugcgaaggcacaaccgugguagucgacgagcacugcgggaauagaggacccaguuuaaggacuacaaccgugacgggcaagaucauucaugaaugguguugccgcagcuguacucucccuccacugcgguucagaggugaggacgggugcugguacggaauggagaucaggcccgugaaagaaaaggaggaaaaccuuguccgcucuaugguuuccgcuggcucaggugagguggauaguuuuagccugggcauauuguguguaucgauuaugaucgaagaggugaugcgaucccgguggucucguaagaugcucaugaccgggacacuggccgucuuccuacugcucaucaugggacagcugaccuggaaugaccuuauuagauugugcaucauggugggcgcaaacgcuagcgauaggauggggaugggaacuacauaucuggccuuaauggcaaccuuuaaaaugcgcccuauguucgccguuggccuccuguuucggagacuuacaucaagggaggugcugcuacucacuauuggucugaguuuggucgcuuccguggaacugccaaauucuuuagaggaacucggggacggacuggcgaugggcauaaugaugcuuaagcuguugaccgaguuccaaccccaccagcucuggacgacacugcuaagccugaccuuuaucaaaacuacccuuucccucgauuacgccuggcgaacaauggcaaugguucugucaauugugagcuuguucccgcuguguuuaaguacuaccucucagaagacgacauggcucccuguccugcuuggcuccuuugggugcaaaccacugaccauguucuugaucacugaaaacaagauuuggggacgcaagagcuggccccucaacgaggguaucauggcuauaggcaucguaucgauucugcuaucaucucugcuuaaaaaugacgugccucucgccgggccccugaucgccggaggcauguugauugcuuguuauguuaucagugguuccagcgcagauuuaucucuggagaaggccgcggaagugagcugggaggaagaggcugaacauuccgggacaucacacaacauacucgucgaggugcaggacgauggaaccaugaaaauuaaggacgaggaacgggaugacacucugacaauccuucugaaagccaccuugcuagcaguaaguggcguguacccaaugagcaucccugccacgcuguuugucugguauuucuggcaaaagaaaaagcagagaucuggcguucucugggauacucccuccccaccggagguggaaagggcugugcuggacgacgggauuuaccguauacuucagcgcggauuacugggucggucacaggucggcguggggguuuuccaagauggaguauuucauaccauguggcacgugacaagaggcgcaguccucauguaucaggguaagagguuggagccuaguugggccagcgugaaaaaggaccugaucuccuacgggggaggcuggcgauuccagggcucuuggaauaccggggaggaaguucaggugauugcggucgagcccggcaagaacccaaagaaugugcaaacaacucccgguaccuuuaaaacgccugaaggcgagguaggggcuaucgcccucgauuucaagccaggaacaucgggcagccccauugucaaccgggaagguaagaucguggggcuguacggaaauggcguugugacuaccucaggcacauaugucuccgcaauagcccaggcuaaaaccagucaggaggggccucuuccggagaucgaagaggaaguguuuaagaaacgcaaccugacuauuauggacuugcacccaggaucugguaagaccagaagguaccuacccgccaucguucgggaggcaauuaaacgaaagcugagaacacucaucuuagcuccuacgcgcguggucgccagcgaaauggcggaggcccugaagggcaugccaauaagguaucaaacuaccgcagugaaauccgagcauacagggcgugaaauuguagaucuuaugugccacgcuaccuucacuaugcggcugcucucacccgugagaguuccuaauuacaacaugaucaucauggacgaggcccauuuuacagauccggcuucuauugcagccaggggauauaucagcacccgcgucggcaugggugaagccgcugcgauauucaugacggcaacucccccagggaguguggaggccuuuccucaguccaaugcugugauucaggacgaagaacgagauauccccgagagaagcuggaacucuggauacgacuggauuacagauuucccaggcaagaccgucugguuuguaccuucaaucaaauccggcaaugacauagccaacuguuugcggaagaaugggaaaagggugauucagcugagucgcaagaccuucgacacugaauaucaaaagacacguaacaacgauugggacuacguugugaccacagauaucagcgagaugggagcaaauuucagagccgaccgggucaucgaucccaggcgcugccucaaaccagugauucugaaggacgguccggaacgaguuauccuugcuggcccuaugcccgugacugucgcgucggccgcacagagacgggggaggauuggacgcaaccagaauaaagagggcgaucaguacguguauaugggucaaccacuaaacaaugacgaggaucacgcucauuggacggaagccaagaugcuguuggacaacauaaauacccccgaggggaucauuccugcauuauuugaaccagagagagaaaaaucugccgcuaucgauggcgaguacaggcugcggggagaggcccguaagacauucguagaacucaugcgccgaggcgaccugcccguguggcuuuccuauaagguugcgagcgagggguuucaguacucagauagaagguggugcuucgacggagaacggaacaaucagguccuggaggaaaacauggacguggagaucuggacuaaagagggugaacgcaagaaacucagaccuaggugguuggaugcacggaccuauagugacccgcuggcccuacgagaguuuaaggaguucgcugccggcagacgcucuguguccggggaucugauucucgagauaggaaaacuuccacagcaccugacauuaagggcucaaaaugcauuggacaaccuggucaugcuccacaauagcgaacagggcgguaaggccuaccggcaugcuauggaggagcugcccgauaccaucgaaacucuuaugcugcucgccuugauugcaguucugaccgggggagugacguuauuuuuccuaucaggaaaaggccuggggaagacaaguaucggacuccuuuguguaauggcgagcuccgcccuguuguggauggcuaacguggagccucacuggauugccgcaucuaucauacuggaauuuuuccucaugguccugcuuauccccgagccagaccgucagagaacuccucaggauaaucaacucgcuuaugugguuauuggucuguuguuuaugauccugaccguggccgcaaacgagaugggcuuacuagaaacaaccaagaaagaccuggggauuggauacgucgccgcugagaaccagcaucacgcgacuaugcucgauguagaccuuaggcccgccagcgcauggacacuguacgcuguggccacgaccguuaucacuccaaugaugcgccacacaauagaaaauaccaccgccaacauuuccuugacagcaaucgcuaaucaggccgcgauucugaugggccucgauaaggguuggccuaucucaaaaauggacauaggggugccgcugcuugcuuuaggcugcuauucucaagucaacccccugacucucacggccgcaguguugaugcuggucgcccauuacgcuaucauuggaccaggccuacaggcaaaggccacccgggaggcgcagaaacgaacagcugccgggaucaugaagaauccuacuguggauggaauuguugcaaucgaccuggaccccgugguauaugaugccaaguucgaaaaacagcucggccaaauaaugcuucugauuuuguguaccagucagauccugcucaugagaacaaccugggcucugugcgagucgaucacuuuagccacggguccacuuacaacccugugggaggggagcccuggaaaguuuuggaacacuaccauugcaguguccauggcuaauaucuucaggggcucuuaccucgccggugcgggccuagccuucucacugaugaaaagccuagggggaggccgccgggggacaggagcacagggcgaaacucugggugagaaguggaagagacagcucaaccaacuuuccaagagugaauuuaauaccuauaagcguucugggauaauggaggucgacaggagcgaagcuaaagagggacugaagcggggcgagacaacgaaacacgccguuucacgcgguaccgcaaaguugcgaugguucguggaaagaaaccuggucaaacccgagggcaaggugauugaucucggguguggaaggggcgggugguccuacuauugcgcuggauuaaagaaaguaacugaagugaagggcuacacaaaaggugggccgggacaugaggaaccaaucccuauggccaccuacggcuggaaucugguuaaacuuuauaguggcaaagacguguuuuucacucccccagagaagugugauacacugcuaugcgacauuggggagagcucucccaacccuaccaucgaagagggacggacgcuccgcguccugaaaaugguggaaccgugguugagagguaaucaguuuuguauaaagauccugaaccccuacaugccauccgucguggagacccucgagcagaugcagaggaagcacggcgggaugcuuguucgaaauccucugucacggaacagcacacaugaaauguauuggguaucgugcggaacuggcaauauugugucugccgucaacaugaccagucguauguuacugaacagauucacaaugacucaccgcaaacccaccuacgagagggauguggacuugggugcggggacacggcacguugcuguggaaccugaggucgcaaaucucgauaucauuggacaaagaaucgaaaacauuaagaaugagcauaaauccaccugguauuacgacgaggauaacccauauaagacuugggccuaccacggcagcuacgaagugaaacccucaggcuccgcuucuagcaugguaaauggggugguucgccugcuaacgaagccuugggacgucaucccaauggugacacagauagccaugaccgacacuacccccuuuggacagcaaaggguguucaaggagaaagucgauacacgaacgccgcgggcaaagagagguaccgcccagauuauggaaguuacugcuaaauggcuuuggggcuuucugaguaggaacaagaaaccucgcaucuguacacgugaggaguucacccggaaggugagauccaaugcggccaucggggcaguauuuguggacgagaaccaguggaauagcgcuaaggaggccgucgaagaugagagguucugggaccucgugcaucgcgaacgagagcugcacaaacagggaaagugcgcaacuugcguuuauaacaugaugggcaaacgggaaaagaaauugggugaguuugggaaggccaagggaucuagagcuauuugguacauguggcugggcgccagguuccucgaguucgaagcgcuuggcuuuaugaaugaggaucacugguucucacgcgaaaacaguuuuuccgggguggagggagagggucugcauaaauuaggcuauauacugagagacaucagcaagauuccagggggaaauauguacgcagaugacacagccggcugggauacccggaucacagaagacgauuugcaaaacgaggcuaaaauuacugacaucauggaacccgagcacgcccuccuggcaaccucuauauucaagcuaacguaucagaauaaagucgugaggguacagcguccugcuaagaacgguaccguuauggaugugaucucgcgacgcgaccagagagggucaggacaagucggcacauacggccuuaacacuuuuaccaauauggaagugcagcugauucggcagauggagagcgaggggaucuuccucccauccgaacuggagacacccaacuuggccgaaaggguguuaaauuggcuggagaaacauggaacugaacgccucaagagaauggcuauuaguggugacgauugugucguuaagccgguggacgaucgguuugccaccgcacuuaucgcgcugaacgacaugggcaaaguaaggaaggauauaccucagugggagcccucuaaaggguggaaugacuggcaacaggugccauucugcagccaccauuuucaccagcuaauuaugaaggauggacgagagaucgucgugccuugucguaaccaggacgaacugguuggcagagcccgcgugucccaaggugcuggguggucacuccgggagacggccugcuugggaaaaaguuaugcacagauguggcagcugauguacuuccacaggagagaucuucgccuggcugccaaugcaaucuguucugccguccccguggacuggguaccaacaagccggaccacuugguccauucaugcgcaccaucaauggaugacaaccgaagauaugcucucaguuuggaacaggguguggauagaggaaaaucccuggauggaggacaagacucacgucagcucuugggaggaagugccuuacuuaggcaagcgagaggaccaguggugcggcucccugaucggguugaccgcuagagccacaugggcaacgaacauucagguugccaucaaucaggugcggaggcugauuggaaacgaaaauuaucucgauuacaugaccaguaugaaacgcuuuaagaacgagagcgacccagagggugcucuuugguga

SEQ ID NO: 13498 - RNA, 9879 nt, Artificial Sequence
  derived and/or modified CDS sequence (opt3) from DENV-1__EU482609__SS-prME
agcgugaccaugcugcucaugcuucugccaaccgccuuggcuuuccacuuaacuacgagaggaggggaaccucauaugaucgucuccaagcaggaaaggggaaaaucucuguuauuuaagaccucagccgguguuaacaugugcacacucauugccauggaccugggcgaacuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaaacuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggcaagaaaaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacuuaucuggcuuuaauggccaccuuuaaaaugcgcccuauguucgcagugggucuccuguuucggagacuuacgucuagggagguccugcuacucacaaucgggcugagcuugguggccucaguugaacugccaaacaguuuagaggaacucggagacggccuggcuaugggcauuaugaugcuuaagcuguugaccgaguuccaaccccaccagcucuggacuacccugcuaucccugacauuugugaaaacuacccuuucucucgauuacgcguggaagacgacagccaugguccugagcauaguauccuuguucccgcuguguuuaucaaccacuagccagaaaacaaccuggcucccugugcugcuugggaguuuuggaugcaagccacugacuauguucuugaucacagaaaacaagauuuggggucgaaaaucuuggccccucaaugagggcaucauggcaauugggaucguuuccauacugcuaagcucgcugcuuaagaacgacgugccucucgcuggaccccugaucgccggcgguauguugauugccuguuaugucaucucagggucuagugcugauuuaucccuggagaaagcagccgaagugagcugggagcaggaagcggagcauucuggagcuagccacaauauucucguagaagugcaagacgauggcaccaugaagaucaaagacgaggagcgcgaugacacgcugacuauacuucugaaggccaccuugcuagcagucuccggcguuuacccaaugucaauuccugccacacuguuugugugguauuucuggcagaaaaagaagcagcggaguggggugcucugggauacccccagcccaccggaagucgagagagcugugcuggacgauggaaucuacaggauccuucagcgugguuuacugggccgcucucaaguugggguaggaguguuccaggacggcgucuuucauacaauguggcacgugacucggggugcaguucucauguaucaggggaaaagauuggaaccuuccugggccucagugaagaaagaccugauuaguuacggaggcggcuggagguuccaggggagcuggaacaccggagaggagguccaagugauagcgguagaacccgguaagaaucccaagaauguccagacgacacccggcacuuuuaagaccccugagggggaagugggagcuaucgcccucgauuucaagccaggcacauccgguucucccauuguuaaucgagaggggaaaaucgugggacuguacggcaacggcgucgugaccacuucggggaccuauguuagcgcaauugcccaggcucgggccucacaagaaggaccucuuccggagaucgaggacgaaguguuuaagaaacgcaaucugacaauaauggauuugcacccagguuccggcaagacgagaagguaccuacccgcaaucguccgggaggcuauuaaacgaaagcugagaacucucaucuuagccccuacccgcgugguagcgagugaaauggccgaggcacugaaggggaugccaauuagguaucagacaaccgcugugaaaucugaacauacuggacgugagaucguugaccuuaugugccacgccacauucaccaugcggcugcucagccccgucagagugccuaacuacaauaugauaauuauggaugaggcucauuuuacggacccggcauccaucgccgccaggggcuauaucucaacucgcguggguaugggggaagcugcggcaauuuucaugacagccacacccccaggaucugucgaggcuuuuccucagagcaacgccguaauccaggaugaagaacgagacauacccgaaagaaguuggaacuccggcuacgauuggauuaccgacuucccaggcaagacugugugguuuguuccuagcaucaaaucugggaacgauauugcaaauuguuugcggaagaacggaaaaagggugauccaacugucacgcaagacauucgacaccgaguaucagaagaccaagaauaaugacugggauuacgucgugacuacggacauauccgagaugggugccaacuuccgugcugauagaguuauugacccccggaggugccucaagccagugauccugaaagauggcccggaacgcgucauccuugcggggccuaugcccgugaccguagccagugcagcucagcgaagaggacggauuggcaggaaucagaacaaggagggugaccaauacguguauauggggcagccacuaaauaacgaugaagaccacgcccauuggacagaggcaaaaaugcuguuggauaauaucaacacucccgagggcauuauaccugccuuauuugaaccagagcgcgaaaagagcgcugccaucgacggagaguacagacugaggggcgaagcgcggaagaccuucguugagcucaugcgucgcggggaucugcccgucuggcuuucguauaaaguggcaucugagggauuucaguacuccgaccgaagauggugcuucgauggugaaaggaauaaccaggugcuggaggaaaauauggacgucgagauuuggacaaaggaaggcgagcggaaaaagcuccgcccuagaugguuggacgccaggaccuauagcgauccgcuggcucuacgggaguuuaaagaguucgccgcugggcgaagaucaguuaguggagaccugauccucgagaucggcaaacuuccacaacaccugacuuuacgcgcacagaacgccuuggauaaucuggugaugcuccacaacucugaacagggugggaaggcuuacaggcaugccauggaggaacugcccgacacgauugagacccuuaugcugcucgcauugauagcgguacugacaggcggagugacuuuauuuuuccuauccggcaaggggcugggaaagaccagcaucggucuccuuugugucacagccucaagugcucuguuguggauggccagcguggagccucacuggauugcagcuuccaucauucuggaauuuuuccucaugguucugcuuauccccgagccagaucggcagcguaccccucaagacaaucagcucgccuauguggucauaggccuguuguuuaugauccugacuguagcagccaacgaaaugggguuacuagagacaacgaaaaaggaucugggaauuggcuacguggcugcggagaaccaucagcacgccaccaugcucgacguugaucuuagacccgcaucugcuuggacucuguacgccguggccacaaccgucaucaccccaaugaugaggcacacaauugaaaauacuacggcaaacaucagcuugaccgcuauagccaaucaagcggcuauucugaugggucucgacaaaggguggccuaucuccaagauggauauuggcgugccgcugcuugccuuaggaugcuauucacaggucaacccccugacacucacugcagccguguugaugcugguugcucauuacgcaaucauaggcccagggcuacaggccaaagcgacccgcgaggcucagaagcggacagccgcaggaaucaugaagaauccuaccguggacggcauuguagccaucgaucuggaccccguggucuaugacgcuaaauucgaaaagcaacucggucagauuaugcuucugaucuuguguacuucucagauacugcucaugcgaacgacaugggcccugugcgagaguauuaccuuagcaacugggccacuuaccacacugugggaaggaucgccuggcaaauuuuggaacacuaccaucgcuguuagcauggccaauaucuucagagguuccuaccucgcgggcgccgggcuagcauucucucugaugaagucauugggaggcgggaggcgcggaacaggcgcucagggugagacgcugggggagaaauggaagcggcaacucaaccagcuuagcaaguccgaauuuaauaccuauaaaagaaguggaauuauggagguggaucguucugaagccaaggagggccugaaaaggggugaaacuacaaagcacgcagucagccggggcaccgcuaaauugcgcugguucguggagcgaaaccugguaaagcccgaggggaaggugaucgaccucggauguggcagagggggauggucauacuauugcgccggccugaaaaagguuacugaagugaaagguuacacaaaagggggaccgggccaugaggaaccaauaccuauggccaccuacggcuggaaucuagucaaacuucacuccgggaaggauguguuuuucaugcccccagagaaaugugacacgcugcuaugcgauauuggagaaaguagccccaacccuaccaucgaggaggguaggacacuccggguccugaagaugguggaaccgugguugaagggcaaucaguuuuguauuaaaauccugaaccccuauaugccaucuguuguagagacucucgaacagaugcaacgcaagcaugggggaaugcuugugagaaauccucuguccaggaacucaacccacgagauguacugggucagcugcggcacagguaauauagugucggcgguuaacaugacuucucgaauguuacugaaccgguucaccauggcucaccguaaacccacauaugagagagacguggauuugggggcaggaacccgccaugucgccguggaaccugagguagcuaaucucgacaucauuggccagaggaucgaaaacauuaagaaugagcacaaaaguacuuggcauuacgaugaagacaacccauauaagacgugggccuaccacggcuccuaugaggugaagcccagcgggucagcauccucuaugguuaauggagucgugcggcugcuaacaaaaccuugggaugugaucccaauggucacccagauugccaugacugacaccacacccuuuggucaacagagaguuuucaaggagaaaguggacacgcgcaccccgagggcuaagcgaggcacuacacagaucauggaaguaaccgcgcgguggcuuuggggguuucugagcagaaacaaaaagccuaggauauguacucgcgaggaguucacacguaaggugcggaguaaugccgcaauuggagcugucuuuguggaugagaaccaguggaacuccgccaaagaagcaguugaggacgagagauucugggaucucgugcacagggaacgcgagcugcauaagcaaggcaaaugcgcaaccugcgucuacaacaugauggguaagcgagagaaaaaguugggggaguuuggaaaggcuaaaggcagccgggccaucugguacauguggcugggcgcgagauuccucgaguucgaggcacuuggguuuaugaaugaggaccacugguucucuagggaaaacucacugaguggaguggagggugaaggcuuacauaagcugggguauaucuugcgcgauauuuccaaaauaccaggaggcaauauguacgccgacgauacagcugguugggacacuagaaucaccgaggaugaccuccagaacgaggccaagauuacggauaucauggaacccgagcacgcacugcuagcuaccagcauuuuuaaacuuacauaucagaauaagguaguucgggugcagaggccugccaaaaacgggacugucauggacgugaucucucgucgagaucaacgcggaucgggccaggugggcaccuacgggcugaacacauucacuaauauggaaguccagcucauaagacagauggagucagaaggaaucuuuagcccauccgagcuggagacccccaacuuggcugaacggguuuuagacuggcuggagaagcauggugccgaaaggcucaagcgcauggcaauuaguggcgacgauugugugguaaaaccgaucgacgauagauucgcgacggcccuuacagcucugaaugacauggggaaggugcggaaagauauuccucaaugggagcccucuaagggauggaacgacuggcagcaggucccauuuugcagccaccacuuccaucagcuaaucaugaaagauggcagggaaauagugguuccuugucgaaaucaagacgagcuggugggucgugccagagucucccagggggcaggauggucacuccgcgagaccgcuugcuugggcaagaguuaugcccagauguggcaacugauguacuuucaccggagggaucuuagacuggcagccaacgcgauuuguucugcugugcccguagacuggguuccaacuagccgcacaaccugguccauccaugcccaccaccaguggaugacuaccgaagauaugcucucaguguggaaucgggucuggaucgaggaaaaccccuggauggaggacaagacacaugugagcucuugggaagagguuccuuauuuaggcaaaagggaggaccaguggugcgggucccugauuggauugacggcacgagccaccugggcuacuaauauacagguggccaucaaccaagucagacggcugauugguaaugaaaacuaccucgauuacaugacaaguaugaagagguucaaaaaugagagcgacccagaaggcgcacuuugguga

SEQ ID NO: 13499 - RNA, 9879 nt, Artificial Sequence
  derived and/or modified CDS sequence (opt3) from DENV-1__EU482610__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuuggguucugcggcacccuggauucaccgugauugcuuuuuuccuggcacaugccaucggcacaucgauuacccagaagggcaucauauuuauccucuuaaugcuggucacgccaucaauggcuaugcgcugcguggggauuggaaacagagacuucguagagggucuuagcggcgccacuuggguugauguggucuuggaacacgggaguugugugacaaccauggcgaagaauaaacccacucuggacaucgagcuacucaagacagaagugaccaacccugcaguccugaggaaacuuugcauugaggccaagaucuccaauacgaccacagauucucgguguccaacucaaggagaagcuacccugguugaggagcaggacgccaacuuugugugccgccgaacauucguagauagaggcugggguaauggguguggauuguuuggcaaaggcagccuccugacuugcgcaaaguucaagugcgugaccaaauuagaagggaagauaguccaguacgagaaccugaaauauuccgugauuguuacagugcacaccggagaccagcaucaagucgguaaugaaacuacggagcacggcacaaucgcuaccauuacuccccaggccccuaccucagaaauccagcucacagauuacggggcgcuuacccuggacuguaguccaaggacuggauuggacuuuaacgagauggugcuacugacaaugaaggagaaaagcuggcucguacauaagcagugguuccuggaucuuccgcugcccuggacgucuggcgccuccaccucacaagaaacuuggaaucggcaggacuugcucguuacauuuaaaaccgcacacgcuaagaagcaggagguggucgugcuggguagccaagaaggggccaugcacacagcuuuaacuggcgccaccgagauccagacgaguggaaccacaacuauuuucgcaggccaucugaaaugccgucuaaagauggauaaacucacccugaaggggaugucuuaugucauguguacaggauccuucaaacuugaaaaggagguggccgagacucagcacgguaccguuuuggugcagguaaaguacgaaggcacggacgcuccuugcaaaauaccauuuagcacacaagaugagaagggggucacccagaacggacgccugaucacugcgaaucccauugugacagacaaagaaaagccuguuaacaucgagaccgagccacccuucggcgaaucguauauaguggucggugcaggggagaaagcccucaagcugucuugguuuaagagaggcuccucaauuggaaaaauguucgaagcuacugccaggggcgcacggcgaauggccauccuuggggauaccgcuugggacuuuggaaguaucgguggcguguucacaagcguagggaagcuggugcaucagguuuuuggaacggccuacggcgucuuguucuccggugugucuuggaccaugaaaauugggaucggcauucuccugacuugguuaggacugaauagccgcucaacaagucuauccaugaccuguauagcagugggcauggucacacucuaccuggggguuauggugcaggcggauagcggaugcgugaucaacuggaagggcagagagcuuaaaugugguucugggauuuuuguaacuaacgaaguccacaccuggacggagcaauauaaguuccaggcugacucaccgaagagguugagugccgcaaucggaaaagccugggaggaaggcgugugcgguauccggagcgcuacacgccuggagaauauuauguggaagcagauauccaacgaacucaaucauauccuguuagagaacgauaugaaacugaccguuguggucggcgacgccaaugggauucuugcacagggaaagaaaaugaucagaccucaacccauggaacacaaguacucuuggaaaucguggggcaaggcuaagauuaucggggccgacauacagaacacuaccuuuaucauugauggaccagacacaccugagugucccgauggccagagggcguggaauaucugggagguggaagacuaugguuucgggguuuuuacuaccaacauuugguugaaacuccgugauagcuacacacagaugugcgaccaccggcugauguccgccgcuaucaaggauucaaaagcagugcaugccgacaugggauauuggauagagagugaaaagaaugagacguggaaacuagcucgagccucuuucauugaaguaaagaccuguacuuggccaaagagccacacacugugguccaacggcguccucgagucagagaugaucauucccaaaaucuacgguggcccuauaagccaacauaauuauagaccaggguacuucacccagacugcaggaccguggcaccugggcaagcuugaauuggauuuugaccugugcgaggggacaaccgugguggucgaugaacacugcggaaacaggggccccucuuuacgcacgacuaccguuacagguaaaaucauucaugagugguguugccgguccuguacccucccuccacugagauucaggggggaggacggaugcugguacggcauggaaauccgccccgugaaggagaaagaagagaaucuuguacgaaguauggugagcgcggguucuggcgaagucgauuccuuuucacuggggauuuugugugugaguaucaugauagaggagguuaugcggagccguuggucgagaaagaugcucaugacuggaacacuggccguguuccuacugcucauuaugggccagcugaccuggaacgaccuuaucagguugugcaucauggucggggcuaaugccuccgaccgcaugggaaugggcacaacuuaucuggcauuaauggcuaccuuuaagaugcggccuauguucgccgugggucuccuguuuagaaggcuuacgucucgagaaguucugcuacucacaauugggcugagcuugguggcaucagucgagcugccaaacaguuuagaagagcucggagauggccuggccaugggcaucaugaugcuuaaacuguugaccgaauuccaaccccaccagcucuggacuacccugcuaucccugacauuuguaaagacuacccuuucucucgacuacgcuuggaaaacgacagcgauggugcugagcauuguuuccuuguucccgcuguguuuaucaaccacuagccagaagacaaccuggcucccugugcugcuugggaguuuuggaugcaaaccacugacuauguucuugauaacagagaacaagaucuggggucgcaagucuuggccccucaaugagggcauuauggccaucgggauugucuccauccugcuaagcucgcugcuuaaaaacgaugugccucucgcaggaccccugauagcuggcgguauguugaucgccuguuauguaauuucagggucuagugccgacuuaucccuggaaaaggcugcagaggugagcugggaacaggaggccgaacauucuggagcgagccacaauauccucgucgagguucaagaugacggcaccaugaaaauuaaggaugaggaacgggacgauacgcugacuauccuucugaaagcuaccuugcuagccguguccggcguguacccaaugucaauaccugcaacacuguuugucugguauuucuggcagaagaaaaagcagagaaguggggugcucugggacacccccagcccaccggagguugaaagggccguacuggaugacggaauuuaccguauccuucagcgcgguuuacugggccggucucaagugggggucggaguguuccaggauggcguuuuucauacaauguggcacgugacuagaggugcuguccucauguaucaggggaagagguuggagccuuccugggcaucagugaaaaaggaccugaucaguuacggaggcggcuggcgauuccaggggagcuggaacaccggagaggaaguacaagucauugccguggagcccgguaaaaauccaaagaacguucagacgacacccggcacuuuuaaaaccccugaaggggaggugggagcgauagcucucgacuucaagccaggcacauccgguucucccaucgucaaucgggaagggaagauugugggacuguacggcaacggcguugugaccacuucggggaccuaugucagcgccaucgcacaggccaaagcuucacaagagggaccucuuccggagauugaagaugagguguuuaagaaacgcaaucugacaaucauggacuugcacccagguuccggcaagacgagaagguaccuacccgccauaguacgggaagcaaucaaacgaaagcugagaacucucauuuuagcuccuacccgcgugguugccagugagauggcggaagcccugaaggggaugccaaucagguaucagacaaccgcagucaaaucugagcauacuggacgugagauuguggaucuuaugugccacgcuacauucaccaugcggcugcucagccccgugagagucccuaacuacaauaugaucauaauggacgaagcccauuuuacggauccggcuuccauugcagccaggggcuauaucucaacucgcguagguaugggggaggccgcugcgaucuucaugacagcaacccccccaggaucuguggaagccuuuccucagagcaacgcuguuauucaggacgaggaacgagauauccccgagagaaguuggaauuccggcuacgacuggauaaccgauuucccaggcaagacugugugguuugucccuagcauuaaaucugggaacgacaucgccaauuguuugcggaagaacggaaaaagggugauucaacugucacgcaagacauucgauaccgaguaucagaagacaaaaaacaaugacugggacuacguugugacuacggauaucuccgaaaugggugcaaacuuccgugccgacagagucauagauccccggaggugccucaagccagugauucugaaagacggcccggagcgcguaauccuugcugggccuaugcccgugaccguugcgagugccgcacagcgaagaggacggaucggcaggaaucagaacaaggaaggugaucaauacgucuauauggggcagccacuaaauaacgacgaggaucacgcucauuggacagaggccaaaaugcuguuggacaauauuaacacucccgaaggcaucauuccugcauuauuugagccagaacgcgagaagagcgccgcuauagauggagaauacagacugaggggcgaggcccggaagaccuucguggagcucaugcgucgcggggaccugcccguguggcuuucguauaaagucgcgucugaaggauuucaguacuccgaucgaagauggugcuucgacggugagaggaauaaccagguucuggaagagaauauggauguggaaaucuggacaaaggagggcgagcggaaaaagcuccgcccuagaugguuggacgcaaggaccuauagcgacccgcuggcccuacgggaauuuaaagaguucgcugccgggcgaagaucaguaaguggagaucugauucucgaaaucggcaagcuuccacaacaccugacuuuacgcgcucagaacgcauuggacaaucuggugaugcuccacaacucugagcagggugggaaagccuacaggcaugcuauggaagagcugcccgauacgaucgagacccuuaugcugcucgccuugauugcaguccugacaggcggagugacuuuauuuuuccuauccggcaaggggcugggaaagaccagcauaggucuccuuuguguuacagcgucaagugcccuguuguggauggcuagcguggaaccucacuggaucgccgcauccauuauccuggaguuuuuccucaugguccugcuuauucccgaaccagaccggcagcguaccccucaagauaaucagcucgcuuauguagugaucggccuguuguuuaugauacugacuguugccgcaaacgagaugggguuacuagagacaacgaaaaaggaccugggaaucggcuacguggccgcugaaaaccaucagcacgcgaccaugcucgaugucgaccuucaccccgccucugcauggacucuguacgcuguggccacaaccgucauuaccccaaugaugagacauacaaucgagaauacuacggccaacauuagcuugaccgcaaucgcuaaucaagccgcgauacugaugggucucgauaaaggguggccuauuuccaagauggacaucggcgugccgcugcuugcuuuaggaugcuauucacagguuaacccccugacacucacugccgcaguguugaugcugguagcccacuacgcuauuaucggcccagggcuacaggcaaaagccaccagggaagcgcagaagcgcacagcugccggaauaaugaagaauccuaccguggauggcaucgucgcaauugaccuggaucccguuguguaugacgccaaauucgagaagcaacucggucagaucaugcuucugauuuuguguacuucucagauccugcucaugcggacgacaugggcucugugcgaaaguauaaccuuagccacugggccacuuaccacacugugggagggaucgccuggcaaauuuuggaacacuaccauugcagucagcauggcuaauaucuuccgagguuccuaccucgccggcgcggggcuagccuucucucugaugaagucauugggaggcgggagaaggggaacaggcgcacagggugagacgcugggggaaaaauggaagcgccaacucaaccagcuuagcaaguccgaguuuaauaccuauaaacggaguggaaucauggaaguggacagaucugaggcuaaggaaggccugaaacguggugagacuacaaagcaugccguaagcaggggcaccgcaaaauugcggugguucguggagcgcaaccugguuaagcccgaagggaaggugauugaucucggauguggccgagggggauggucauacuauugcgcuggcuuaaaaaaggucacugaggugaaagguuacacaaaggggggaccgggccacgaagagccaaucccuauggccaccuacggcuggaaucuggucaaacuucauuccgggaaggacguguuuuucaugcccccagaaaaaugugauacgcugcuaugcgacauaggagagaguagccccaacccuaccauugaggaagguagaacacucaggguucugaagaugguagagccgugguugcggggcaaucaguuuuguaucaagauucugaaccccuauaugccaucuguggucgaaacucucgagcagaugcaacgcaaacacgggggaaugcuugugagaaauccucuguccaggaacucaacccacgagauguacuggguuagcugcggcacagguaauaucgugucggccgucaacaugacuucucgaauguuacugaaccgguucaccauggcgcaucguaagcccacauaugaaagagauguggacuugggggcuggaacccgccacguagcaguggagccugaaguugccaaucucgauauaaucggccagaggauugagaacaucaaaaaugaacauaagaguacuuggcacuacgacgaggauaacccauauaaaacgugggcuuaccacggcuccuaugaggucaagcccagcgggucagccuccucuauggugaauggagugguccggcugcuaacaaagccuugggacguuauuccaauggugacccagaucgcaaugacugauaccacacccuuuggucaacagagaguauucaaagaaaagguggacacgcgcaccccgagggccaaacgaggcacuacacagauuauggaggucaccgcuaaguggcuuuggggguuucugagccggaacaaaaagccuagaaucuguacuagggaagaguucacacgcaaggugcguaguaaugcggccauaggagcaguuuuuguggacgaaaaccaguggaauuccgcuaaagaggccgucgaggaugaacgguucugggaccucgugcauagagagagggaacugcacaagcaaggcaaaugcgcaaccugcguauacaacaugauggguaagcgcgagaaaaaguugggggaauuuggaaaggccaaaggcagccgagcuauuugguacauguggcugggcgcccgguuccucgaguucgaggcgcuuggguuuaugaaugaagaucauugguucucuagagagaacucacugaguggaguugaaggugagggcuuacacaagcugggguauaucuugagggacaucuccaaaauuccaggaggcaauauguacgcagaugacacagccgguugggauacucgcauaaccgaggacgaucuccagaacgaagcuaagaucacggacauuauggagcccgaacaugcccugcuagcaaccagcaucuuuaaacuuacauaucagaauaagguggucagagugcagcggccugcuaaaaacgggacugugauggaugucauuucuaggcgugaccaacgaggaucgggccagguuggcaccuacgggcugaacacauucacuaauauggaggugcagcucauccgccagauggaaucagagggaauauuucugccaagcgaguuggaaacccccaacuuagccgagagagcucuggauuggcucgaaaagcacggugccgagcggcuuaagaggauggcaaucuccggcgacgacuguguagugaaaccgauugaugaccgcuucgcgacggcccugacagcucuaaaugauauggggaaggucagaaaagacaucccucaaugggaacccaguaagggauggaacgauuggcagcaggugccauuuugcucucaccauuuccaccagcugauuaugaaagacggccgggagaucguugugccuuguaggaaucaagaugagcucgucggucgagcccgugugagccagggggcaggaugguccuugagagaaaccgcuugccugggcaagucauaugcccagauguggcaacuuauguacuuucaucgccgggaccugaggcucgcagccaacgcgauauguagugcuguacccguugauugggugccaacuucuagaacaaccuggagcauucacgcccaccaucaguggaugacuaccgaggacauguuauccgucuggaaucgcguguggaucgaagagaaccccuggauggaagauaagacacacguuucaagcugggaggaggugccuuaucugggcaaacgggaagaccaguggugcgggucuuugaucggacugacggcaagggccaccugggcuacuaauauucaggucgccauaaaccaagugcgaagacucaucgguaaugagaacuaccuugacuacaugacauccaugaagcgguucaaaaaugaaagugauccagagggcgcacugugguga

SEQ ID NO: 13500 - RNA, 9879 nt, Artificial Sequence
  derived and/or modified CDS sequence (opt3) from DENV-1__EU482611__SS-prME
agcgugaccaugcugcucaugcuucugcccaccgcauuggcuuuccacuuaacuacgaggggcggggagccucauaugaucgucuccaagcaggaaaggggaaaaucucuguuauuuaagaccucagccgguguuaauaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaacugaccgugguugugggcgacgcaaaugggauucuugcucagggaaagaaaaugaucagaccucaacccauggaacacaaguacucuuggaaaucguggggcaaggccaagauuaucggggcggacauacagaacacuaccuuuaucauugauggaccagacacaccugagugucccgauggccagagggccuggaauaucugggaggucgaagacuaugguuucgggguguuuacuaccaacauuugguugaaacuccgugauagcuacacacagaugugcgaccaccggcugauguccgcugcaaucaaggauucaaaagccguucaugcugacaugggauauuggauagagagugaaaagaaugagacguggaaacuagcccgagcaucuuucauugaagugaagaccuguacuuggccaaagagccacacacugugguccaacggcguacucgagucagagaugaucauucccaaaaucuacgguggcccuauaagccaacauaauuauagaccaggguacuucacccagacugcgggaccguggcaccugggcaaacuugaauuggauuuugaccugugcgaggggacaaccgucgugguggaugaacacugcggaaacaggggccccucuuuacgcacgacuaccgucacagguaaaaucauucaugagugguguugccgguccuguacccucccuccacugagauucagaggggaagacggaugcugguacggcauggaaauccgccccguuaaggagaaagaagagaaucuugugcgaaguaugguaagcgccgguucuggcgaaguggauuccuuuucacuggggauuuugugugucaguaucaugauagaggaggugaugcggagccguuggucgagaaagaugcucaugacuggaacacuggcuguuuuccuacugcucauuaugggccagcugaccuggaacgaccuuaucagguugugcaucauggugggggccaaugcauccgaccgcaugggaaugggcacaacuuaucuggcuuuaauggccaccuuuaagaugcggccuauguucgcagucggucuccuguuuagaaggcuuacgucucgagaagugcugcuacucacaauugggcugagcuugguugccucaguggagcugccaaacaguuuagaggaacucggagauggccuggcuaugggcaucaugaugcuuaaacuguugaccgaguuccaaccccaccagcucuggacuacccugcuaucccugacauuugucaagacuacccuuucucucgacuacgcguggaaaacgacagccaugguacugagcauuguguccuuguucccgcuguguuuaucaaccacuagccagaagacaaccuggcucccuguucugcuugggaguuuuggaugcaaaccacugacuauguucuugauaacagagaacaagaucuggggucgcaagucuuggccccucaaugagggcauuauggcaaucgggauuguguccauccugcuaagcucgcugcuuaaaaacgaugucccucucgcuggaccccugauagccggcgguauguugaucgccuguuaugugauuucagggucuagugcugacuuaucccuggaaaaggcagccgagguaagcugggaacaggaggcggaacauucuggagcuagccacaauauccucguggagguccaagaugacggcaccaugaaaauuaaggaugaggaacgggacgauacgcugacuauccuucugaaagccaccuugcuagcaguuuccggcguguacccaaugucaauaccugccacacuguuugugugguauuucuggcagaagaaaaagcagagaagugggguccucugggacacccccagcccaccggagguggaaagggcuguucuggaugacggaauuuaccguauccuucagcgcgguuuacugggccggucucaaguaggggugggagucuuccaggauggcguguuucauacaauguggcacguuacuagaggugcagugcucauguaucaggggaagagguuggagccuuccugggccucagucaaaaaggaccugaucaguuacggaggcggcuggcgauuccaggggagcuggaacaccggagaggaagugcaaguaauugcggucgagcccgguaaaaauccaaagaacgugcagacgacacccggcacuuuuaaaaccccugaaggggagguuggagcuauagcccucgacuucaagccaggcacauccgguucucccaucgugaaucgggaagggaagauugucggacuguacggcaacggcgugguuaccacuucggggaccuaugugagcgcaaucgcccaggcuaaagccucacaagagggaccucuuccggagauugaagaugaggucuuuaagaaacgcaaucugacaaucauggacuugcacccagguuccggcaagacgagaagguaccuacccgcaauagugcgggaagcuaucaaacgaaagcugagaacucucauuuuagccccuacccgcguaguggcgagugagauggccgaagcacugaaggggaugccaaucagguaucagacaaccgcuguuaaaucugagcauacuggacgugagauugucgaucuuaugugccacgccacauucaccaugcggcugcucagccccgugagagugccuaacuacaauaugaucauaauggacgaagcucauuuuacggauccggcauccauugccgccaggggcuauaucucaacucgcgucgguaugggggaggcugcggcaaucuucaugacagccacacccccaggaucuguagaggcuuuuccucagagcaacgccgugauucaggacgaggaacgagauauccccgagagaaguuggaacuccggcuacgacuggauaaccgauuucccaggcaagacuguuugguuugugccuagcauuaaaucugggaacgacaucgcaaauuguuugcggaagaacggaaaaagggucauucaacugucacgcaagacauucgauaccgaguaucagaagaccaagaauaaugacugggacuacgugguuacuacggauaucuccgaaaugggugccaacuuccgugcugacagagugauagauccccggaggugccucaagccagucauucugaaagacggcccggagcgcgugauccuugcggggccuaugcccguaaccguggccagugcagcucagcgaagaggacggaucggcaggaaucagaacaaggaaggugaucaauacguuuauauggggcagccacuaaauaacgacgaggaucacgcccauuggacagaggcaaaaaugcuguuggacaauauuaacacucccgaaggcaucauuccugccuuauuugagccagaacgcgaaaagagcgcugccauagauggagaauacagacugaggggcgaggcgcggaagaccuucgucgagcucaugcgucgcggggaccugcccguguggcuuucguauaaaguggcaucugaaggauuucaguacuccgaucgaagauggugcuucgacggugagaggaauaaccagguccuggaagagaauauggauguugaaaucuggacaaaggagggcgagcggaaaaagcuccgcccuagaugguuggacgccaggaccuauagcgacccgcuggcucuacgggaauuuaaagaguucgccgcugggcgaagaucagugaguggagaucugauucucgaaaucggcaaacuuccacaacaccugacuuuacgcgcacagaacgccuuggacaaucugguaaugcuccacaacucugagcagggugggaaggcuuacaggcaugccauggaggaacugcccgauacgaucgagacccuuaugcugcucgcauugauugcggugcugacaggcggagucacuuuauuuuuccuauccggcaaggggcugggaaagaccagcauaggucuccuuugugugacagccucaagugcucuguuguggauggccagcguugaaccucacuggaucgcagcuuccauuauccuggaguuuuuccucauggugcugcuuauucccgaaccagaccggcagcguaccccucaagauaaucagcucgccuaugucguaaucggccuguuguuuaugauacugacuguggcagccaacgagaugggguuacuagagacaacgaaaaaggaccugggaaucggcuacguugcugcggaaaaccaucagcacgccaccaugcucgauguggaccuucaccccgcaucugcuuggacucuguacgccgucgccacaaccgugauuaccccaaugaugagacauacaaucgagaauacuacggcaaacauuagcuugaccgcuaucgccaaucaagcggcuauacugaugggucucgauaaaggguggccuauuuccaagauggacaucggcgucccgcugcuugccuuaggaugcuauucacaggugaacccccugacacucacugcagccguuuugaugcugguggcucacuacgcaauuaucggcccagggcuacaggccaaagcgaccagggaagcucagaagcgcacagccgcaggaauaaugaagaauccuaccguagauggcaucguggccauugaccuggaucccgucguuuaugacgcuaaauucgagaagcaacucggucagaucaugcuucugauuuuguguacuucucagauccugcucaugcggacgacaugggcccugugcgaaaguauaaccuuagcaacugggccacuuaccacacugugggagggaucgccuggcaaauuuuggaacacuaccauugcugugagcauggccaauaucuuccgagguuccuaccucgcgggcgccgggcuagcauucucucugaugaagucauugggaggcgggagaaggggaacaggcgcucagggugagacgcugggggaaaaauggaagcgccaacucaaccagcuuagcaaguccgaguuuaauaccuauaaacggaguggaaucauggaagucgacagaucugaggccaaggaaggccugaaacguggugagacuacaaagcaugcagugagcaggggcaccgcuaaauugcggugguucguagagcgcaaccuggugaagcccgaagggaagguuauugaucucggauguggccgagggggauggucauacuauugcgccggccugaaaaaggugacugaggucaaagguuacacaaaagggggaccgggccacgaggaaccaaucccuauggccaccuacggcuggaaucuagugaaacuucauuccgggaaggacgucuuuuucaugcccccagaaaaaugugauacgcugcuaugcgacauaggagagaguagccccaacccuaccauugaggaagguagaacacucagggugcugaagaugguugagccgugguugcggggcaaucaguuuuguaucaagauucugaaccccuauaugccaucuguaguggaaacucucgagcagaugcaacgcaaacacgggggaaugcuugucagaaauccucuguccaggaacucaacccacgagauguacugggugagcugcggcacagguaauaucguuucggcggugaacaugacuucucgaauguuacugaaccgguucaccauggcucaucguaagcccacauaugaaagagaugucgacuugggggcaggaacccgccacguggccguagagccugaaguggcuaaucucgauauaaucggccagaggauugagaacaucaaaaaugaacauaagaguacuuggcacuacgacgaggauaacccauauaaaacgugggccuaccacggcuccuaugagguuaagcccagcgggucagcauccucuauggucaauggaguggugcggcugcuaacaaagccuugggacgucauuccaaugguuacccagaucgccaugacugauaccacacccuuuggucaacagagaguguucaaagaaaagguagacacgcgcaccccgagggcuaaacgaggcacuacacagauuauggaggugaccgcgaaguggcuuuggggguuucugagccggaacaaaaagccuagaaucuguacuagggaagaguucacacgcaagguccguaguaaugccgcaauaggagcuguguuuguugacgaaaaccaguggaacuccgccaaagaggcaguggaggaugaacgguucugggaccucguccauagagagagggaacugcacaagcaaggcaaaugcgcuaccugcguguacaacaugauggguaagcgcgagaaaaaguugggggaauuuggaaaggccaaaggcagccgagccauuugguacauguggcugggcgcgcgguuccucgaguucgaggcacuuggguuuaugaaugaagaucauugguucucuagagagaacucacugaguggaguagaaggugagggcuuacacaagcugggguauaucuugagggacaucuccaaaauuccaggaggcaauauguacgccgaugacacagcugguugggauacucgcauaaccgaggacgaucuccagaacgaagccaagaucacggacauuauggagcccgaacaugcacugcuagcuaccagcaucuuuaaacuuacauaucagaauaagguugugagaguccagcggccugccaaaaacgggacugugauggaugugauuucuaggcgugaccaacgaggaucgggccaggucggcaccuacgggcugaacacauucacuaauauggagguucagcucauccgccagauggaaucagagggaauauuucugccaagcgaguuggaaacccccaacuuagcugagagagcccuggauuggcucgaaaagcacggugcagagcggcuuaagaggauggcgaucuccggcgacgacugugugguaaaaccgauugaugaccgcuucgccacggcucugacagcccuaaaugauauggggaaggugagaaaagacaucccucaaugggaacccaguaagggauggaacgauuggcagcaggucccauuuugcucucaccauuuccaccagcugauuaugaaagacggccgggagaucgugguuccuuguaggaaucaagaugagcucgugggucgagcacgugucagccagggggcuggaugguccuugagagaaaccgccugccugggcaagucauaugcacagauguggcaacuuauguacuuucaucgccgggaccugaggcucgccgcgaacgcuauauguagugccgugcccguagauuggguuccaacuucuagaacaaccuggagcauucacgcacaccaucaguggaugacuaccgaggacauguuauccguguggaaucgcgucuggaucgaagagaaccccuggauggaagauaagacacacgugucaagcugggaggagguuccuuaucugggcaaacgggaagaccaguggugcgggucuuugaucggacugacggccagggcuaccugggccacuaauauucagguggcaauaaaccaaguccgaagacucaucgguaaugagaacuaccuugacuacaugacauccaugaagcgguucaaaaaugaaagugauccagagggcgcucugugguga

SEQ ID NO: 13501 - RNA, 9879 nt, Artificial Sequence
  derived and/or modified CDS sequence (opt3) from DENV-1__FJ639735__SS-prME
agcgugaccaugcugcucaugcuucugcccaccgccuuggcuuuccacuuaacuacgagaggaggggaaccucauaugaucgucuccaagcaggaaaggggaaaaucucuguuguuuaagaccucagccgguguuaacaugugcacacucauugccauggaccugggagaacuuugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuacagcacuguuucucgcccaugcuauuggcaccucgaucacgcagaagggcauuaucuucauauuacugaugcuugugacuccaucaauggccaugcgcugcgucgggaucggaaacagagauuuuguggaggguuugagcggcgcgacauggguagacguugugcuggagcacgggaguugugucaccacuauggcaaagaauaaacccacacuagauauugaacuccugaagaccgaggugacgaacccugccgugcuuaggaaacugugcaucgaagcuaagauuuccaauaccacaacugacucucgguguccaacccaaggagaggccacauuggucgaagaacaggaugcaaacuucguuugccgccgaacuuuuguggacagaggcugggguaauggguguggacucuucggcaaaggcagccuguuaaccugcgcuaaguuuaagugcguaacaaaacuggaggggaagaucgugcaguacgaaaaccucaaauauuccgucauagugaccguucacacuggagaucagcaucaaguggguaaugagacgacagaacacggcaccauugccacuaucacaccccaggcgccuacaucagagauucagcuuaccgacuacggggcccugacuuuggacuguaguccaaggacaggacuagauuucaacgaaaugguccugcucacgaugaaggagaaaagcuggcuggugcauaagcagugguuucuugaccugccguugcccuggaccucuggcgcauccacuucacaagagacauggaaucggcaggaucuccugguaaccuucaaaacagcucacgccaagaagcaggaaguuguggucuuagguagccaagagggggcuaugcacacugcccugaccggcgcaacggaaauccagaccaguggaacaacuaccaucuuugccggccaucuaaaaugccgucucaagauggacaaacugacacuuaaggggacuucuuaugugauguguaccggauccuucaaauuggagaaggaagucgcugagacgcagcacgguacagugcugguucaggugaaguacgagggcaccgaugcgccuugcaaaauuccauucagcacucaagacgaaaaggggguaacacagaacggacgccucauaaccgcaaaucccaucgucacugauaaagagaagccugugaacauugaaaccgagccacccuuuggcgagucguauaucguugugggugccggggaaaaagcucugaaacuuucuugguucaagaaaggcuccucaauaggaaagauguuugaggccacagcaagaggcgccaggcggauggcuauucugggggacacggccugggauuucggaaguaucgguggcgucuuuaccagcguggggaaauugguacaucagguguucggaacugcauacggcguucucuuuuccggugucucuuggacaaugaagaucgggauuggcauccuguuaaccuggcugggacuaaauagccgaucaacaagucucuccaugacuuguauugcggugggcauggugacccuguaccuuggggucaugguucaggcugacagcggaugcgugauaaacuggaaaggccgcgaauugaagugugguucugggaucuucgugacgaacgagguacacacauggaccgaacaauauaaguuucaggccgauucaccgaaaagacugagugcagccauuggaaaggcuugggaggagggcgucugcgguaucaggagcgccacucggcucgaaaauaucauguggaaacagauuuccaacgagcugaaucauauauuacuggaaaacgacaugaaguucaccgugguugugggcgacgcaaaugggauccuugcucagggcaagaagaugauucgcccucaacccauggagcacaaauacucuuggaagucguggggcaaggccaaaaucauuggggcggauauccagaacacaacuuuuauaaucgacggaccagauaccccugaaugucccgacgaucagagagccuggaauauuugggaggucgaggacuauggcuucgguaucuuuacaacgaacauuugguugaagcucagggauagcuacacccagaugugcgaccaccgucugauguccgcugcaaucaaagauucaaaggccgugcaugcugacaugggguauuggauagaaagugagaaaaaugaaacuuggaagcuagcccgggcaucuuucauugagguuaagacauguaccuggccaaaaagccacacucugugguccaacggagugcucgaaucagagaugaucauucccaagaucuacggcgguccuauaagccaacauaauuaucgaccaggcuacuucacacagaccgcggggccguggcaccugggaaaacuugaguuggauuuuaaccugugcgaaggcacgacuguagucguggacgagcacugcgggaauagaggacccucuuuaaggaccacaaccgugacuggcaagaucauucaugaaugguguugccgcuccuguacacucccuccacugcgguucagaggugaggaugggugcugguacggaauggagaucaggcccgucaaagaaaaggaggaaaaccuuguucgcaguauggugagcgccggcucuggugagguagacuccuuuucacugggcauuuugugugugaguaucaugauagaagaggucaugcgaagccgguggucgcguaagaugcucaugaccgggacacuggcuguguuccuacugcucauuaugggacagcugacuuggaaugaccuuaucagauugugcaucaugguuggcgccaacgcauccgauaggauggggaugggaaccacguaucuggcuuuaauggccacauuuaaaaugcgcccuauguucgcagugggccuccuguuucggagacuuaccucuagggagguccugcuacucacuauuggucugagcuugguggccucaguugaacugccaaacaguuuagaggaacucggggacggacuggcuaugggcaucaugaugcuuaagcuguugaccgaguuccaaccccaccagcucuggacaacucugcuaucccugaccuuuauuaaaacgacacuuucucucgauuacgcguggaagaccacugccauggcacugagcauaguguccuuguucccgcuguguuuaucaacaaccagccagaaaacuacauggcucccuguccugcuuggcaguuuugggugcaagccacugaccauguucuugaucacggaaaauaagauuuggggacgaaaaucuuggccccucaacgaggguaucauggcuauuggcaucguauccauacugcuaagcucgcugcuuaagaaugacgugccucucgccgggccccugaucgccggaggcauguugauugcuuguuauguuaucucagguucuagugcagauuuaucccuggagaaagccgcggaagugagcugggagcaggaagcugagcauucugggacuagccacaacauucucgucgaagugcaagacgauggaaccaugaagaucaaagacgaggagaaggaugacacacugaccauacuucugaaagccacauugcuagcaguauccggcguguacccaaugucaauuccugccacucuguuugucugguauuucuggcagaagaagaaacagcgcaguggcguucucugggauacccccagcccaccggaaguggagcgggcugugcuggacgaugggaucuacagaauccuucagaggggauuacugggucguucucaagucggcguggggguuuuccaggacggaguauuucauacgauguggcacgugacacgcggcgcaguccucauguaucaggguaagcgguuggaaccuuccugggccucagugaaaaaggaccugauuaguuacgggggaggcuggagauuccagggcagcuggaauacuggggaggagguucaagugauagcggucgaacccggcaagaacccaaagaaugugcagaccacacccgguaccuuuaagacuccugagggcgaaguaggggcuaucgcccucgauuucaaaccaggaaccuccggcucucccauugucaacagggaggguaagaucguggggcuguacggaaauggcguugugacaacgucgggcacuuaugucagcgcaauugcccaggcuaaagccucacaagaagggccucuuccggagaucgaggacgaaguguuuaagaaacgaaaccugaccauaauggauuugcacccaggauccgguaagacacggcgcuaccuacccgcaaucguuagagaggcuauuaagaggaaacugcggacccucaucuuagccccuacucgaguggucgcgagugaaauggccgaggcacugaagggcaugccaauuagauaucagacaaccgcugugaaaucugaacauacggggcgcgagaucguagaccuuaugugccacgccacuuucacaaugaggcugcucagccccgugcguguuccuaauuacaacaugauagucauggaugaggcucauuuuaccgacccggcauccauugccgcccggggauauaucucaaccagagugggcaugggugaagcugcggcaaucuucaugacugccacacccccagggucuguggaggcuuuuccucagagcaaugccgucauucaggaugaagagagggacauccccgaacgcaguuggaacuccggauacgauuggauaaccgacuucccaggcaagacaguaugguuugugccuagcauuaaaucuggcaaugauaucgcaaacuguuugcgaaagaacgggaagagaguuauucaacugucacggaaaacuuucgacacggaguaucagaagaccaaaaauaacgacugggauuacguggucacaacugacaucuccgagaugggagccaauuucagggcugaucgcgugauagacccccguagaugccucaagccaguuauucugaaagaugguccggaacgggugauccuugcgggcccuaugcccgucaccguggccagugcagcucagaggcgcgggcgaaucggaagaaaccagaauaaggagggcgaccaauacguauauaugggucagccacuaaacaaugaugaagaccacgcccauuggacagaggcaaagaugcuguuggauaacauuaauacccccgaggggaucauuccugccuuauuugaaccagagcgggaaaagagcgcugccauagacggcgaguacaggcugcgcggagaggcgagaaagacuuucguggagcucaugaggcggggcgaucugcccguuuggcuuucguauaaagucgcaucugagggguuucaguacuccgaccgucgcuggugcuucgauggagaacgaaacaaucaggugcuggaggaaaacauggacguggagaucuggacgaaggaaggugagaggaagaagcucaggccucggugguuggacgcccgcaccuauagcgauccgcuggcucuaagagaguuuaaagaguucgccgcuggcaggcggucagucaguggggaccugauucucgagaucggaaaacuuccacaacaccugacauuacgagcacagaaugccuuggauaaccugguuaugcuccacaauucugaacagggcgguaaggcuuacagacaugccauggaggaacugcccgacacuaucgagacccuuaugcugcucgcauugauugcggugcugacagggggcguaaccuuauuuuuccuauccggaaaaggccuggggaagacuagcauaggacuccuuugugugacagccucaagugcucuguuguggauggccagcgucgagccucacuggaucgcagcuuccauuauccuggaauuuuuccucauggugcugcuuauucccgagccagaucgccagaggacgccucaagacaaccagcucgccuauguugugaucggucuguuguuuaugauacugaccgucgcagccaacgaaaugggcuuacuagagacuacaaaacgggaucuggggaucggacauguagcugcggagaaucaccagcacgccaccaugcucgacguggaucuucgucccgcaucugcuuggacccuguacgccguugccacaacugugauuacgccaaugaugagacauaccaucgaaaacacaacugcaaauauuagcuugaccgcuaucgccaaccaagcggcuauacugaugggccucgacaaggguuggccuauuuccaaaauggauaucggggucccgcugcuugccuuaggcugcuacucacaggugaauccccugacacucaccgcagccgucuugaugcugguggcucacuaugcaauuaucggaccaggccuacaggccaaggcgacuagggaggcucagaagcgcacggccgcagggauaaugaaaaacccuacaguugacggaaucguggccauugaucuggaccccguaguguacgacgcuaaguucgaaaaacaacucggccagaucaugcuucugauuuuguguaccucucagauccugcucaugcggacuaccugggcccugugcgagaguauaacauuagcaacugguccacuuaccacacugugggaagggucgccuggaaaguuuuggaauacgaccauugcugucagcauggccaacaucuuccgaggcuccuaucucgcgggugccggccuagcauucucucugaugaaaucacuagggggaggcagaagggggacuggagcucagggcgagacacugggugagaaguggaagcgccaacucaaucagcuuagcaaauccgaauuuaacaccuacaagcggagugggaucauggagguugauagaucugaagccaaagagggacugaagcguggcgaaacuacaaaacaugcagugagcagggguaccgcuaaguugcggugguucgucgagcgcaaucuggugaagcccgagggcaaaguaauugaccucggguguggacgaggcggguggucauauuacugcgccggauuaaagaaagugacggaaguuaagggcuauaccaaaggugggccgggacacgaggaaccaaucccuauggccacauacggcuggaaccuggugaaacuucauuccggcaaagaugucuuuuucaugcccccagagaagugugacacucugcuaugcgauauaggggaaaguagccccaauccuaccauugaggagggaagaacacucagggugcugaagauggucgaaccgugguugcgggguaaccaguuuuguaucaaaauucugaaucccuacaugccaucugugguugagacucucgaacagaugcaacgcaagcacggcgggaugcuuguaagaaacccucuguccagaaauucaacccacgagauguauugggugagcugcggaacaggcaacaucgucucggcggugaacaugaccucucgaauguuacugaaucgguucacuauggcucaucguaaacccacguacgagagagacguugauuugggugcagggacacgccacguggccgucgaaccugagguggcuaaccucgacauaaucggacagaggauugaaaauaucaagaacgagcauaaaaguaccuggcacuaugaugaagacaauccauacaagacuugggccuaucacggcuccuacgagguaaagcccagcggcucagcauccucuauggugaacgggguuguccggcugcuaaccaaaccuugggaugugauuccaauggugacacagaucgccaugacggacaccacucccuuuggacaacagagagucuucaaggagaaaguugacacacgcaccccgagggcuaagcgagguacuacacagauuauggaagugaccgcgaaauggcuuuggggcuuucugagccggaauaagaagccuagaaucuguacaagggaggaguucacucgcaaaguacguaguaacgccgcaauaggggcuguguuugucgaugagaaucaguggaacuccgccaaggaagcaguggaggacgagcgguucugggaucucguucauagagaaagggagcugcacaaacaaggaaagugcgcaaccugcguguauaauaugaugggcaaacgcgaaaagaaguugggugaguuugggaaagcuaagggaagccgagccauuugguacauguggcugggcgcgcgguuccucgaguucgaggcacuuggcuuuaugaacgaggaccauugguucucuagagaaaauucacugaguggggucgagggagaagguuuacacaaacugggcuacaucuugagggauaucuccaagauuccagggggaaacauguaugccgacgauacggcuggcugggacacccgcauaacagaggaugaccuccagaaugaggccaaaaucacugauauuauggaacccgagcaugcacugcuagcuaccagcaucuuuaaacuuacauaccagaacaaagugguaagaguucagcggccugccaagaacgguacugugauggacgucauuucuaggcgugaucaacgagggucgggacaggugggcaccuauggccugaauacguucacaaacauggaagugcagcucauccgccagauggagucagaagggauauuucugccaagcgaguuggagacccccaauuuagcugaaagaguccuggacuggcucgagaagcacggagccgaacggcuuaaaaggauggcaaucuccggugacgauuguguugugaagccgauugacgaucgcuucgcgacugcccugacagcucuaaacgacaugggcaaaguaagaaaggauaucccucaaugggagcccaguaaaggguggaaugacuggcaacaggugccauuuugcucucaccauuuccaccagcugauuaugaaggauggacgggaaaucgucgugccuuguaggaaccaagacgagcucguuggccgagcccgugugagccagggugcagggugguccuugagagagaccgcuugccugggaaagucauacgcccagauguggcaacuuauguauuuucaucgccgggaucugaggcucgcagccaaugcgauauguagugcuguccccguggacuggguaccaacuucuagaaccacauggagcauucacgcccaccaucaguggaugacgaccgaagauauguuauccguuuggaaccgcguguggaucgaggaaaaucccuggauggaggacaaaacucacgucucaagcugggaagaggugccuuaccugggcaagcgggaggaccaguggugcggcucuuugaucgggcugacagcaagggccaccugggcuacuaacauucagguugccauaaaucaagugcgaagacucaucggaaacgaaaauuaucuugauuacaugacauccaugaaacgguucaagaacgagagugacccagaaggugcacugugguga

SEQ ID NO: 13502 - RNA, 9879 nt, Artificial Sequence
  derived and/or modified CDS sequence (opt3) from DENV-1__FJ639740__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacacucguggacagaggcugggguaauggguguggacuguuuggcaaaggcagcuuacugacuugcgcuaaguucaagugcguaaccaaacucgaggggaagauagugcaguacgaaaaccuuaaauauuccgucauugugacaguucacaccggagaucagcaucaaguggguaaugagacuacggaacacggcacaaucgccaccauuacuccccaggcgccuaccucagagauccagcugacagacuacggggccuugacccuagacuguaguccaaggacuggacuggauuuuaacgaaaugguccuccugacaaugaaggagaaaagcuggcuugugcauaagcagugguuccuggacuugccgcuccccuggacgucuggcgcauccaccucacaagagacuuggaaucggcaggaucuguuaguaacauuuaaaaccgcucacgccaagaagcaggaaguugugguccuggguagccaagagggggcuaugcacacagcccuaacuggcgcaaccgaaauccagacgaguggaaccacaacuauuuucgccggccaucucaaaugccgucugaagauggacaaacuuaccuugaaggggaugucuuaugugauguguacaggauccuuuaaacuggagaaggaagucgcugagacucagcacgguaccgugcucguucaggugaaguacgagggcacggaugcgccuugcaaaauaccauucgcaacacaagacgaaaaggggguaacccagaacggacgccugaucacugccaaucccauugucacagauaaagagaagccugugaacaucgaaaccgagccacccuucggcgagagcuauauaguugugggugcuggggaaaaagcccuuaagcugucgugguuuaagaaaggcucuuccauuggaaagauguucgaggcaacugccagaggcgcuaggcggauggccaucuugggggacaccgcaugggauuuuggaucaaucgguggcgucuucacaaguguggggaaacucguacaucagguguuuggaacggcguacggcguucuguucagcggugucuccuggaccaugaagauugggaucggcauuuuacugacuuggcuaggacucaauucucgaagcacaucacugaguaugaccuguauagcugugggcauggugacacuuuacuugggggucaugguucaggccgacuccggaugcgugaucaacuggaaaggccgcgaacugaagugugguagcgggauuuuugugacuaacgagguacacaccuggacggaacaauauaaguuccaggcagauucuccgaaaagacucucagccgcuaucggaaaggccugggaggagggcgucugcgguaucaggagugcaacacggcuggaaaauauuauguggaaacagauaagcaacgaguuaaaucauauccugcuugaaaacgacaugaaguuuaccgugguugugggcgacgcuaaugggauuuuggcccagggaaaaaagaugauccgcccucaacccauggagcacaaauacuccuggaagucuuggggcaaggcgaaaauuaucggggccgauauacagaacacuaccuucaucauugacggaccagauacaccugaaugucccgacggccagagagcuuggaauaucugggaggucgaggauuaugguuuugggauuuucacuaccaacaucuggcucaagcugagggacucguacacacagaugugcgaucaccgucuaaugagcgcagccauaaaagacuccaaggcugugcaugccgauaugggauauuggauugaaucagagaaaaaugaaacguggaagcuggcacgggcgaguuuuaucgagguuaagaccuguacuuggccaaaaucucacacacucuggagcaacggcgugcuggaauccgagaugauuauccccaagauauacgguggcccuaucucacaacauaauuaucgaccaggguacuucacccagacugccggaccguggcaccuuggcaaauuggagcuggacuucgauuuaugcgaagggacaaccguagucguggacgagcacugcggaaacagaggccccagccucaggacgacuaccgugacagguaagauuauccaugaaugguguugccgcucuuguacccugccuccacuucgguuuagaggggaggauggaugcugguacggcauggagauuaggcccgucaaagaaaaggaggaaaaucugguucgcuccauggugagugcugguagcggcgagguagacucuuucuccuuggggauccucugugugucaauaaugauugaagaggucaugcgaagucgguggagccguaagaugcugaugacuggaacacuagccguguuucugcuccugaucaugggccagcuuaccuggaacgacuugaucagacugugcauuaugguuggggcaaaugcuucggauaggaugggaaugggcacaacuuauuuagcccucauggcaaccuucaaaaugcgcccuauguuugccgugggucugcuuuuccggagacugacguccagggagguccuacuccugacaaucggguugucucugguggcuagcguugaauuaccaaacucacucgaggaacugggagacggccuugcgaugggcauuaugaugcugaaguugcucaccgaguuucaaccccaccagcuguggacuacccuacugagucuuacauucgugaaaacuacccucucccuggauuacgccuggaagacgacagcaauggucuugucuauaguaagccuguuuccguuaugucucuccaccacuucacagaaaacaaccuggcugccugugcuucuggggagcuucggaugcaagccauugacuauguuucucaucacagaaaacaagauuuggggucgaaaaaguuggccccugaaugagggcaucauggcuauugggaucguuucuauacuacuguccagccuucucaagaacgacgugccucuggccggacccuugaucgccggcgguauguuaauugcuuguuaugucaucucggggucaucugcagaucugagucucgagaaagccgcggaaguguccugggagcaggaagcugagcauagcggagccucucacaauauucugguagaagugcaagacgauggcaccaugaagaucaaagacgaggagcgcgaugacacgcuuacuauacuguugaaggcaacccuacuggccgucagcggcguuuacccaauguccauuccugcuacacucuucgugugguauuuuuggcagaaaaagaagcagcggucaggggugcugugggauacccccaguccaccggaagucgagagagcagugcuugacgauggaaucuacaggaucuuacagcguggucugcucggccgcagccaaguugggguaggaguguuccaggacggcgucuuccauacaauguggcacgugacucggggugccguuuugauguaucaggggaaaagacuggaaccuucuugggcguccgugaagaaagaccucauuucauacggaggcggcuggagguuucaggggaguuggaacaccggagaggagguccaagugauagcuguagaacccgguaagaauccaaaaaacguccagacgacacccggcacuuucaagaccccugagggggaagugggagccaucgcacuggauuuuaagccaggcacaagcgguucccccauuguuaaucgagaggggaaaaucgugggacuuuacggcaacggcgucgugaccacuucugggaccuauguuucggccauugcucaggccaaggcaagccaagaaggaccucugccggagaucgaggacgaaguguucaaaaagcggaauuugacaauaauggaucuacacccagguucaggcaaaacgcgcagauaccugcccgcuaucgucagggaggccauuaagcggaagcuccgaacuuuaauccuggcgccuaccagagugguagccuccgaaauggcagaggcucuuaaagggaugccaauucgcuaucagacaaccgccgugaagagugaacauacuggaagggagaucguugaccugaugugccacgcuacauuuaccaugcgucucuugucucccguccgggugccuaacuacaauaugauaauuauggaugaggcacauuucacggacccggccagcaucgccgcuagaggcuauaucuccacuaggguggguaugggggaagcggcagccauuuuuaugacagcuacccccccaggaucagucgaggccuucccucagucuaacgcaguaauccaggaugaagagcgcgacauacccgaacgaagcuggaauaguggcuacgauuggauuaccgacuuuccaggcaaaacugugugguucguuccuuccaucaagagcgggaacgauauugccaauugucugagaaaaaacggaaagcgggugauccaacucucuaggaagacauuugacaccgaguaucagaaaacaaagaacaaugacugggauuacgucgugacuacggacauaucagagaugggugcuaacuuccgcgcggaucguguuauugaccccagacggugccugaaaccagugauccuuaaggauggcccggaaagggucauccuagccgggccuaugcccgugaccguagcauccgcugcccagcgccgaggaagaauuggccggaaucagaacaaagagggugaccaauacguguauauggggcagccacugaauaacgaugaagaccacgcacauuggacagaggccaagauguuguuagauaauaucaacacucccgagggcauuauaccugcucuguucgaaccagagagggaaaagagugccgcgaucgacggagaguaccgccucagaggcgaagcaaggaaaaccuuuguugagcugaugcggcguggggaucuucccgucuggcugagcuauaagguggccucggagggauuccaguacucugaccgccgauggugcuuugauggugaaagaaauaaccaggugcucgaggaaaauauggacgucgagauuuggacaaaagaaggcgagaggaagaaauugcggccucgcuggcuggacgcuagaaccuauuccgauccgcuagcccugagggaguucaaggaauuugcugcagggcggcgaagcguuucaggagaccucauccuugagaucggcaaacugccacaacacuuaacuuugagagcccagaacgcucuggauaaucucgugaugcugcacaacagugaacagggugggaaggccuaccgccaugcaauggaggaacuucccgacacgauugagacccugaugcucuuggcgcugauagccguauuaacaggcggagugacucuauucuuucugucuggcaaggggcucggaaaaaccuccaucggucuucugugugucacagcuagcucagccuugcuguggauggcaaguguggagccucacuggauugcugccagcaucauucucgaauucuuucugaugguucuucucauccccgagccagauaggcagcggaccccucaagacaaucagcuggcauauguggucauaggcuugcuguucaugaucuuaacuguagccgcuaacgaaauggggcuacuggagacaacgaagaaagaucucggaauuggcuacguggcggccgagaaccaucagcacgcaaccaugcuugacguugaucugcgucccgcuuccgccuggacuuuguacgccguggcaacaaccgucaucaccccaaugaugagacacacaauugaaaauacuacggcuaacaucucucugaccgccauagcgaaucaagcugccauucucaugggucuggacaagggguggccuaucagcaaaauggauauuggcgugccgcuuuuagcacugggaugcuauucccaggucaacccccucacauugacugccgcugugcugaugcuaguugcacauuacgccaucauaggcccagggcugcaggcgaaggcuaccagggaggcccagaagcgcacagcagccggaaucaugaaaaauccuaccguggacggcauuguagcuaucgaucucgaccccguggucuaugacgccaaguuugaaaaacaacuuggucagauuaugcuguugauccuguguacuucacagauacuccugaugcggacgacaugggcauuaugcgagucuauuacccuugcuacugggccacugaccacacucugggaaggaaguccuggcaaguucuggaacacuaccaucgccguuucgauggcgaauaucuuucgagguagcuaccuagccggcgcagggcuggcuuucuccuugaugaaaucucugggaggcgggagaaggggaacaggcgcccagggugagacgcucggggagaaguggaagcgccaacuuaaccagcugucaaaaagcgaauucaauaccuauaagcgguccggaauuauggagguggauagaagugaagcaaaagagggcuugaagcguggugaaacuacaaaacacgcugucucuaggggcaccgccaagcugcggugguuuguggagcgcaaccucguaaagcccgaggggaaagugaucgacuuaggauguggccgagggggauggagcuacuauugcgccggccugaagaaaguuacugaagugaaggguuacacaaaagggggaccgggccaugaggaaccaauaccuauggcgaccuacggcuggaaucuugucaagcugcacucagggaaagauguguucuuuaugcccccagagaagugugacacgcuacucugcgauauuggagaauccagucccaacccuaccaucgaggaggguagaacacugagggucuugaagaugguggaaccguggcugcggggcaaucaguucuguauuaaaauccucaaccccuauaugccaagcguuguagagacucuugaacagaugcaacgcaagcaugggggaaugcuggugagaaauccuuuaucuaggaacuccacccacgagauguacugggucucaugcggcacagguaauauagugagcgcuguuaacaugacuucgcgaaugcuguugaaccgguuuaccauggcacaccguaaacccacauaugagagagacguggaucucggggccggaacccgccaugucgcuguggaaccugaggaagccaaucuggacaucauuggccagaggaucgagaacauuaagaaugaacacaaaucuacuuggcauuacgaugaggacaacccauauaagacgugggcauaccacggcaguuaugagguaaagcccuccgggagcgccucauccauggugaauggaguuguccggcuacuuacaaaaccuugggaugugaucccaauggugacccagauugcuaugacugacaccacacccuucggucaacagagagucuuuaaggaaaaaguugacacgcgcaccccgagggcgaagcgaggcacuacacagaucauggaggugaccgccaaauggcuguggggguuccucucucggaacaagaagccuagaauauguacuagggaagaguuuacacgcaaaguacguagcaaugcagcuauuggagccguguucgucgaugaaaaccaguggaauagugcaaaggaggccguggaggacgaacgguuuugggaucugguucacagagagagggaauugcauaaacaaggcaagugcgcuaccugcguguacaacaugauggguaaacgcgagaagaagcugggggaauucggaaaagccaagggcucccgagcgaucugguacauguggcucggcgcacgguuucuugaguucgaggcccugggguucaugaaugaagaccacugguuuagcagagagaacucuuuaucaggagucgaaggugagggccugcauaaauugggguauauccucagggauauuaguaagauaccaggaggcaauauguacgcugacgauacagccgguugggacacucgcaucaccgaggaugaccugcagaacgaagcaaaaauuacggauaucauggagcccgaacacgcucuacuugccaccuccauuuucaagcugacauaucagaauaaagugguaagaguucagcggccugcuaagaacgggacugugauggacgucaucagcaggcgugaucaacgaggaucuggccaggugggcaccuacgggcucaacacauuuacuaauauggaggugcagcugauacgccagauggaaucggagggaaucuucuugccaucagaguuagaaacccccaaccuggccgagagaguccucgacuggcuugaaaagcauggugcagagcggcugaaaaggauggcgauuagcggcgacgauuguguugugaagccgaucgacgaucgcuuugccacggcucuaacagcccugaaugacauggggaaaguaagaaaggauauuccucaaugggaacccuccaaaggauggaacgacuggcagcaggugccauucugcagucaccacuuucaucagcucaucaugaaggauggccgggagauagucgugccuuguaggaaucaagacgaguugguuggucgagcacgugugucucagggggcuggauggagccugagagaaaccgccugccuuggcaaguccuaugcacagauguggcaacugauguacuuccaccgccgggaucucagguuagccgcgaacgcuauuuguucagccguccccguggacuggguaccaacuaguagaacaaccuggucuauccaugcacaccaccaguggaugacuaccgaggauaugcugagcguuuggaaucgcguguggaucgaagagaaccccuggauggaagacaaaacacaugucuccucaugggaggaggugccuuauuugggcaagcgggaagaccaguggugcgggagccugauuggacucacggccagggcuaccugggccacuaauauacagguugcaaucaaccaagugcgaagacuuauugguaaugagaacuaccuggauuacaugacaucuaugaaacgguuuaagaaugaauccgacccagagggcgcucuaugguga

SEQ ID NO: 13503 - RNA, 9879 nt, Artificial Sequence
  derived and/or modified CDS sequence (opt3) from DENV-1__FJ639741__SS-prME
agcgugaccauccugcucaugcuucugcccacagcauuggcuuuccacuuaacuacgagaggaggggaaccucauaugauugucuccaagcaggaaagaggaaaaucucuguuauuuaagaccucagccgguguuaauaugugcacacucauagcaauggaccugggagaacuuugugaagauacuaugaccuacaaaugcccacggaucacagaagcggaaccggacgauguggacuguuggugcaaugcuaccgauacuuggguaacauaugggaccuguagucagacgggagaacaccgccgagacaagcguagcguggcccuggcaccccaugucggcuugggucucgagacuagaaccgaaacauggauguccucugagggggccuggaaacagauucagaggguggaaacuugggcucugcggcacccuggauucaccguuaucgcacuguuucucgcccaugcuauuggcacaucgaucacccagaagggcauuaucuucauuuuacugaugcuugugacgccaucaauggccaugcgcugcgucgggaucggaaacagagauuuuguggaggguuugagcggcgcgacuuggguagacguugugcuggagcacgggaguugugucacaaccauggcaaagaauaaacccacuuuggauauugaacuccugaagacagaggugaccaacccugccgugcuuaggaaacugugcaucgaagcuaagauauccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauugugcaguacgaaaaccucaaauauuccgucaucgugacaguucacaccggagaucagcaucaaguggguaaugagacuacggaacacggcacaauugccaccaucacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcaccuccacuucacaagagacauggaaucggcaggaucuccugguaaccuucaaaacagcacacgcuaagaagcaggaaguuguggucuuagguagccaagagggggccaugcacacugcucugaccggcgccacggaaauucagaccaguggaacaacuaccauauuugcaggccaucuaaaaugccgucucaagauggacaaacugacacuuaaggggacuucuuaugugauguguaccggauccuucaaauuggagaaggaagucgccgagacgcagcacgguacagugcugguucaggugaaguacgagggcaccgaugcuccuugcaaaaucccauucagcacucaagacgaaaaggggguaacacagaacggacgccucauuaccgcgaaucccaucgucacugauaaagagaagccugugaacauagaaaccgagccacccuuuggcgagucguauauuguugugggugcaggggaaaaagcccugaaacuuucuugguucaagaaaggcuccucaaucggaaagauguuugaggcuacagccagaggcgcaaggcggauggccauccugggggacacggcuugggauuucggaaguauugguggcgucuuuaccagcguggggaaauugguacaucagguguucggaacugccuacggcguucucuuuuccggugucucuuggacaaugaagaucgggauuggcauacuguuaaccuggcugggacuaaauagccgaucaacaagucucuccaugacuuguaucgcagugggcauggugacccuguaccuuggggucaugguucaggcggacagcggaugcgugauuaacuggaaaggccgcgaauugaagugugguucugggaucuucgugacgaacgagguacacacauggaccgaacaauauaaguuucaggcugauucaccgaaaagacugagugccgcaaucggaaaggccugggaggagggcgucugcgguauuaggagcgcuacucggcucgaaaauauaauguggaaacagaucuccaacgagcugaaucauauuuuacuggaaaacgacaugaaguucaccgugguugugggcgacgccaaugggauccuugcacagggcaagaagaugauucgcccucaacccauggagcacaaauacucuuggaagucguggggcaaggcuaaaaucauaggggccgauauccagaacacaacuuuuauuaucgacggaccagauaccccugaaugucccgacgaucagagagcguggaauauuugggaggucgaggacuauggcuucgguaucuuuacaacgaacauaugguugaagcucagggauagcuacacccagaugugcgaccaccgucugauguccgccgcuauuaaagauucaaaggcagugcaugccgacaugggguauuggaucgaaagugagaaaaaugaaacuuggaagcuagcuaaggccucuuucauugagguuaaaacauguaucuggccaaagagccacacccugugguccaacggagugcucgaaucagagaugauaauccccaaaauuuacggcgguccuaucagccaacauaauuaucggccaggcuacuucacucagacagcagggccguggcaccugggaaaacuugaguuggauuuugaccugugcgaaggcaccacgguagucguggaugagcacugcgggaaccgaggacccucuuuaagaacuaccacagugaccggcaaaauuauccaugaaugguguugcagguccuguacucucccuccacugcgcuuccggggugaggacgggugcugguacggaauggagauaagacccgucaaggaaaaggaggaaaaucuuguuaggaguauggugagcgcgggcucuggugagguagacuccuuuucacugggcauuuugugugugaguaucaugaucgaagaggucaugcgcagccgauggucgcggaaaaugcucaugacagggacccuggccguguuccuacugcucauuaugggacagcugacauggaacgaucuuauccguuugugcauuaugguuggcgcuaaugccuccgacagaauggggaugggaacuaccuaucuggcauuaauggcuacguuuaagaugaggccuauguucgccgugggccuccuguuucgccggcuuacaucuagagagguccugcuacucaccauaggucugagcuugguggcaucaguugaacugccaaacaguuuagaggaacucggggauggacuggccaugggcaucaugaugcuuaaacuguugacugaguuccaaccccaccagcucuggaccacacugcuaucccugacuuuuauuaagaccacgcuuucucucgacuacgcuuggaaaacaaccgcgauggugcugagcaucgucuccuuguucccgcuguguuuaucaacuacaagccagaagaccacuuggcucccuguacugcuuggcaguuuugggugcaagccacugacaauguucuugauuaccgaaaacaaaaucuggggaaggaagucuuggccccucaaugaggguauaauggccaucggcauuguguccauccugcuaagcucgcugcuuaaaaacgauguuccucucgcagggccccugauugcuggaggcauguugaucgccuguuaugugauaucagguucuagugccgacuuaucccuggagaaggcugcagaagucagcugggagcaggaagccgagcauucugggacgagccacaauauucucguggaaguacaagaugacggaacuaugaaaaucaaggaugaggagcgagacgauacccugacaauccuucugaaagcgaccuugcuagcuguguccggcgucuacccaaugucaauuccugccacacuguuuguuugguauuucuggcagaagaagaaacagcgcaguggcgugcucugggacacucccagcccaccggaaguggagcgggcaguccuggaugacgggauauacagaauccuucagaggggauuacugggucguucucaagugggcguugggguauuccaggacggaguguuucauaccauguggcacgucacgcgcggcgccgugcucauguaucaggguaagcgguuggaaccuuccugggcuucaguuaaaaaggaucugauuaguuacgggggaggcuggagauuccagggcagcuggaacacaggggaggaggugcaagucaucgcaguggaacccggcaagaauccaaagaacguacagacuacccccgguacauuuaagaccccugagggcgaagucggggccauugcgcucgacuucaaaccaggaacuuccggcucucccaucgugaauagggaggguaagauaguugggcuguacggaaacggcguggucaccacaucgggcacguaugugagcgcuaucgcccaggcaaaagccucacaagaagggccucuuccggagauugaggaugaaguuuuuaagaaacgaaaucugacuaucauggacuugcacccaggauccgguaagacccggcgcuaccuacccgcuauugugagagaggccaucaagaggaaacugcggacacucauauuagcaccuacccgagucguggcuagugaaauggccgaggcgcugaagggcaugccaauuagauaucagacuacagccguaaaaucugaacauaccgggcgcgagaucguggaucuuaugugccacgcaacguucacuaugaggcugcucagccccguucgugucccuaacuacaauaugaucauuauggacgaggcucauuuuacagauccggccuccaucgcugcacggggauauauaucaaccagagugggcaugggugaagccgccgcuauuuucaugaccgcgacucccccagggucuguggaggcauuuccucagagcaacgccgucauccaggacgaagagagggauauucccgaacgcaguuggaacuccggauacgacuggaucacagauuucccaggcaagaccguaugguuugugccuagcauaaaaucuggcaacgacauugcuaauuguuugcgaaagaacgggaagagaguuauccaacugucacggaaaacauucgacacugaguaucagaagacgaaaaacaaugauugggacuacguggucaccacagauaucuccgagaugggagccaacuucagggcagaccgcgugauugauccccguagaugccucaagccaguuauccugaaagacgguccggaacgggugauucuugccggcccuaugcccgucacuguggcuagugcggcccagaggcgcgggcgaauaggaagaaaucagaacaaggagggcgaucaauacguauauaugggucagccacuaaauaacgacgaagaucacgcacauuggaccgaggcuaagaugcuguuggacaauaucaacacacccgaggggauuaucccugccuuauuugaaccagagcgggagaaaagcgcagccaucgauggcgaguacaggcugcgcggagaagcuagaaagaccuucguggagcucaugaggcggggcgaccugcccguuuggcuuucguauaaagucgccucugagggguuucaguacuccgaucgucgcuggugcuucgacggagaacgaaauaaccaggugcuggaggaaaauauggacguggagauuuggacuaaggaaggugagaggaaaaagcucaggccucggugguuggaugcgcgcacguauagcgacccgcuggcacuaagagaguuuaaagaguucgccgcuggcaggcggucagucaguggggaucugauacucgagaucggaaaacuuccacaacaccugaccuuacgagcccagaacgcuuuggacaaucugguuaugcuccacaacucugaacagggcgguaaggcauacagacaugccauggaggaacugcccgauacaauugagacucuuaugcugcucgcuuugaucgccgugcugaccgggggcguaacauuauuuuuccuauccggaaaaggccuggggaagaccagcauuggacuccuuugugugacugcaucaagugcgcuguuguggauggccagcgucgagccucacuggaucgcugccuccauaauccuggaauuuuuccucauggugcugcuuauucccgagccagaccgccagaggacaccucaagauaaucagcucgcauauguugugaucggucuguuguuuaugauucugacggucgcugccaacgaaaugggcuuacuagagaccacuaaaaaggaccuggggaucggacauguagcagccgagaaccaccagcacgcuacaaugcucgauguggaccuucggcccgcgucugccuggacccuguacgcaguugcuaccacagugauaacuccaaugaugcgucauacgauugaaaauaccacagccaacaucagcuugacugccauugcaaaucaagcugccauccugaugggccucgauaaagguuggccuauauccaagauggacaucggggucccgcugcuugcguuaggcugcuacucacaggugaacccccugacccucacagcugccgucuugaugcugguggcacacuaugccauuaucggaccaggccuacaggcuaaggcaaccagagaggcccagaaaaggacugcggcugggauuaugaagaauccuacgguugauggaaucguggccauagaccuggaccccguaguguacgaugcaaaauucgaaaagcaacucggccagauuaugcuucugaucuuguguacaucucagauccugcucaugcgcaccacuugggcccugugcgagaguauuaccuuagcuacagguccacuuacuacccugugggaagggucgccuggaaaauuuuggaacacaacgaucgccgucagcauggcaaauauauuccggggcuccuaucucgcuggugccggccuagcguucucucugaugaagucacuagggggaggccgaagagggaccggagcccagggcgagacucugggugagaaguggaaaaggcaacucaaccagcuuagcaaguccgaauuuaauacauacaaacgcagugggauuauggagguugaccggucugaagcaaaggagggacugaaaagaggcgaaaccacuaagcaugcugugagccgugguacagccaaguugaggugguucgucgagcggaaccuggugaaacccgagggcaagguaaucgaucucggguguggacgcggcggguggucauauuacugcgcaggacuaaagaaggugaccgaaguuaaaggcuauacgaagggugggcugggacacgaggaaccgauuccaauggcuaccuacggcuggaaucuugugaaacugcauuccggcaaggacgucuuuuucaugccucccgagaagugugauacacuacucugcgacaucggggaaaguagcccaaaccccacuauagaggagggacgaacccugagaguguugaaaauggucgaaccuuggcugagggguaaucaguuuuguaucaagauucucaacccguacaugcccucugugguugagacacuugaacagaugcaacggaaacacggcgggaugcugguacgcaauccauuauccagaaacucaacucacgagauguauugggugagcugcggaaccggcaauaucgucucggccgugaacaugacaucuaggaugcuguugaaccgauucaccauggcccaucggaagccuacuuacgagcgugauguugaccucggugcggggacgagacacguggcugucgaacccgagguggcaaaucuggauauuaucggacagcgcauugaaaacaucaaaaaugagcauaagaguacauggcacuaugacgaagauaacccuuacaagaccugggccuaucacggcuccuacgagguaaaaccaagcggcucagcuuccucuauggugaaugggguugucaagcuacuuacuaaacccugggacgugauaccuauggugacccagauugccaugacagacacgaccccauuuggacaacagagggucuucaaggagaaaguugauacucggacacccagagcaaagcgcgguaccacucagaucauggaagugacagccaaguggcuguggggcuuucucagcaggaacaaaaagccgcgaaucuguacccgggaggaguucacaagaaaaguaaggaguaaugcugcgauuggggccguguuugucgacgagaaccaguggaacuccgcaaaggaagcuguggaggaugagcgcuucuggaaccugguucaucgugaacgggaguugcacaaacaaggaaagugcgccacuugcguguauaauaugaugggcaagagagagaaaaagcugggugaguuugggaaagcaaagggaagcagggccauaugguacauguggcucggcgcucgcuuccuugaguucgaggcccugggcuuuaugaacgaggaccauugguucucucgagaaaauucauuaaguggggucgagggagaaggucugcacaaauugggcuacauccuccgggauauuuccaagaucccugggggaaacauguaugcggacgauaccgcaggcugggacacgagaauuaccgaggaugaccugcagaaugaggccaaaaucacagauauaauggaaccagagcaugcucuacuugccacuagcaucuuuaagcugaccuaccagaacaaggugguaaggguucagcgccccgccaaaaaugguacagugauggacgucauuucuagacgggaucaaagggggucgggacaggugggcacuuauggccucaauaccuucacgaacauggaagugcagcugauccgucagauggagucagaagggauauuuuugccuagcgaguuagagacaccaaaucuggcugaacgaguccucgacuggcuugagaagcacggagccgaacgccugaaaagaauggcuaucuccggugacgauuguguugugaagcccauagacgaucgguucgccaccgcacuaacugcgcugaacgacaugggcaaaguaaggaaggauauuccgcaaugggagccuaguaagggguggaaugacuggcaacaggugcccuuuugcucucaccauuuccaccagcucaucaugaaagauggacgcgaaaucgucgugccauguagaaaccaagacgaguugguuggccgggccagggugagccagggugcuggguggucccugcgagagacagccugccuuggaaagucauacgcacagauguggcaacugauguauuuucaucguagagaucuccgcuuagcugccaaugcaauuuguagugccgucccuguggacuggguacccaccucucggacuaccuggagcauacacgcgcaccaucaguggaugacaacggaagauaugcuguccguuuggaacaggguguggaucgaggaaaauccauggauggaggacaaaacccacgucucaagcugggaagaggugcccuacuugggcaagagagaggaccaguggugcggcucucugauugggcucacugcucgcgccacaugggcaaccaacauccagguugccauuaaucaagugcggaggcuuaucggaaacgaaaauuaucuggauuacaugacuuccaugaaacgauucaagaacgagagugacccugaaggugcucuaugguga

SEQ ID NO: 13504 - RNA, 9879 nt, Artificial Sequence
  derived and/or modified CDS sequence (opt3) from DENV-1__FJ639743__SS-prME
agcgugaccaugcugcucaugcuucugcccacugcauuggcuuuccacuuaacuacgaggggcggggagccucauaugaucgucuccaagcaggaaaggggaaaaucucugcuauuuaagaccucagccgguguuaauaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauggcacuguuucucgcccaugcuauuggcacaucgaucacccagaagggcauuaucuucauauuacugaugcuugugacgccaucaauggccaugcgcugcgucgggaucggaaacagagauuuuguggaggguuugagcggcgcgacuuggguagacguugugcuggagcacgggaguugugucacaaccauggcaaagaauaaacccacucuagauauugaacuccugaagacagaggugaccaacccugccgugcuuaggaaacugugcaucgaagcuaagauuuccaauacgaccacagacucucgguguccaacucaaggagaggccaccuuggucgaagaacaggaugcaaacuucguuugccgccgaacauuuguggacaggggcugggguaauggguguggacucuucggcaaaggcagccuguuaacuugcgcuaaguuuaagugcguaaccaaacuggaggggaagaucgugcaguacgaaaaccucaaauauuccgucauagugacaguucacaccggagaucagcaucaaguggguaaugagacuacggaacacggcacaauugccaccaucacuccccaggcgccuaccucagagauucagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuaucuuugccggccaucuaaaaugccgucucaagauggacaaacugacccuuaaggggaugucuuaugugauguguacaggauccuucaaauuggagaaggaagucgcugagacucagcacgguaccgugcugguucaggugcgcuacgagggcacggaugcgccuugcaagauuccauucagcacacaagacgaaaaagggguaacccagaacggaagacucauaacugcaaaucccaucgucacagauaaggagaaaccugugaacauugaaaccgagccacccuuuggcgagucguauaucguugugggugccggggaaaaggcucugaaacuuucuugguucaagaagggcuccucaauaggaaaaauguuugaggccacugcaaggggcgcccggcgaauggcuauucugggggacaccgccugggauuucggaaguaucgguggcgucuuuacaagcguggggaaguugguacaucagguguucggaacggcauacggcguucucuuuuccggugucucuuggaccaugaaaaucgggauuggcauccuguuaacuuggcugggacuaaauagccgcucaacaagucucuccaugaccuguauugcggugggcauggugacacuguaccuuggggucaugguucaggcugacagcggaugcgugauaaacuggaagggcagagaauugaaaugugguucugggaucuucgugacuaacgagguacacaccuggacggaacaauauaaguuucaggccgauucaccgaagaggcugagugcagccauuggaaaggcuugggaggagggcgucugcgguauccggagcgccacacgccucgaaaauaucauguggaagcagauuuccaacgagcugaaucauauauuacuggaaaacgacaugaaauucaccgugguugugggcgacgcaaaugggauccuugcucagggaaagaaaaugauuagaccucaacccauggagcacaaguacucuuggaaaucguggggcaaggccaaggucaucggggcggauauucagaacacuaccuuuaucauagacggaccagauacaccugaaugucccgacggccagagggccuggaauaucugggagguggaggauuaugguuucgggauuuuuacuaccaacaucugguugaaacuccgugacagcuacacacagaugugcgaucaccggcugauguccgcugcaauuaaggacucaaaagccguucaugcugauaugggauauuggaucgaaagugagaagaaugaaacguggaaacuagcccgagcaucuuucauagaggugaagaccuguacuuggccaaagagccacacacugugguccaacggcguacucgaaucagagaugauuauccccaaaauuuacgguggcccuaucagccaacauaauuauagaccaggguacuucacccagacugcgggaccguggcaccugggcaaacuugaguuggacuuugaucugugcgaagggacaaccgucgugguggacgagcacugcggaaacaggggccccucuuuacgcacgacuaccgucacagguaaaauaauccaugaaugguguugccgguccuguacccucccuccacugagauucagaggggaagauggaugcugguacggcauggagauucgccccguuaaggaaaaagaggaaaaucuugugcgaaguaugguaagcgccgguucuggcgagguggacuccuuuucacuggggaucuugugugucaguauuaugaucgaagaggugaugcggagccguuggucgagaaagaugcucaugacuggaacacuggcuguuuuccuacugcucgugaugggccagcugaccuggaacgaccuuauaagguugugcauuauggucggggccaaugcauccgaucgcaugggaaugggcacaacuuaucuggcuuuaauggccaccuuuaagaugcggccuauguucgcagugggucuccuguuuagaaggcuuacgucucgagagguucugcuacucacaaucgggcugagcuugguggccucagucgaacugccaaacaguuuagaggaacucggagacggccuggcuaugggcaucaugaugcuuaaacuguugaccgaguuccaaccccaccagcucuggacuacccugcuaucccugacauuuguaaagacuacccuuucucucgauuacgcguggaaaacgacagccauggugcugagcauuguuuccuuguucccgcuguguuuaucaaccacuagccagaagacaaccuggcucccugugcugcuugggaguuuuggaugcaaaccacugacuauguucuugaucacagaaaacaagauuuggggucgcaagucuuggccccucaaugagggcauaauggcaaucgggauugucuccauccugcuaagcucgcugcuuaaaaacgacgugccucucgcuggaccccugauugccggcgguauguugaucgccuguuauguaauaucagggucuagugcugauuuaucccuggagaaggcagccgaagugagcugggagcaggaagcggagcauucuggagcuagccacaauauccucgucgaaguucaagacgauggcaccaugaaaauuaaggacgaggagcgggaugacacgcugacuauccuucugaaagccaccuugcuagcaguguccggcguguacccaaugucaauuccugccacacuguuugucugguauuucuggcagaagaaaaagcagagaaguggggugcucugggauacccccagcccaccggaaguugagagggcuguacuggacgauggaaucuaccguauacuucagcgcgguuuacugggccggucucaagugggggucggaguguuccaggacggcguuuuucauacaauguggcacgugacuagaggugcaguccucauguaucaggggaagagguuggaaccuuccugggccucagugaaaaaggaccugauuaguuacggaggcggcuggcgauuccaggggagcuggaacaccggagaggagguacaagucaucgcgguggaacccgguaaaaauccaaagaacguucagacgacacccggcacuuuuaaaaccuccgagggggaagugggagcuaucgcccucgauuucaagccuggcacaucugguucgccaauugucaaucgggaggggaagauagugggacuguacggcaacggcguugugaccacuagcgggaccuaugucucagcaaucgcccaggcuaaagccucccaagaaggaccccuuccugagauugaggacgaaguguuuaagaaacgcaaucugacaaucauggauuugcacccggguaguggcaagacgagaagguaccuaccagcaauuguacgggaggcuaucaaacgaaagcugagaacucucauauuagcccccacccgcgugguugcgucugaaauggccgaggcacugaaggggaugccuaucagguaucagacaaccgcugucaaaagcgaacauacuggacgugagauuguggaccuuaugugccacgccacauucaccaugcggcugcucuccccagugagaguccccaacuacaauaugaucauuauggaugaggcucauuuuacggacccugcaucaaucgccgccaggggcuauauaucuacucgcguagguaugggggaagcugcggcaauuuucaugacagccaccccgcccggaagcguggaggcuuuuccacagaguaacgccguuauccaggaugaggagcgagacaucccugaaagauccuggaauagcggcuacgauuggauuaccgacuuccccggccggacugugugguuugucccaucuaucaagucagggaacgauauagcaaauuguuugaggaaaaacggaaagcgcgugauucaacugucccguaaaacauucgacaccgaguaucagaagacaaagaacaaugacugggauuacguugugacuacggacaucagugagaugggugccaacuucagagcugaucgggucauugacccuaggcgcugccucaaacccgugauccugaaggauggcccagaacgaguaauacuugcggggccgaugccugugaccguugccagcgcagcucagagacggggaaggauuggccgcaaucagaacaaagagggugaccaauacgucuauauggggcagccccuaaauaacgaugaagaccacgcccauuggacagaggcaaagaugcuguuggauaauaucaacacuccagagggcaucauucccgccuuauuugaaccugagagagaaaaaucggcugccaucgacggagaguacaggcugcggggcgaagcgcguaagaccuucguggagcucaugcgccgaggggaucugccaguguggcuuucuuauaaggucgcauccgagggauuucaguacagcgacagaagguggugcuucgauggugaacggaauaaccagguucuggaggaaaauauggacguggagauuuggacaaaagaaggcgagcgcaagaaacucagacccaggugguuggacgcccggaccuauucagauccucuggcucuacgagaguuuaaggaguucgccgcugggagacgcaguguaucuggagaccugauacucgagaucggcaaacuuccgcaacaccugacuuuaagggcacagaacgccuuggauaaucuggugaugcuccacaacuccgaacagggugggaaggcuuaccggcaugccauggaggaacugccagacacgauugagacccuuaugcugcucgcauugaucgcgguccugacaggcggagugacuuuauuuuuccuaagcggcaaagggcugggaaagaccucaaucggucuccuuuguguuacagccaguagcgcucuguuguggauggccuccguggagccccacuggauugcagcuucuauaauccuggaauuuuuccucaugguccugcuuauuccugagcccgaucgucagagaaccccacaagacaaucagcucgccuauguagugaucggccuguuguuuaugauucugacuguugcagccaacgaaaugggguuacuagagacaacgaagaaagaucugggaaucggcuacguggcugcggagaaccaucagcacgccaccaugcucgacgucgaucuuaggccugcaagcgcuuggacucuguacgccguggccacaaccgucauaacccccaugaugcgccacacaaucgaaaauacuacggcaaacauuuccuugaccgcuaucgccaaucaagcggcuauucugaugggucucgacaagggguggccaaucucaaaaauggauauaggcgugccucugcuugccuuaggaugcuauucucagguuaacccgcugacacucacugcagccguguugaugcugguagcucauuacgcaauuaucggccccgggcuacaggccaaggcgacccgggaggcucagaaacgaacagccgcaggaauuaugaagaauccaaccguggacggcaucgucgccauagaucuggacccuguuguguaugacgcuaaguucgaaaaacaacucggucagaucaugcuucugauuuuguguacaagucagauccugcucaugagaacgacaugggcccugugcgagucgauuaccuuagcaacugggccccuuaccacacugugggaaggaagcccaggcaaguuuuggaacacuaccaucgcugucuccauggccaauauauucagggguucuuaccucgcgggcgccgggcuagcauucucacugaugaaguccuugggaggcgggcgccggggaacaggcgcucagggugagacgcugggggagaaguggaaaagacaacucaaccagcuuagcaagagugaauuuaauaccuauaagcguucuggaauuauggagguggauaggagcgaagccaaagagggccugaagcggggugaaacuacaaaacacgcaguaucacgcggcaccgcuaaguugcgaugguucguggagagaaaccugguuaaaccugaggggaaggugaucgaccucggauguggcagagggggaugguccuacuauugcgccggcuuaaagaaagucacugaagugaaggguuacacaaaagggggacccggccaugaggaaccgaucccaauggccaccuacggcuggaaucuggucaaacuucacagugggaaagauguguuuuucaugagcccugagaagugugacacgcugcuaugcgauauuggagaaucuucccccaacccaaccaucgaggagggucggacacuccgcguucugaaaaugguagaacccugguugagaggcaaucaguuuuguauaaagauucugaacccuuauaugccgucaguggucgagacucucgaacagaugcaaaggaagcaugggggaaugcuugugcgaaauccccugagccggaacucgacccacgagauguacuggguuucuugcggcacagguaauaucgugagugcggucaacaugacuucccguauguuacugaacagauucaccauggcucaccgcaaaccaacauaugagagggacguggauuugggggcaggaacccggcauguagccguggaaccugaggaagcuaaucucgacauuaucggccagagaauagagaacauccgcaaugaacacaagagcacuuggcauuacgaugaggacaaccccuauaaaacgugggccuaccacggcucauaugagguuaagccuuccgggucugcaagcaguauggucaauggaguggugaggcugcuaacaaaaccaugggaugucauucccaugguuacccagaucgccaugacugacaccacaccuuuuggucaacagcgaguguucaaggaaaagguagacacgcggaccccaagagcuaaaaggggcacuacacagauuauggaggugaccgcgaaguggcuuuggggguuucugucccgcaacaaaaagccccguaucuguacucgggaagaguucacaagaaaagucaggagcaaugccgcaauuggagcuguguuuguugaugaaaaccaguggaacucugccaaggaggcaguggaggacgaacgcuucugggaucucguccaccgagagcgggaacugcauaagcaaggcaaaugcgcuaccugcguguacaacaugauggguaagagagagaaaaaguugggggaauuuggaaaagccaagggcucaagggccaucugguacauguggcugggcgcgcgcuuccucgaguucgaggcacuuggguuuaugaaugaagaccacugguucaguagagagaacucccugagcggaguagaaggugagggcuuacauaagcugggguauauauugcgggauauuucuaaaaucccgggaggcaauauguacgccgacgauacagcugguugggacacuaggaucaccgaggaugaccuccagaacgaagccaagauuacggauauaauggagccugaacacgcacugcuagcuaccucgaucuuuaaacuuacauaucagaauaagguugugcguguccagcgaccagccaaaaacgggacugugauggacgugauuucacgcagagaucaacggggaagcggccaggucggcaccuacgggcugaacacauucacuaauauggagguucagcucaucaggcagauggaauccgagggaauuuuucugcccagugaguuggaaaccccuaacuuagcugagcgcgugcuggacuggcucgaaaagcauggugccgagagacuuaaacggauggcaaucucuggcgacgauuguguagugaagccaauagacgauagguucgcgacggcccugacagcucuaaaugacauggggaagguccgaaaagauaucccccaaugggaaccgagcaagggauggaacgacuggcaacaggugccuuuuugcucccaccacuuccaucagcugauuaugaaagauggccgugagaucguugugcccuguagaaaucaagacgagcucgucggucgcgcccgggugucacagggggcaggauggaguuugagggaaaccgcuugccugggcaagucuuaugcccagauguggcaacuuauguacuuucacagacgcgaucugcggcucgcagccaacgcgauuuguagcgcuguaccaguugacugggugccuacuuccaggacaaccuggucaauccaugcccaccaccaguggaugacuaccgaggauauguuaagcgucuggaaucgaguguggauagaagagaaccccuggauggaagacaaaacacauguuucuuccugggaggaggugccauaucugggcaagagagaagaccaguggugcgggaguuugauuggacugacggcacgggccaccugggcuacuaauauccaggucgccaucaaccaagugaggcgccucauugguaaugagaacuaccuugauuacaugacaagcaugaagcguuucaaaaaugaaucggaccccgagggcgcacugugguga

SEQ ID NO: 13505 - RNA, 9879 nt, Artificial Sequence
  derived and/or modified CDS sequence (opt3) from DENV-1__FJ639794__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauaguggugggcauggucacacuguaccuugggguuauggugcaggcggacagcggaugcgugaucaacuggaaaggccgcgaauugaagugugguucugggauuuucguaacuaacgagguccacaccuggacggaacaauauaaguuucaggcugauucaccgaaaagacugagugccgcaaucggaaaggccugggaggagggcgugugcgguaucaggagcgcuacacggcucgaaaauauuauguggaaacagauauccaacgagcugaaucauaucuuacuggaaaacgacaugaaguucaccguuguggucggcgacgccaaugggauucuugcacagggaaaaaagaugauccgcccucaacccauggagcacaaauacucuuggaagucguggggcaaggcuaaaauuaucggggccgauauacagaacacuaccuuuaucauugacggaccagauacaccugaaugucccgacggccagagagcguggaauaucugggagguggaggauuaugguuucgggauuuuuacuaccaacaucugguugaagcucagggacagcuacacacagaugugcgaucaccgucugauguccgccgcuauaaaagacucaaaggcaguucaugccgauaugggauauuggauugaaagugagaaaaaugaaacguggaagcuagcucgggccucuuucaucgaggugaagaccuguacuuggccaaaaagccacacacugugguccaacggcguacucgaaucagagaugauuauccccaagauauacgguggcccuaucagccaacauaauuaucgaccaggguacuucacccagacugcaggaccguggcaccugggcaaacuugaguuggacuuugaucugugcgaagggacaaccgucgugguggacgagcacugcggaaacagaggccccucuuuaaggacgacuaccgucacagguaagauuauccaugaaugguguugccgcuccuguacccucccuccacugcgguucagaggggaggauggaugcugguacggcauggagauuaggcccguuaaagaaaaggaggaaaaucuugugcgcaguaugguaagcgcggguucuggcgagguggacuccuuuucacuggggaucuugugugucaguauaaugauugaagaggugaugcgaagccgguggucgcguaagaugcucaugacuggaacacuggccguuuuccuacugcucaucaugggccagcugaccuggaacgaccuuaucagauugugcauuauggugggggcuaaugccuccgauaggaugggaaugggcacaacuuaucuggcauuaauggcuaccuuuaaaaugcgcccuauguucgccgucggucuccuguuucggagacuuacgucuagggaggugcugcuacucacaaucgggcugagcuugguugcaucaguggaacugccaaacaguuuagaggaacucggagacggccuggccaugggcauuaugaugcuuaagcuguugaccgaguuccaaccccaccagcucuggacuacccugcuaucccugacauuugucaaaacuacccuuucucucgauuacgcuuggaagacgacagcgaugguacugagcauaguguccuuguucccgcuguguuuaucaaccacuagccagaaaacaaccuggcucccuguucugcuugggaguuuuggaugcaagccacugacuauguucuugaucacagaaaacaagauuuggggucgaaaaucuuggccccucaaugagggcaucauggccauugggaucguguccauacugcuaagcucgcugcuuaagaacgacgucccucucgcaggaccccugaucgcuggcgguauguugauugccuguuaugugaucucagggucuagugccgauuuaucccuggagaaagcugcagaaguaagcugggagcaggaagccgagcauucuggagcgagccacaauauucucguggaaguccaagacgauggcaccaugaagaucaaagacgaggagcgcgaugacacgcugacuauacuucugaaggcuaccuugcuagccguuuccggcguguacccaaugucaauuccugcaacacuguuugugugguauuucuggcagaaaaagaagcagcggagugggguccucugggauacccccagcccaccggaaguggagagagccguucuggacgauggaaucuacaggauccuucagcgugguuuacugggccgcucucaaguaggggugggagucuuccaggacggcguguuucauacaauguggcacguuacucggggugcugugcucauguaucaggggaaaagauuggaaccuuccugggcaucagucaagaaagaccugauuaguuacggaggcggcuggagguuccaggggagcuggaacaccggagaggaggugcaaguaauagccgucgaacccgguaagaauccaaaaaacgugcagacgacacccggcacuuuuaagaccccugagggggaaguuggagcgaucgcucucgauuucaagccaggcacauccgguucucccauugugaaucgagaggggaaaaucgucggacuguacggcaacggcgugguuaccacuucggggaccuaugugagcgccauugcacaggccaaggcuucacaagaaggaccucuuccggagaucgaggacgaagucuuuaaaaagcggaaucugacaauaauggauuugcacccagguuccggcaaaacgcgcagauaccuacccgccaucgugagggaggcaauuaagcggaagcugcgaacucucaucuuagcuccuaccagaguaguggccagugaaauggcggaggcccugaaagggaugccaauucgcuaucagacaaccgcaguuaagucugaacauacuggaagggagaucgucgaccuuaugugccacgcuacauucaccaugcgucugcucagccccgugcgggugccuaacuacaauaugauaauuauggaugaggcccauuuuacggacccggcuuccaucgcagccagaggcuauaucucaacuagggucgguaugggggaagccgcugcgauuuucaugacagcaacccccccaggaucuguagaggccuuuccucagagcaacgcugugauccaggaugaagagcgcgacauacccgaacgaaguuggaauuugggcuacgauuggauuaccgacuucccaggcaaaacuguuugguuugugccuuccaucaagagcgggaacgauauugccaauugucugagaaaaaacggaaagcgggucauccaacucucuaggaagacauucgacaccgaguaucagaaaacaaagaacaaugacugggauuacgugguuacuacggacauaucagagaugggugcaaacuuccgcgccgaucgugugauugaccccagacggugccugaaaccagucauccuuaaggauggcccggaaagggugauccuagcugggccuaugcccguaaccguggcguccgccgcacagcgccgaggaagaauuggccggaaucagaacaaagagggugaccaauacguuuauauggggcagccacugaauaacgaugaagaccacgcucauuggacagaggccaagauguuguuagauaauaucaacacucccgagggcauuauaccugcacuguuugaaccagagagggaaaagagugccgcuaucgacggagaguaccgccucagaggcgaagccaggaaaaccuucgucgagcugaugcggcguggggaucuucccguguggcugagcuauaagguggcgucggagggauuucaguacucugaccgccgauggugcuucgauggugaaagaaauaaccagguccucgaggaaaauauggacguugagauuuggacaaaagaaggcgagaggaagaaauugcggccucgcuggcuggacgcaagaaccuauuccgauccgcuagcccugagggaguuuaaggaauucgcugccgggcggcgaagcgugucaggagaccucauccuugagaucggcaaacugccacaacacuuaacuuugagagcucagaacgcacuggauaaucucguaaugcugcacaacagugaacagggugggaaggccuaccgccaugcuauggaggaacuucccgacacgauugagacccugaugcucuuggcccugauagcaguguuaacaggcggagucacucuauuuuuccugucuggcaaggggcucggaaaaaccuccaucggucuucugugugugacagcgagcucagccuugcuguggauggcuaguguugagccucacuggauugccgcaagcaucauucucgaauuuuuccugauggugcuucucauccccgagccagauaggcagcggaccccucaagacaaucagcuggcuuaugucguaauaggcuugcuguuuaugaucuuaacuguggccgcaaacgaaauggggcuacuggagacaacgaagaaagaucucggaauuggcuacguugccgcugagaaccaucagcacgcgaccaugcuugacguggaucugcgucccgccuccgcauggacuuuguacgcugucgccacaaccgugaucaccccaaugaugagacacacaauugaaaauacuacggccaacaucucucugaccgcaauagcuaaucaagccgcgauucucaugggucuggacaagggguggccuaucagcaaaauggauauuggcgucccgcuuuuagcucugggaugcuauucccaggugaacccccucacauugacugccgcaguucugaugcuaguggcccauuacgcuaucauaggcccagggcugcaggcaaaggccaccagggaggcgcagaagcgcacagcugccggaaucaugaaaaauccuaccguagacggcauuguggcaaucgaucucgaccccgucguuuaugacgccaaguucgaaaaacaacuuggucagauuaugcuguugauccuguguacuucacagauacuccugaugcggacgacaugggcuuuaugcgagucuauuacccuugccacugggccacugaccacacucugggaaggaaguccuggcaaguuuuggaacacuaccaucgcagugucgauggcuaauaucuuccgagguagcuaccuagccggcgcggggcuggccuucuccuugaugaaaucucugggaggcgggagaaggggaacaggcgcacagggugagacgcucggggagaaguggaagcgccaacuuaaccagcugucaaaaagcgaauuuaauaccuauaagcgguccggaauuauggaggucgauagaagugaagcuaaagagggcuugaagcguggugaaacuacaaaacacgccgugucuaggggcaccgcaaagcugcggugguucguagagcgcaaccucgugaagcccgaggggaaaguuaucgacuuaggauguggccgagggggauggagcuacuauugcgcuggccugaagaaagugacugaagucaaggguuacacaaaagggggaccgggccaugaggaaccaauaccuauggccaccuacggcuggaaucuugugaagcugcacucagggaaagaugucuuuuucaugcccccagagaagugugacacgcuacucugcgauauuggagaauccagucccaacccuaccaucgaggaggguagaacacugaggguguugaagaugguugaaccguggcugaaaggcaaucaguuuuguauuaagauccucaaccccuauaugccaagcguaguggagacucuugaacagaugcaacggaaacaugggggaaugcugguccgcaauccuuuaucuagaaacuccacccacgagauguacugggugucaugcggcacagguaauauaguuagcgccgugaacaugacuucgaggaugcuguugaaccgauucaccaugguccaccggaagcccacauaugagcgugacguggaucucggggcgggaaccagacauguagcuguggaaccugagguugcaaaucuggacaucauuggccagcgcaucgaaaacauuaaaaaugagcacaagucuacuuggcauuacgaugaagacaacccauauaagacgugggccuaccacggcaguuaugaggucaaacccuccgggagcgcuucauccauggugaauggaguggucaggcuacuuacaaagccuugggauguuaucccaauggugacccagauugccaugacugacaccacacccuuuggucaacagcggguauucaaagagaagguggacacgagaaccccgcgcgcaaaaaggggcacuacacagaucauggaagucaccgccaaguggcuguggggguuucucucucgaaacaagaaaccucggauauguacuagagaggaauucacaaggaaggugcgcagcaaugcugcgauuggagccguuuuuguggaugagaaccaguggaauagugcaaaagaagcugucgaggacgagcguuucugggaucuggugcaccgggaaagagaguugcauaagcaaggcaaaugcgccaccugcguauacaacaugauggguaagagggaaaagaaacugggggaguuuggaaaggcaaaaggcucccgcgccaucugguacauguggcucggcgcucgauuccuugaauucgaggcccugggguuuaugaaugaggaccacugguucagccgggaaaacucuuuaucaggaguugagggugaaggccugcauaaguugggguauauccucagagauauuaguaaaauaccaggaggcaauauguacgcggacgauacagcagguugggacacuaggaucaccgaggaugaccugcagaacgaggccaagauuacggauaucauggaacccgagcacgcucuacuugccaccuccauuuuuaaacugacauaucagaauaaggugguccgcgugcagagaccugcaaagaacgggacugugauggacgucaucagccggagggaucaacguggaucuggccagguuggcaccuacgggcucaacacauucacuaauauggaagugcagcugauacgacagauggagucggaaggaaucuuuuugccaucagaguuagagacccccaaccuggcugaacgcguacucgacuggcuugagaaacauggugccgaaagacugaagcggauggcuauuagcggcgacgauuguguggucaaaccgaucgacgauagguucgccacggcacuaacagcgcugaaugacauggggaaggugcgcaaagauauuccucaaugggagcccuccaagggauggaacgacuggcagcagguuccauuuugcagucaccacuuccaucagcucgugaugaaggauggcagagaaaucgucgugccuugucggaaucaagacgaguugguagguagggcccgaguuucucagggggcuggauggagccugcgugagaccgccugccuuggcaaauccuaugcacagauguggcaacugauguacuuucacagacgcgaucuccgguuagcugccaacgcaauauguucagccgugcccgucgacugggugccaacuaguaggacaaccuggucuauucaugcgcaccaccaguggaugacuaccgaagauaugcugagcguuuggaauagaguguggaucgaggaaaaccccuggauggaggacaagacacaugucuccucaugggaagaggugccuuauuugggcaaacgcgaggaccaguggugcgggagccugaucggacucacggcucgggccaccugggcaacuaauauucagguagccauaaaccaagugaggcgacuuaucgguaaugaaaacuaccuggauuacaugacaucuaugaagagauucaaaaaugaguccgacccagaaggcgcucuaugguga

SEQ ID NO: 13506 - RNA, 9879 nt, Artificial Sequence
  derived and/or modified CDS sequence (opt3) from DENV-1__FJ639796__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacuuaucuggcuuuaauggccaccuuuaaaaugcgcccuauguucgcagugggucuccuguuucggagacuuacgucuagggagguccugcuacucacaaucgggcugagcuugguggccucaguugaacugccaaacaguuuagaggaacucggagacggccuggcuaugggcauuaugaugcuuaagcuguugaccgaguuccaaccccaccagcucuggacuacccugcuaucccugacauuugugaaaacuacccuuucucucgauuacgcguggaagacgacagccaugguccugagcauaguauccuuguucccgcuguguuuaucaaccacuagccagaaaacaaccuggcucccugugcugcuugggaguuuuggaugcaagccacugacuauguucuugaucacagaaaacaagauuuggggucgaaaaucuuggccccucaaugagggcaucauggcaauugggaucguuuccauacugcuaagcucgcugcuuaagaacgacgugccucucgcuggaccccugaucgccggcgguauguugauugccuguuaugucaucucagggucuagugcugauuuaucccuggagaaagcagccgaagugagcugggagcaggaagcggagcauucuggagcuagccacaauauucucguagaagugcaagacgauggcaccaugaagaucaaagacgaggagcgcgaugacacgcugacuauacuucugaaggccaccuugcuagcagucuccggcguuuacccaaugucaauuccugccacacuguuugugugguauuucuggcagaaaaagaagcagcggaguggggugcucugggauacccccagcccaccggaagucgagagagcugugcuggacgauggaaucuacaggauccuucagcgugguuuacugggccgcucucaaguugggguaggaguguuccaggacggcgucuuucauacaauguggcacgugacucggggugcaguucucauguaucaggggaaaagauuggaaccuuccugggccucagugaagaaagaccugauuaguuacggaggcggcuggagguuccaggggagcuggaacaccggagaggagguccaagugauagcgguagaacccgguaagaauccaaaaaacguccagacgacacccggcacuuuuaagaccccugagggggaagugggagcuaucgcccucgauuucaagccaggcacauccgguucucccauuguuaaucgagaggggaaaaucgugggacuguacggcaacggcgucgugaccacuucggggaccuauguuagcgcaauugcccaggcuaaggccucacaagaaggaccucuuccggagaucgaggacgaaguguuuaaaaagcggaaucugacaauaauggauuugcacccagguuccggcaaaacgcgcagauaccuacccgcaaucgucagggaggcuauuaagcggaagcugcgaacucucaucuuagccccuaccagagugguagcgagugaaauggccgaggcacugaaagggaugccaauucgcuaucagacaaccgcugugaagucugaacauacuggaagggagaucguugaccuuaugugccacgccacauucaccaugcgucugcucagccccguccgggugccuaacuacaauaugauaauuauggaugaggcucauuuuacggacccggcauccaucgccgccagaggcuauaucucaacuaggguggguaugggggaagcugcggcaauuuucaugacagccacccccccaggaucugucgaggcuuuuccucagagcaacgccguaauccaggaugaagagcgcgacauacccgaacgaaguuggaauuccggcuacgauuggauuaccgacuucccaggcaaaacugugugguuuguuccuagcaucaagucugggaacgauauugcaaauuguuugagaaaaaacggaaagcgggugauccaacugucaaggaagacauucgacaccgaguaucagaaaacaaagaacaaugacugggauuacgucgugacuacggacauauccgagaugggugccaacuuccgcgcugaucguguuauugaccccagacggugccucaaaccagugauccugaaggauggcccggaaagggucauccuugcggggccuaugcccgugaccguagccagugcagcucagcgccgaggaagaauuggccggaaucagaacaaagagggugaccaauacguguauauggggcagccacuaaauaacgaugaagaccacgcccauuggacagaggcaaagaugcuguuggauaauaucaacacucccgagggcauuauaccugccuuauuugaaccagagagggaaaagagcgcugccaucgacggagaguaccgccugagaggcgaagcgaggaaaaccuucguugagcucaugcggcguggggaucugcccgucuggcuuucguauaagguggcaucugagggauuucaguacuccgaccgccgauggugcuucgauggugaaagaaauaaccaggugcuggaggaaaauauggacgucgagauuuggacaaaagaaggcgagaggaagaaacuccggccucgcugguuggacgccagaaccuauagcgauccgcuggcucuaagggaguuuaaggaauucgccgcugggcggcgaucaguuaguggagaccugauccucgagaucggcaaacuuccacaacaccugacuuuaagagcacagaacgccuuggauaaucuggugaugcuccacaacucugaacagggugggaaggcuuaccgccaugccauggaggaacugcccgacacgauugagacccuuaugcugcucgcauugauagcgguacugacaggcggagugacuuuauuuuuccuauccggcaaggggcugggaaaaaccagcaucggucuccuuugugucacagccucaagugcucuguuguggauggccagcguggagccucacuggauugcagcuuccaucauucuggaauuuuuccucaugguucugcuuauccccgagccagauaggcagcggaccccucaagacaaucagcucgccuauguggucauaggccuguuguuuaugauccugacuguagcagccaacgaaaugggguuacuagagacaacgaagaaagaucugggaauuggcuacguggcugcggagaaccaucagcacgccaccaugcucgacguugaucuucgucccgcaucugcuuggacucuguacgccguggccacaaccgucaucaccccaaugaugagacacacaauugaaaauacuacggcaaacaucagcuugaccgcuauagccaaucaagcggcuauucugaugggucucgacaagggguggccuaucuccaaaauggauauuggcgugccgcugcuugccuuaggaugcuauucacaggucaacccccugacacucacugcagccguguugaugcugguugcucauuacgcaaucauaggcccagggcuacaggccaaggcgaccagggaggcucagaagcgcacagccgcaggaaucaugaaaaauccuaccguggacggcauuguagccaucgaucuggaccccguggucuaugacgcuaaguucgaaaaacaacucggucagauuaugcuucugaucuuguguacuucucagauacugcucaugcggacgacaugggcccugugcgagaguauuaccuuagcaacugggccacuuaccacacugugggaaggaucgccuggcaaguuuuggaacacuaccaucgcuguuagcauggccaauaucuuccgagguuccuaccucgcgggcgccgggcuagcauucucucugaugaaaucauugggaggcgggagaaggggaacaggcgcucagggugagacgcugggggagaaguggaagcgccaacucaaccagcuuagcaaauccgaauuuaauaccuauaagcggaguggaauuauggagguggauagaucugaagccaaagagggccugaagcguggugaaacuacaaaacacgcagucagcaggggcaccgcuaaguugcggugguucguggagcgcaaccugguaaagcccgaggggaaagugaucgaccucggauguggccgagggggauggucauacuauugcgccggcuuaaagaaaguuacugaagugaaggguuacacaaaagggggaccgggccaugaggaaccaauaccuauggccaccuacggcuggaaucuggucaagcuucacuccgggaaagauguguuuuucaugcccccagagaagugugacacgcugcuaugcgauauuggagaaaguagccccaacccuaccaucgaggaggguagaacacucaggguccugaagaugguggaaccgugguugaaaggcaaucaguuuuguauuaagauccugaaccccuauaugccaucuguuguagagacucucgaacagaugcaacggaaacaugggggaaugcuugugcgcaauccucuguccagaaacucaacccacgagauguacugggucagcugcggcacagguaauauagugucggcgguuaacaugacuucuaggauguuacugaaccgauucaccauggcucaccggaagcccacauaugagcgugacguggauuugggggcaggaaccagacaugucgccguggaaccugagguagcuaaucucgacaucauuggccagcgcaucgaaaacauuaaaaaugagcacaagaguacuuggcauuacgaugaagacaacccauauaagacgugggccuaccacggcuccuaugaggugaaacccagcgggucagcauccucuaugguuaauggagucgugaggcugcuaacaaagccuugggaugugaucccaauggucacccagauugccaugacugacaccacacccuuuggucaacagcggguuuucaaagagaagguggacacgagaaccccgcgcgcuaaaaggggcacuacacagaucauggaaguaaccgcgaaguggcuuuggggguuucugagccgaaacaagaaaccucggauauguacuagagaggaauucacaaggaaggugcgcaguaaugccgcaauuggagcugucuuuguggaugagaaccaguggaauuccgccaaagaagcaguugaggacgagcguuucugggaucucgugcaccgggaaagagagcugcauaagcaaggcaaaugcgccaccugcgucuacaacaugauggguaagagggaaaagaaauugggggaguuuggaaaggcuaaaggcagccgcgccaucugguacauguggcugggcgcgcgauuccucgaauucgaggcacuuggguuuaugaaugaggaccacugguucucucgggaaaacucacugaguggaguggagggugaaggcuuacauaagcugggguauaucuugagagauauuuccaaaauaccaggaggcaauauguacgccgacgauacagcugguugggacacuaggaucaccgaggaugaccuccagaacgaggccaagauuacggauaucauggaacccgagcacgcacugcuagcuaccagcauuuuuaaacuuacauaucagaauaagguaguucgcgugcagagaccugccaagaacgggacugucauggacgugaucucucggagggaucaacguggaucgggccaggugggcaccuacgggcugaacacauucacuaauauggaaguccagcucauacgacagauggagucagaaggaaucuuucugccaagcgaguuggagacccccaacuuagcugaacgcguucuggacuggcucgagaaacauggugccgaaagacuuaagcggauggcaauuuccggcgacgauugugugguaaaaccgaucgacgauagguucgcgacggcccugacagcucuaaaugacauggggaaggugcgcaaagauauuccucaaugggagcccaguaagggauggaacgacuggcagcaggucccauuuugcucucaccacuuccaucagcugaucaugaaggauggcagagaaauagugguuccuugucggaaucaagacgagcucguggguagggcccgagucagccagggggcaggaugguccuugcgugagaccgcuugccugggcaaaucauaugcccagauguggcaacuuauguacuuucacagacgcgaucugcggcucgcagccaacgcgauuuguagugcugugcccguagacuggguuccaacuucuaggacaaccuggagcauccaugcccaccaccaguggaugacuaccgaagauauguuauccguguggaauagagucuggaucgaggaaaaccccuggauggaggacaagacacaugugucaagcugggaagagguuccuuaucugggcaaacgcgaggaccaguggugcgggucuuugauuggacugacggcacgggccaccugggcuacuaauauacagguggccaucaaccaagucaggcgacucauugguaaugaaaacuaccuugauuacaugacauccaugaagagauucaaaaaugagagugacccagaaggcgcacugugguga

SEQ ID NO: 13507 - RNA, 9879 nt, Artificial Sequence
  derived and/or modified CDS sequence (opt3) from DENV-1__FJ639797__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaagggcuugggaggagggcgucugcgguauccggagcgccacacgccucgaaaauauuauguggaagcagauauccaacgagcugaaucauaucuuacuggaaaacgacaugaaauucaccgugguugugggcgacgcaaaugggauucuugcucagggaaagaaaaugaucagaccucaacccauggagcacaaguacucuuggaaaucguggggcaaggccaagauuaucggggcggauauacagaacacuaccuuuaucauugacggaccagauacaccugaaugucccgacggccagagggccuggaauaucugggaggucgaggauuaugguuucgggauuuuuacuaccaacaucugguugaaacuccgugacagcuacacacagaugugcgaucaccggcugauguccgcugcaauaaaggacucaaaagccgugcaugcugauaugggauauuggauugaaagugagaagaaugaaacguggaaacuagcccgagcaucuuucaucgagguuaagaccuguauuuggccaaagagccacacucugugguccaacggcgugcucgaaucagagaugaucauacccaaaaucuacgguggcccuauuagccaacauaauuauagaccaggguacuucacacagaccgcgggaccguggcaccugggcaagcuugaguuggacuuugaucugugcgaagggacuacaguagucguggacgagcacugcggaaacaggggccccucuuuacgcaccacgacugugaccgguaaaaucauucaugaaugguguugccgguccuguacacucccuccacugagauucaggggggaggauggaugcugguacggcauggagauccgccccgucaaggaaaaagaggaaaaucuuguucgaaguauggugagcgccgguucuggcgagguagacuccuuuucacuggggauauugugugugaguauuaugaucgaagaggucaugcggagccguuggucgagaaagaugcucaugaccggaacucuggcuguguuccuacugcucaucaugggccagcugacauggaacgaccuuauuagguugugcaucaugguuggggccaaugcauccgaucgcaugggaaugggcaccacauaucuggcuuuaauggccacuuuuaagaugcggccuauguucgcagugggucuccuguuuagaaggcuuaccucucgagagguccugcuacucacgauugggcugagcuugguggccucaguugaacugccaaacaguuuagaggaacucggagacggccuggcuaugggcauaaugaugcuuaaacuguugacagaguuccaaccccaccagcucuggaccacucugcuaucccugaccuuugugaagacaacucuuucucucgauuacgcguggaaaaccacggccaugguccugagcaucguauccuuguucccgcuguguuuaucaacaaccagccagaagacuacauggcucccugugcugcuugggaguuuuggaugcaaaccacugaccauguucuugauuacugaaaacaagaucuggggucgcaagucuuggccccucaaugagggcauuauggcaaucgggauaguuuccauccugcuaagcucgcugcuuaaaaacgacgugccucucgcuggaccccugauugccggcgguauguugaucgccuguuaugucauuucagggucuagugcugauuuaucccuggagaaggcagccgaagugagcugggagcaggaagcggagcauucuggagcuagccacaauauccucguagaagugcaagacgauggcacaaugaaaauaaaggacgaggagcgggaugacacccugacgauucuucugaaagccacuuugcuagcagucuccggcguuuacccaaugucaaucccugccacccuguuugugugguauuucuggcagaagaaaaagcagagaaguggggugcucugggauacacccagcccaccggaagucgagagggcugugcuggacgauggaaucuaccguauucuucagcgcgguuuacugggccggucucaaguugggguaggaguguuccaggacggcgucuuucauaccauguggcacgugacaagaggugcaguucucauguaucaggggaagagguuggaaccuuccugggccucagugaaaaaggaccugauaaguuacggaggcggcuggcgauuccaggggagcuggaacacuggagaggagguccaagugaucgcgguagaacccgguaaaaauccaaagaacguccagaccacgcccggcacauuuaaaacuccugagggggaagugggagcuauugcccucgauuucaagccaggcaccuccgguucucccaucguuaaucgggaggggaagauugugggacuguacggcaacggcgucgugacaaccucggggacuuauguuagcgcaaucgcccaggcuaaagccucacaagaaggaccucuuccggagauagaggacgaaguguuuaagaaacgcaaucugaccaucauggauuugcacccagguuccggcaagacaagaagguaccuacccgcaauuguccgggaggcuaucaaacgaaagcugagaacgcucauuuuagccccuacucgcgugguagcgagugaaauggccgaggcacugaaggggaugccaaucagguaucagaccacagcugugaaaucugaacauaccggacgugagauaguugaccuuaugugccacgccacuuucacaaugcggcugcucagccccgucagagugccuaacuacaauaugauuaucauggaugaggcucauuuuaccgacccggcauccaucgccgccaggggcuauauuucaacgcgcguggguaugggggaagcugcggcaaucuucaugacugccacacccccaggaucugucgaggcuuuuccucagagcaacgccguaauacaggaugaagagcgagacauucccgaaagaaguuggaauuccggcuacgauuggaucaccgacuucccaggcaagaccgugugguuuguuccuagcauuaaaucugggaacgauaucgcaaauuguuugcggaagaacggaaaaagggugauacaacugucacgcaagacuuucgacacagaguaucagaagaccaaaaacaaugacugggauuacgucgugacaacugacauuuccgagaugggugccaacuuccgugcugauagaguuaucgacccccggaggugccucaagccagugauccugaaagauggcccggaacgcgucauucuugcggggccuaugcccgugacgguagccagugcagcucagcgaagaggacggaucggcaggaaucagaacaaggagggugaccaauacguguauauggggcagccacuaaauaacgaugaagaccacgcccauuggaccgaggcaaaaaugcuguuggauaauauuaacacacccgagggcauaaucccugccuuauuugaaccagagcgcgaaaagagcgcugccauugacggagaguacagacugaggggcgaagcgcggaagacuuucguugagcucaugcgucgcggggaucugcccgucuggcuuucguauaaaguggcaucugagggauuucaguacuccgaccgaagauggugcuucgauggugaaaggaauaaccaggugcuggaggaaaauauggacgucgagaucuggaccaaggaaggcgagcggaaaaagcuccgcccuagaugguuggacgccaggacauauagcgauccgcuggcucuacgggaguuuaaagaauucgccgcugggcgaagaucaguuaguggagaccugauccucgagauuggcaagcuuccacaacaccugaccuuacgcgcacagaacgccuuggauaaucuggugaugcuccacaacucugaacagggugggaaagcuuacaggcaugccauggaggaacugcccgacacuauagagacgcuuaugcugcucgcauugaucgcgguacugaccggcggagugacauuauuuuuccuauccggcaaggggcugggaaagacuagcauuggucuccuuugugucaccgccucaagugcucuguuguggauggccagcguggagccucacuggaucgcagcuuccauuauccuggaauuuuuccucaugguucugcuuauacccgagccagaucggcagcguacaccucaagacaaucagcucgccuauguggucaucggccuguuguuuaugauucugaccguagcagccaacgaaaugggguuacuagagacuacaaaaaaggaucugggaaucggcuacguggcugcggagaaccaucagcacgccacgaugcucgacguugaucuuagacccgcaucugcuuggacccuguacgccguggccacuacagucauuaccccaaugaugaggcacaccaucgaaaauacaacugcaaacauaagcuugacggcuauugccaaucaagcggcuauccugaugggucucgacaaaggguggccuauuuccaagauggauaucggcgugccgcugcuugccuuaggaugcuauucacaggucaacccccugacccucacagcagccguguugaugcugguugcucauuacgcaauaaucggcccagggcuacaggccaaagcgacucgcgaggcucagaagcggaccgccgcaggaauuaugaagaauccuacaguggacggcaucguagccauugaucuggaccccguggucuaugacgcuaaauucgaaaagcaacucggucagaucaugcuucugauauuguguaccucucagauucugcucaugcgaacuacgugggcccugugcgagaguaucacauuagcaaccgggccacuuacuacccugugggaaggaucgccuggcaaauuuuggaacacaacuaucgcuguuagcauggccaauauuuucagagguuccuaccucgcgggcgccgggcuagcauucucucugaugaagucauugggaggcgggaggcgcggaaccggcgcucagggugagacacugggggagaaauggaagcggcaacucaaccagcuuagcaaguccgaauuuaauacguauaaaagaaguggaaucauggagguggaucguucugaagccaaggagggccugaaaaggggugaaaccacuaagcacgcagucagccggggcacagcuaaauugcgcugguucguggagcgaaaccugguaaagcccgaggggaaggugauagaccucggauguggcagagggggauggucauacuauugcgccggcuuaaaaaagguuaccgaagugaaagguuacacuaaggggggaccgggccaugaggaaccaauuccuauggccacauacggcuggaaucuggucaaacuucacuccgggaaggauguguuuuucaugcccccagagaaaugugacacccugcuaugcgauaucggagaaaguagccccaacccuacgauugaggaggguaggacccuccggguccugaagaugguggaaccgugguugaagggcaaucaguuuuguaucaaaauacugaaccccuauaugccaucuguuguagagacacucgaacagaugcaacgcaagcaugggggaaugcuugugagaaauccucuguccaggaacucaacucacgagauguacugggucagcugcggcaccgguaauaucgugucggcgguuaacaugacaucucgaauguuacugaaccgguucacuauggcucaccguaaacccaccuaugagagagacguggauuugggggcaggaacacgccaugucgccguggaaccugagguagcuaaucucgacauuaucggccagaggauugaaaacaucaagaaugagcacaaaaguaccuggcauuacgaugaagacaacccauauaagacuugggccuaccacggcuccuaugaggugaagcccagcgggucagcauccucuaugguuaauggagucgugcggcugcuaacgaaaccuugggaugugauuccaauggucacacagaucgccaugaccgacacuacccccuuuggucaacagagaguuuucaaggagaaaguggacacacgcacgccgagggcuaagcgaggcaccacucagauaauggaaguaacagcgaaauggcuuuggggguuucugagccggaacaagaagccuagaauuuguaccagggaggaauucacucgcaaagugcguaguaaugccgcaaucggagcugucuuuguggaugagaaccaguggaauuccgccaaggaagcaguugaggacgagcgguucugggaucucgugcacagagaaagggagcugcauaaacaaggcaagugcgccacaugcgucuacaacaugauggguaaacgcgaaaagaaguugggggaguuuggaaaagcuaagggcagccgagccaucugguacauguggcugggcgcgcgguuccucgaauucgaggcacuuggguuuaugaaugaggaccacugguucucuagagaaaacucacugaguggaguggagggugaaggcuuacauaaacugggguauauuuugagggauauauccaagaucccaggaggcaauauguacgccgacgauaccgcugguugggacacacgcauuacugaggaugaccuccagaacgaggccaaaaucaccgauauuauggaacccgagcacgcacugcuagcuacgagcaucuuuaagcuuaccuaucagaauaaaguaguuagagugcagcggccugccaagaacgggacagucauggacgugauaucuaggcgugaucaacgaggaucgggccaggugggcacuuacgggcugaacaccuucacaaauauggaaguccagcucauccgccagauggagucagaaggaauuuuucugccaagcgaguuggagacucccaacuuagcugaaagaguucuggacuggcucgagaagcauggugccgaacggcuuaaaaggauggcaaucuccggcgacgauugugugguaaagccgauugacgaucgcuucgcgaccgcccugacggcucuaaaugacauggggaaagugagaaaggauaucccucaaugggagcccaguaaaggauggaacgacuggcagcaggucccauuuugcucucaccacuuccaucagcugauaaugaaggauggccgggaaauugugguuccuuguaggaaucaagacgagcucgugggucgagcccgugucagccagggggcaggaugguccuugagagagacagcuugccugggcaagucauaugcccagauguggcaacuuauguacuuucaccgccgggaucugaggcucgcagccaacgcgaucuguagugcugugcccguagacuggguuccaaccucuagaacuacauggagcauccaugcccaccaccaguggaugaccacugaagauauguuauccguguggaaucgcgucuggauugaggaaaaccccuggauggaggacaaaacccaugugucaagcugggaagagguuccuuaucugggcaagcgggaggaccaguggugcgggucuuugauaggacugacagcaagggccacgugggcuaccaauauccagguggccauuaaccaaguccgaagacucaucgguaaugaaaacuaccuugauuacaugacuuccaugaaacgguucaagaaugagagugacccagaaggcgcacugugguga

SEQ ID NO: 13508 - RNA, 9879 nt, Artificial Sequence
  derived and/or modified CDS sequence (opt3) from DENV-1__FJ639802__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauagauuucaggccgauucaccgaagaggcugagugcagccaucggaaaagcuugggaggagggcgucugcgguauccggagcgccacacgccucgaaaauauuauguggaagcagauauccaacgagcugaaucauaucuuacuggaaaacgacaugaaauucaccgugguugugggcgacgcaaaugggauucuugcucagggaaagaaaaugaucagaccucaacccauggagcacaaguacucuuggaaaucguggggcaaggccaagauuaucggggcggauauacagaacacuaccuuuaucauugacggaccagauacaccugaaugucccgacggccagagggccuggaauaucugggaggucgaggauuaugguuucgggauuuuuacuaccaacaucugguugaaacuccgugacagcuacacacagaugugcgaucaccggcugauguccgcugcaauaaaggacucaaaagccgugcaugcugauaugggauauuggauugaaagugagaagaaugaaacguggaaacuagcccgagcaucuuucaucgagguuaagaccuguauuuggccaaagagccacacucugugguccaacggcgugcucgaaucagagaugaucauacccaaaaucuacgguggcccuauuagccaacauaauuauagaccaggguacuucacacagaccgcgggaccguggcaccugggcaagcuugaguuggacuuugaucugugcgaagggacuacaguagucguggacgagcacugcggaaacaggggccccucuuuacgcaccacgacugugaccgguaaaaucauucaugaaugguguugccgguccuguacacucccuccacugagauucaggggggaggauggaugcugguacggcauggagauccgccccgucaaggaaaaagaggaaaaucuuguucgaaguauggugagcgccgguucuggcgagguagacuccuuuucacuggggauauugugugugaguauuaugaucgaagaggucaugcggagccguuggucgagaaagaugcucaugaccggaacucuggcuguguuccuacugcucaucaugggccagcugacauggaacgaccuuauuagguugugcaucaugguuggggccaaugcauccgaucgcaugggaaugggcaccacauaucuggcuuuaauggccacuuuuaagaugcggccuauguucgcagugggucuccuguuuagaaggcuuaccucucgagagguccugcuacucacgauugggcugagcuugguggccucaguugaacugccaaacaguuuagaggaacucggagacggccuggcuaugggcauaaugaugcuuaaacuguugacagaguuccaaccccaccagcucuggaccacucugcuaucccugaccuuugugaagacaacucuuucucucgauuacgcguggaaaaccacggccaugguccugagcaucguauccuuguucccgcuguguuuaucaacaaccagccagaagacuacauggcucccugugcugcuugggaguuuuggaugcaaaccacugaccauguucuugauuacugaaaacaagaucuggggucgcaagucuuggccccucaaugagggcauuauggcaaucgggauaguuuccauccugcuaagcucgcugcuuaaaaacgacgugccucucgcuggaccccugauugccggcgguauguugaucgccuguuaugucauuucagggucuagugcugauuuaucccuggagaaggcagccgaagugagcugggagcaggaagcggagcauucuggagcuagccacaauauccucguagaagugcaagacgauggcacaaugaaaauaaaggacgaggagcgggaugacacccugacgauucuucugaaagccacuuugcuagcagucuccggcguuuacccaaugucaaucccugccacccuguuugugugguauuucuggcagaagaaaaagcagagaaguggggugcucugggauacacccagcccaccggaagucgagagggcugugcuggacgauggaaucuaccguauucuucagcgcgguuuacugggccggucucaaguugggguaggaguguuccaggacggcgucuuucauaccauguggcacgugacaagaggugcaguucucauguaucaggggaagagguuggaaccuuccugggccucagugaaaaaggaccugauaaguuacggaggcggcuggcgauuccaggggagcuggaacacuggagaggagguccaagugaucgcgguagaacccgguaaaaauccaaagaacguccagaccacgcccggcacauuuaaaacuccugagggggaagugggagcuauugcccucgauuucaagccaggcaccuccgguucucccaucguuaaucgggaggggaagauugugggacuguacggcaacggcgucgugacaaccucggggacuuauguuagcgcaaucgcccaggcuaaagccucacaagaaggaccucuuccggagauagaggacgaaguguuuaagaaacgcaaucugaccaucauggauuugcacccagguuccggcaagacaagaagguaccuacccgcaauuguccgggaggcuaucaaacgaaagcugagaacgcucauuuuagccccuacucgcgugguagcgagugaaauggccgaggcacugaaggggaugccaaucagguaucagaccacagcugugaaaucugaacauaccggacgugagauaguugaccuuaugugccacgccacuuucacaaugcggcugcucagccccgucagagugccuaacuacaauaugauuaucauggaugaggcucauuuuaccgacccggcauccaucgccgccaggggcuauauuucaacgcgcguggguaugggggaagcugcggcaaucuucaugacugccacacccccaggaucugucgaggcuuuuccucagagcaacgccguaauacaggaugaagagcgagacauucccgaaagaaguuggaauuccggcuacgauuggaucaccgacuucccaggcaagaccgugugguuuguuccuagcauuaaaucugggaacgauaucgcaaauuguuugcggaagaacggaaaaagggugauacaacugucacgcaagacuuucgacacagaguaucagaagaccaaaaacaaugacugggauuacgucgugacaacugacauuuccgagaugggugccaacuuccgugcugauagaguuaucgacccccggaggugccucaagccagugauccugaaagauggcccggaacgcgucauucuugcggggccuaugcccgugacgguagccagugcagcucagcgaagaggacggaucggcaggaaucagaacaaggagggugaccaauacguguauauggggcagccacuaaauaacgaugaagaccacgcccauuggaccgaggcaaaaaugcuguuggauaauauuaacacacccgagggcauaaucccugccuuauuugaaccagagcgcgaaaagagcgcugccauugacggagaguacagacugaggggcgaagcgcggaagacuuucguugagcucaugcgucgcggggaucugcccgucuggcuuucguauaaaguggcaucugagggauuucaguacuccgaccgaagauggugcuucgauggugaaaggaauaaccaggugcuggaggaaaauauggacgucgagaucuggaccaaggaaggcgagcggaaaaagcuccgcccuagaugguuggacgccaggacauauagcgauccgcuggcucuacgggaguuuaaagaauucgccgcugggcgaagaucaguuaguggagaccugauccucgagauuggcaagcuuccacaacaccugaccuuacgcgcacagaacgccuuggauaaucuggugaugcuccacaacucugaacagggugggaaagcuuacaggcaugccauggaggaacugcccgacacuauagagacgcuuaugcugcucgcauugaucgcgguacugaccggcggagugacauuauuuuuccuauccggcaaggggcugggaaagacuagcauuggucuccuuugugucaccgccucaagugcucuguuguggauggccagcguggagccucacuggaucgcagcuuccauuauccuggaauuuuuccucaugguucugcuuauacccgagccagaucggcagcguacaccucaagacaaucagcucgccuauguggucaucggccuguuguuuaugauucugaccguagcagccaacgaaaugggguuacuagagacuacaaaaaaggaucugggaaucggcuacguggcugcggagaaccaucagcacgccacgaugcucgacguugaucuuagacccgcaucugcuuggacccuguacgccguggccacuacagucauuaccccaaugaugaggcacaccaucgaaaauacaacugcaaacauaagcuugacggcuauugccaaucaagcggcuauccugaugggucucgacaaaggguggccuauuuccaagauggauaucggcgugccgcugcuugccuuaggaugcuauucacaggucaacccccugacccucacagcagccguguugaugcugguugcucauuacgcaauaaucggcccagggcuacaggccaaagcgacucgcgaggcucagaagcggaccgccgcaggaauuaugaagaauccuacaguggacggcaucguagccauugaucuggaccccguggucuaugacgcuaaauucgaaaagcaacucggucagaucaugcuucugauauuguguaccucucagauucugcucaugcgaacuacgugggcccugugcgagaguaucacauuagcaaccgggccacuuacuacccugugggaaggaucgccuggcaaauuuuggaacacaacuaucgcuguuagcauggccaauauuuucagagguuccuaccucgcgggcgccgggcuagcauucucucugaugaagucauugggaggcgggaggcgcggaaccggcgcucagggugagacacugggggagaaauggaagcggcaacucaaccagcuuagcaaguccgaauuuaauacguauaaaagaaguggaaucauggagguggaucguucugaagccaaggagggccugaaaaggggugaaaccacuaagcacgcagucagccggggcacagcuaaauugcgcugguucguggagcgaaaccugguaaagcccgaggggaaggugauagaccucggauguggcagagggggauggucauacuauugcgccggcuuaaaaaagguuaccgaagugaaagguuacacuaaggggggaccgggccaugaggaaccaauuccuauggccacauacggcuggaaucuggucaaacuucacuccgggaaggauguguuuuucaugcccccagagaaaugugacacccugcuaugcgauaucggagaaaguagccccaacccuacgauugaggaggguaggacccuccggguccugaagaugguggaaccgugguugaagggcaaucaguuuuguaucaaaauacugaaccccuauaugccaucuguuguagagacacucgaacagaugcaacgcaagcaugggggaaugcuugugagaaauccucuguccaggaacucaacucacgagauguacugggucagcugcggcaccgguaauaucgugucggcgguuaacaugacaucucgaauguuacugaaccgguucacuauggcucaccguaaacccaccuaugagagagacguggauuugggggcaggaacacgccaugucgccguggaaccugagguagcuaaucucgacauuaucggccagaggauugaaaacaucaagaaugagcacaaaaguaccuggcauuacgaugaagacaacccauauaagacuugggccuaccacggcuccuaugaggugaagcccagcgggucagcauccucuaugguuaauggagucgugcggcugcuaacgaaaccuugggaugugauuccaauggucacacagaucgccaugaccgacacuacccccuuuggucaacagagaguuuucaaggagaaaguggacacacgcacgccgagggcuaagcgaggcaccacucagauaauggaaguaacagcgaaauggcuuuggggguuucugagccggaacaagaagccuagaauuuguaccagggaggaauucacucgcaaagugcguaguaaugccgcaaucggagcugucuuuguggaugagaaccaguggaauuccgccaaggaagcaguugaggacgagcgguucugggaucucgugcacagagaaagggagcugcauaaacaaggcaagugcgccacaugcgucuacaacaugauggguaaacgcgaaaagaaguugggggaguuuggaaaagcuaagggcagccgagccaucugguacauguggcugggcgcgcgguuccucgaauucgaggcacuuggguuuaugaaugaggaccacugguucucuagagaaaacucacugaguggaguggagggugaaggcuuacauaaacugggguauauuuugagggauauauccaagaucccaggaggcaauauguacgccgacgauaccgcugguugggacacacgcauuacugaggaugaccuccagaacgaggccaaaaucaccgauauuauggaacccgagcacgcacugcuagcuacgagcaucuuuaagcuuaccuaucagaauaaaguaguuagagugcagcggccugccaagaacgggacagucauggacgugauaucuaggcgugaucaacgaggaucgggccaggugggcacuuacgggcugaacaccuucacaaauauggaaguccagcucauccgccagauggagucagaaggaauuuuucugccaagcgaguuggagacucccaacuuagcugaaagaguucuggacuggcucgagaagcauggugccgaacggcuuaaaaggauggcaaucuccggcgacgauugugugguaaagccgauugacgaucgcuucgcgaccgcccugacggcucuaaaugacauggggaaagugagaaaggauaucccucaaugggagcccaguaaaggauggaacgacuggcagcaggucccauuuugcucucaccacuuccaucagcugauaaugaaggauggccgggaaauugugguuccuuguaggaaucaagacgagcucgugggucgagcccgugucagccagggggcaggaugguccuugagagagacagcuugccugggcaagucauaugcccagauguggcaacuuauguacuuucaccgccgggaucugaggcucgcagccaacgcgaucuguagugcugugcccguagacuggguuccaaccucuagaacuacauggagcauccaugcccaccaccaguggaugaccacugaagauauguuauccguguggaaucgcgucuggauugaggaaaaccccuggauggaggacaaaacccaugugucaagcugggaagagguuccuuaucugggcaagcgggaggaccaguggugcgggucuuugauaggacugacagcaagggccacgugggcuaccaauauccagguggccauuaaccaaguccgaagacucaucgguaaugaaaacuaccuugauuacaugacuuccaugaaacgguucaagaaugagagugacccagaaggcgcacugugguga

SEQ ID NO: 13509 - RNA, 9879 nt, Artificial Sequence
  derived and/or modified CDS sequence (opt3) from DENV-1__JN819410__SS-prME
agcgugaccaugcugcucaugcuucugcccacagcauuggcuuuccacuuaacuacgaggggcggggagccucauaugaucguauccaagcaggaaaggggaaaaucucuguuauuuaagaccucagccgguguuaacaugugcacccucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagggacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauugguggauagaggcugggguaauggguguggacucuucggcaaaggcaaccuguuaacuugcgcuaaguuuaagugcguaaccaaacuggaagggaagauagugcaguacgagaaucucaaauauagcgucauugugacaguucacaccggagaccagcaucaaguggguaacgaaacuacggagcacggcacaaucgccaccauuacuccccaggcgccuaccuccgaaauccagcuuacagauuacggggcccugaccuuggacuguucaccaaggacuggacuagacuucaaugagaugguccugcucacaaugaaggagaaaaguuggcuggugcauaagcagugguuucuugaucugccguugcccuggacgagcggcgcaucuaccucccaagaaacuuggaaccggcaggaccuccugguaacauucaaaaccgcucacgccaagaagcaggagguuguggucuuagguucacaagaaggggcuaugcacacagcccugacuggcgcaaccgagauccagacgagcggaaccacaacuauuuuugccggccaucuaaaaugccgucucaagauggauaaacugacccuuaaggggaugaguuaugugauguguacaggaucuuucaaauuggaaaaggaggucgcugagacucagcacgguaccgugcugguucaggugaaguacgaaggcacggacgcgccuugcaaaauaccauucuccacacaagaugagaaggggguaacccagaauggacgccucaucacugcaaaccccauugucacagacaaagaaaagccugugaauaucgagaccgagccacccuuuggcgaaagcuauauaguugugggugccggggagaaagcucugaaacuuucgugguucaagagaggaucuuccauuggaaaaauguuugaagccacugcaaggggcgcccggcgaauggcuauccugggggauaccgccugggacuucggaucaaucgguggcgucuuuacaaguguggggaaguugguacaucagguguucggaacggcauacggcguucucuuuagcggugucuccuggaccaugaaaauugggaucggcauucuguuaacuuggcugggacuaaacucucgcagcacaucacucaguaugaccuguauagcggugggcauggugacacuguaccuuggggucaugguucaggcugauuccggaugcgugaucaacuggaagggcagagaguugaaaugugguagcgggauuuucgugacuaaugaaguacacaccuggacggagcaauauaaguuucaggccgacucuccgaagaggcugucagcagccaucggaaaggcuugggaggaaggcgucugcgguauccggagugccacacgccucgagaacauuauguggaagcagauaagcaaugaacugaaccauaucuuacuggagaaugauaugaaauucaccgugguugugggcgacgcaaacgggauucuugcucagggaaagaaaaugaucagaccucaacccauggaacacaaguacuccuggaaaucuuggggcaaggccaagauuaucggggcggacauacagaauacuaccuuuaucauugauggaccagacacaccugagugucccgauggccagagggccuggaacaucugggaggucgaagacuaugguuucgggguguuuacuaccaauauuugguugaaacuccgugauucguacacacagaugugcgaccaccggcugaugagcgcugcaaucaaggauuccaaagccguucaugcugacaugggauauuggauagagucagaaaagaacgagacguggaaacuagcccgagcaaguuucauugaagugaagaccuguacuuggccaaagucucacacacuguggagcaauggcguacucgaguccgagaugaucauucccaaaaucuacgguggcccuauaucacaacauaacuauagaccaggguacuucacccagacugcgggaccguggcaccugggcaaacuugaauuggauuuugaccugugcgaggggacaaccgucgugguggaugaacacugcggaaauaggggccccagcuuacgcacgacuaccgucacagguaaaaucauucaugagugguguugccggucuuguacccucccuccacugagauucagaggggaagacggaugcugguacggcauggaaauccgccccguuaaggagaaagaagagaaccuugugcgauccaugguaagugccgguagcggcgaaguggauucuuuuucccuggggauuuugugugucucaaucaugauagaggaggugaugcggagucguuggagcagaaagaugcucaugacuggaacacuggcuguuuuccuacugcucauuaugggccagcugaccuggaaugaccuuaucagguugugcaucauggugggggccaacgcaucggaccgcaugggaaugggcacaacuuaucuggcuuuaauggccaccuuuaagaugcggccuauguucgcagucggucuccuguuuagaaggcuuacgucccgagaagugcugcuacucacaauugggcugucuuugguugccagcguggagcugccaaacucauuagaggaacucggagauggccuggcuaugggcaucaugaugcuuaaacuguugaccgaguuccaaccccaccagcucuggacuacccugcuaagucugacauuuauuaagacuacccuuucccucgacuacgcguggaaaacgacagccaugguccugucuauagucagcuuguucccgcuguguuuauccaccacuucacagaagacaaccuggcucccugugcugcuugggagcuuuggaugcaaaccacugacuauguucuugaucacagagaauaagauuuggggucgcaagaguuggccccucaacgagggcaucauggcaauugggaucguuucuauacugcuauccagccugcuuaaaaaugaugugccucucgcuggaccccugaucgccggcgguauguugauugccuguuaugucaucucggggucaucugcugacuuaagucuggaaaaggcagccgagguguccugggaacaggaggcggaacauagcggagcuucucacaacauucucguagaggugcaagaugacggcaccaugaaaaucaaggaugaggaacgggacgauacgcugacuauacuucugaaagccaccuugcuagcagucagcggcguuuacccaauguccauuccugccacacuguuugugugguauuucuggcagaagaaaaagcagagaucaggggugcucugggacacccccaguccaccggaggucgaaagggcugugcuggaugacggaaucuaccguauccuucagcgcgguuuacugggccggagccaaguugggguaggaguguuccaggauggcgucuuucauacaauguggcacgugacuagaggugcaguucucauguaucaggggaagagguuggagccuucuugggccuccgugaaaaaggaccugauuucauacggaggcggcuggcgauuccaggggaguuggaauaccggagaggaaguccaagugauagcgguagagcccgguaaaaacccaaagaauguccagacgacacccggcacuuuuaaaaccccugaaggggaggugggagcuaucgcccucgacuucaagccaggcacaagcgguucccccauuguuaaccgggaagggaagaucgugggacuguacggcaauggcgucgugaccacuucugggaccuauguuucggcaauugcccaggcuaaagccagccaagagggaccucuuccggagaucgaagaugagguguuuaagaaacgcaaccugacaauaauggacuugcacccagguucaggcaagacgagaagguaccuacccgcaaucguccgggaagcuauuaaacgaaagcugagaacucucaucuuagccccuacccgcgugguagcguccgagauggccgaagcacugaaggggaugccaauuagguaucagacaaccgcugugaaaagugagcauacuggacgugagaucguugaucuuaugugccacgccacauucaccaugcggcugcucucucccgucagagugccuaauuacaacaugauaauuauggacgaagcucauuuuacggauccggcaagcaucgccgccaggggcuauaucuccacucgcguggguaugggggaggcugcggcaauuuucaugacagccacacccccaggaucagucgaagccuuuccucagucuaaugccguaauccaggacgaggaacgagauauacccgagagaagcuggaacaguggcuacgacuggauuaccgauuucccaggcaagacugugugguuuguuccuuccaucaaaagcgggaaugacauugcaaacuguuugcggaagaacggaaaaagggugauccaacugucucgcaagacauucgauaccgaguaucagaagacuaagaauaacgacugggacuacgucgugacuacggauauaucagaaaugggugccaauuuccgugcugacagaguuauugauccccggaggugccucaagccagugauccugaaagacggcccggagcgcgucauccuugcggggccuaugcccgugaccguagccuccgcagcucagcgaagaggacggauuggcaggaaccagaauaaggaaggugaucaauacguguauauggggcagccacuaaacaaugacgaggaucacgcccauuggacagaggcaaaaaugcuguuggacaacaucaauacucccgaaggcauuauaccugccuuauuugagccagaacgcgagaagagugcugccaucgauggagaauacagacugaggggcgaggcgcggaagaccuucguugagcucaugcgucgcggggaccugcccgucuggcuuagcuauaaaguggcaucggaaggauuucaguacucugaucgaagauggugcuucgacggugagaggaacaaucaggugcuggaagagaacauggaugucgaaauuuggacaaaggagggcgagcggaaaaagcuccgcccuagaugguuggacgccaggaccuauuccgacccgcuggcucuacgggaauuuaaagaguucgccgcugggcgaagaagcguuucaggagaucugauccucgaaaucggcaaacuuccacaacaccugacuuuacgcgcacagaaugccuuggacaaccuggugaugcuccacaauagugagcagggugggaaggcuuacaggcaugccauggaggaacugcccgauacgauugagacccuuaugcugcucgcauugauagcgguacugacaggcggagugacuuuauuuuuccuaucuggcaaggggcugggaaagaccuccaucggucuccuuugugucacagccagcucagcucuguuguggauggccaguguggaaccucacuggauugcagcuagcaucauucuggaguuuuuccucaugguucugcuuauccccgaaccagaccggcagcguaccccucaagauaaccagcucgccuauguggucauaggccuguuguuuaugauccugacuguagcagccaacgagaugggguuacuagagacaacgaaaaaggaccugggaauuggcuacguggcugcggaaaaucaucagcacgccaccaugcucgauguugaccuucaccccgcauccgcuuggacucuguacgccguggccacaaccgucaucaccccaaugaugagacauacaauugagaacacuacggcaaauaucucuuugaccgcuauagccaaccaagcggcuauucugaugggucucgauaaaggguggccuaucagcaagauggacauuggcgugccgcugcuugccuuaggaugcuauucccaggucaauccccugacacucacugcagccguguugaugcugguugcucacuacgcaaucauaggcccagggcuacaggccaaagcgaccagggaagcucagaagcgcacagccgcaggaaucaugaagaacccuaccguggauggcauuguagccaucgaccuggaucccguggucuaugacgcuaaauucgagaagcaacucggucagauuaugcuucugaucuuguguacuucacagauacugcucaugcggacgacaugggcccugugcgaaucuauuaccuuagcaacugggccacuuaccacacugugggagggaaguccuggcaaauuuuggaauacuaccaucgcuguuucgauggccaacaucuuccgagguagcuaccucgcgggcgccgggcuagcauucucccugaugaagucuuugggaggcgggagaaggggaacaggcgcucagggugagacgcugggggaaaaauggaagcgccaacucaaucagcuuucaaagagcgaguuuaacaccuauaaacgguccggaauuauggaaguggacagaagugaggccaaggaaggccugaaacguggugagacuacaaagcaugcagucucuaggggcaccgcuaaauugcggugguucguggagcgcaaucugguaaagcccgaagggaaggugaucgaucucggauguggccgagggggauggagcuacuauugcgccggccuaaagaagguuacugaggugaaagguuacacaaaagggggcccgggccacgaggagccaauaccuauggccaccuacggcuggaaccuggucaaacuucauucagggaaggacguguuuuucaugcccccagaaaaaugugauacgcugcuaugcgacauuggagaguccagucccaauccuaccaucgaggaagguagaacacucaggguccugaagaugguggagccgugguugcggggcaaccaguuuuguauuaagauccugaaucccuauaugccaagcguuguagaaacucucgagcagaugcaacgcaaacacgggggaaugcuugugagaaacccucugucuagaaauuccacccacgagauguacugggucucaugcggcacagguaacauagugagcgcgguuaacaugacuucgcgaauguuacugaaucgguucaccauggcucaucguaagcccacauaugaaagagauguggacuugggggcaggaacccgccacgucgccguggagccugaaguagcuaaccucgauaucauuggccagaggaucgagaauauuaaaaacgaacauaagucuacuuggcacuacgacgaggauaauccauauaaaacgugggccuaccacggcaguuaugaggugaagcccuccgggagcgcaucauccaugguuaacggagucgugcggcugcuaacaaagccuugggacgugaucccaauggucacccagauugccaugacugauaccacacccuuuggucaacagagaguuuucaaagaaaagguggacacgcgcaccccgagggcuaaacgaggcacuacacagaucauggagguaaccgcgaaguggcuuuggggguuucugucucggaauaaaaagccuagaauauguacuagggaagaguucacacgcaaggugcguagcaacgccgcaauuggagcugucuuuguggacgaaaaucaguggaacagugccaaagaggcaguugaggaugaacgguucugggaccucgugcauagagagagggaacugcacaagcaaggcaaaugcgcuaccugcgucuacaauaugauggguaagcgcgagaaaaaguugggggaauuuggaaaggcuaaaggcucccgagccaucugguacauguggcugggcgcgcgguuccucgaguucgaggcacuuggguuuaugaacgaagaucauugguucagcagagaaaauucucugucaggaguggaaggugagggcuuacacaagcugggguauaucuugagggacauuaguaaaauaccaggaggcaacauguacgccgaugacacagcugguugggauacucgcaucaccgaggacgaucuccagaaugaagccaagauuacggacaucauggagcccgaacaugcacugcuagcuaccuccauuuuuaaacuuacauaucagaacaagguaguuagagugcagcggccugccaaaaacgggacugucauggaugugaucagcaggcgugaccaacgaggaucuggccaggugggcaccuacgggcugaauacauucacuaacauggagguccagcucauacgccagauggaaucggagggaaucuuucugccaucagaguuggaaacccccaauuuagcugagagagcccuggauuggcucgaaaagcacggugcagagcggcuuaagaggauggcgauuagcggcgacgacuguguugugaaaccgaucgaugaccgcuucgccacggcucugacagcccuaaacgauauggggaagguaagaaaagacauuccucaaugggaacccuccaagggauggaaugauuggcaacaggugccauuuugcagucaccauuuccaccagcugaucaugaaagacggccgggagauagucgugccuuguaggaaccaagaugagcucguuggucgagcacgugugucucagggggcuggauggagcuugagagaaaccgccugccugggcaaguccuaugcacagauguggcaacuuauguacuuucaucgccgggaccugaggcucgccgcgaaugcuauuuguucagccguccccguggauuggguaccaacaaguagaacaaccuggucuauccacgcacaccaucaguggaugacuaccgaggacauguuaagcguuuggaaccgcguguggaucgaagagaaucccuggauggaagauaagacacacgucuccucaugggaggaggugccuuaucugggcaaacgggaagaccaguggugcgggagcuugauuggacugacggccagggcuaccugggccacuaacauacagguugcaaucaaucaagugcgaagacucauugguaacgagaauuaccuugacuacaugacaucuaugaagcgguucaaaaacgaauccgauccagagggcgcucugugguga

SEQ ID NO: 13510 - RNA, 9879 nt, Artificial Sequence
  derived and/or modified CDS sequence (opt3) from DENV-1__FJ639806__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaagggcuugggaggagggcgucugcgguauccggagcgccacacgccucgaaaauauuauguggaagcagauauccaacgagcugaaucauaucuuacuggaaaacgacaugaaauucaccgugguugugggcgacgcaaaugggauucuugcucagggaaagaaaaugaucagaccucaacccauggagcacaaguacucuuggaaaucguggggcaaggccaagauuaucggggcggauauacagaacacuaccuuuaucauugacggaccagauacaccugaaugucccgacggccagagggccuggaauaucugggaggucgaggauuaugguuucgggauuuuuacuaccaacaucugguugaaacuccgugacagcuacacacagaugugcgaucaccggcugauguccgcugcaauaaaggacucaaaagccgugcaugcugauaugggauauuggauugaaagugagaagaaugaaacguggaaacuagcccgagcaucuuucaucgagguuaagaccuguauuuggccaaagagccacacucugugguccaacggcgugcucgaaucagagaugaucauacccaaaaucuacgguggcccuauuagccaacauaauuauagaccaggguacuucacacagaccgcgggaccguggcaccugggcaagcuugaguuggacuuugaucugugcgaagggacuacaguagucguggacgagcacugcggaaacaggggccccucuuuacgcaccacgacugugaccgguaaaaucauucaugaaugguguugccgguccuguacacucccuccacugagauucaggggggaggauggaugcugguacggcauggagauccgccccgucaaggaaaaagaggaaaaucuuguucgaaguauggugagcgccgguucuggcgagguagacuccuuuucacuggggauauugugugugaguauuaugaucgaagaggucaugcggagccguuggucgagaaagaugcucaugaccggaacucuggcuguguuccuacugcucaucaugggccagcugacauggaacgaccuuauuagguugugcaucaugguuggggccaaugcauccgaucgcaugggaaugggcaccacauaucuggcuuuaauggccacuuuuaagaugcggccuauguucgcagugggucuccuguuuagaaggcuuaccucucgagagguccugcuacucacgauugggcugagcuugguggccucaguugaacugccaaacaguuuagaggaacucggagacggccuggcuaugggcauaaugaugcuuaaacuguugacagaguuccaaccccaccagcucuggaccacucugcuaucccugaccuuugugaagacaacucuuucucucgauuacgcguggaaaaccacggccaugguccugagcaucguauccuuguucccgcuguguuuaucaacaaccagccagaagacuacauggcucccugugcugcuugggaguuuuggaugcaaaccacugaccauguucuugauuacugaaaacaagaucuggggucgcaagucuuggccccucaaugagggcauuauggcaaucgggauaguuuccauccugcuaagcucgcugcuuaaaaacgacgugccucucgcuggaccccugauugccggcgguauguugaucgccuguuaugucauuucagggucuagugcugauuuaucccuggagaaggcagccgaagugagcugggagcaggaagcggagcauucuggagcuagccacaauauccucguagaagugcaagacgauggcacaaugaaaauaaaggacgaggagcgggaugacacccugacgauucuucugaaagccacuuugcuagcagucuccggcguuuacccaaugucaaucccugccacccuguuugugugguauuucuggcagaagaaaaagcagagaaguggggugcucugggauacacccagcccaccggaagucgagagggcugugcuggacgauggaaucuaccguauucuucagcgcgguuuacugggccggucucaaguugggguaggaguguuccaggacggcgucuuucauaccauguggcacgugacaagaggugcaguucucauguaucaggggaagagguuggaaccuuccugggccucagugaaaaaggaccugauaaguuacggaggcggcuggcgauuccaggggagcuggaacacuggagaggagguccaagugaucgcgguagaacccgguaaaaauccaaagaacguccagaccacgcccggcacauuuaaaacuccugagggggaagugggagcuauugcccucgauuucaagccaggcaccuccgguucucccaucguuaaucgggaggggaagauugugggacuguacggcaacggcgucgugacaaccucggggacuuauguuagcgcaaucgcccaggcuaaagccucacaagaaggaccucuuccggagauagaggacgaaguguuuaagaaacgcaaucugaccaucauggauuugcacccagguuccggcaagacaagaagguaccuacccgcaauuguccgggaggcuaucaaacgaaagcugagaacgcucauuuuagccccuacucgcgugguagcgagugaaauggccgaggcacugaaggggaugccaaucagguaucagaccacagcugugaaaucugaacauaccggacgugagauaguugaccuuaugugccacgccacuuucacaaugcggcugcucagccccgucagagugccuaacuacaauaugauuaucauggaugaggcucauuuuaccgacccggcauccaucgccgccaggggcuauauuucaacgcgcguggguaugggggaagcugcggcaaucuucaugacugccacacccccaggaucugucgaggcuuuuccucagagcaacgccguaauacaggaugaagagcgagacauucccgaaagaaguuggaauuccggcuacgauuggaucaccgacuucccaggcaagaccgugugguuuguuccuagcauuaaaucugggaacgauaucgcaaauuguuugcggaagaacggaaaaagggugauacaacugucacgcaagacuuucgacacagaguaucagaagaccaaaaacaaugacugggauuacgucgugacaacugacauuuccgagaugggugccaacuuccgugcugauagaguuaucgacccccggaggugccucaagccagugauccugaaagauggcccggaacgcgucauucuugcggggccuaugcccgugacgguagccagugcagcucagcgaagaggacggaucggcaggaaucagaacaaggagggugaccaauacguguauauggggcagccacuaaauaacgaugaagaccacgcccauuggaccgaggcaaaaaugcuguuggauaauauuaacacacccgagggcauaaucccugccuuauuugaaccagagcgcgaaaagagcgcugccauugacggagaguacagacugaggggcgaagcgcggaagacuuucguugagcucaugcgucgcggggaucugcccgucuggcuuucguauaaaguggcaucugagggauuucaguacuccgaccgaagauggugcuucgauggugaaaggaauaaccaggugcuggaggaaaauauggacgucgagaucuggaccaaggaaggcgagcggaaaaagcuccgcccuagaugguuggacgccaggacauauagcgauccgcuggcucuacgggaguuuaaagaauucgccgcugggcgaagaucaguuaguggagaccugauccucgagauuggcaagcuuccacaacaccugaccuuacgcgcacagaacgccuuggauaaucuggugaugcuccacaacucugaacagggugggaaagcuuacaggcaugccauggaggaacugcccgacacuauagagacgcuuaugcugcucgcauugaucgcgguacugaccggcggagugacauuauuuuuccuauccggcaaggggcugggaaagacuagcauuggucuccuuugugucaccgccucaagugcucuguuguggauggccagcguggagccucacuggaucgcagcuuccauuauccuggaauuuuuccucaugguucugcuuauacccgagccagaucggcagcguacaccucaagacaaucagcucgccuauguggucaucggccuguuguuuaugauucugaccguagcagccaacgaaaugggguuacuagagacuacaaaaaaggaucugggaaucggcuacguggcugcggagaaccaucagcacgccacgaugcucgacguugaucuuagacccgcaucugcuuggacccuguacgccguggccacuacagucauuaccccaaugaugaggcacaccaucgaaaauacaacugcaaacauaagcuugacggcuauugccaaucaagcggcuauccugaugggucucgacaaaggguggccuauuuccaagauggauaucggcgugccgcugcuugccuuaggaugcuauucacaggucaacccccugacccucacagcagccguguugaugcugguugcucauuacgcaauaaucggcccagggcuacaggccaaagcgacucgcgaggcucagaagcggaccgccgcaggaauuaugaagaauccuacaguggacggcaucguagccauugaucuggaccccguggucuaugacgcuaaauucgaaaagcaacucggucagaucaugcuucugauauuguguaccucucagauucugcucaugcgaacuacgugggcccugugcgagaguaucacauuagcaaccgggccacuuacuacccugugggaaggaucgccuggcaaauuuuggaacacaacuaucgcuguuagcauggccaauauuuucagagguuccuaccucgcgggcgccgggcuagcauucucucugaugaagucauugggaggcgggaggcgcggaaccggcgcucagggugagacacugggggagaaauggaagcggcaacucaaccagcuuagcaaguccgaauuuaauacguauaaaagaaguggaaucauggagguggaucguucugaagccaaggagggccugaaaaggggugaaaccacuaagcacgcagucagccggggcacagcuaaauugcgcugguucguggagcgaaaccugguaaagcccgaggggaaggugauagaccucggauguggcagagggggauggucauacuauugcgccggcuuaaaaaagguuaccgaagugaaagguuacacuaaggggggaccgggccaugaggaaccaauuccuauggccacauacggcuggaaucuggucaaacuucacuccgggaaggauguguuuuucaugcccccagagaaaugugacacccugcuaugcgauaucggagaaaguagccccaacccuacgauugaggaggguaggacccuccggguccugaagaugguggaaccgugguugaagggcaaucaguuuuguaucaaaauacugaaccccuauaugccaucuguuguagagacacucgaacagaugcaacgcaagcaugggggaaugcuugugagaaauccucuguccaggaacucaacucacgagauguacugggucagcugcggcaccgguaauaucgugucggcgguuaacaugacaucucgaauguuacugaaccgguucacuauggcucaccguaaacccaccuaugagagagacguggauuugggggcaggaacacgccaugucgccguggaaccugagguagcuaaucucgacauuaucggccagaggauugaaaacaucaagaaugagcacaaaaguaccuggcauuacgaugaagacaacccauauaagacuugggccuaccacggcuccuaugaggugaagcccagcgggucagcauccucuaugguuaauggagucgugcggcugcuaacgaaaccuugggaugugauuccaauggucacacagaucgccaugaccgacacuacccccuuuggucaacagagaguuuucaaggagaaaguggacacacgcacgccgagggcuaagcgaggcaccacucagauaauggaaguaacagcgaaauggcuuuggggguuucugagccggaacaagaagccuagaauuuguaccagggaggaauucacucgcaaagugcguaguaaugccgcaaucggagcugucuuuguggaugagaaccaguggaauuccgccaaggaagcaguugaggacgagcgguucugggaucucgugcacagagaaagggagcugcauaaacaaggcaagugcgccacaugcgucuacaacaugauggguaaacgcgaaaagaaguugggggaguuuggaaaagcuaagggcagccgagccaucugguacauguggcugggcgcgcgguuccucgaauucgaggcacuuggguuuaugaaugaggaccacugguucucuagagaaaacucacugaguggaguggagggugaaggcuuacauaaacugggguauauuuugagggauauauccaagaucccaggaggcaauauguacgccgacgauaccgcugguugggacacacgcauuacugaggaugaccuccagaacgaggccaaaaucaccgauauuauggaacccgagcacgcacugcuagcuacgagcaucuuuaagcuuaccuaucagaauaaaguaguuagagugcagcggccugccaagaacgggacagucauggacgugauaucuaggcgugaucaacgaggaucgggccaggugggcacuuacgggcugaacaccuucacaaauauggaaguccagcucauccgccagauggagucagaaggaauuuuucugccaagcgaguuggagacucccaacuuagcugaaagaguucuggacuggcucaagaaacauggugccgagcggcuuaagaggauggcaaucuccggcgacgauugugugguaaaaccgauugacgaucgcuucgcgaccgcccugacggcucuaaaugacauggggaaggugagaaaagauaucccucaaugggaacccaguaagggauggaacgacuggcagcaggucccauuuugcucucaccacuuccaucagcugauaaugaaggauggccgggagauugugguuccuuguaggaaucaagacgaacucgugggucgagcccgugucagccagggggcaggaugguccuugagagagacagcuugccugggcaaaucauaugcccagauguggcaacuuauguacuuucaccgccgggaucugaggcucgcagccaacgcgaucuguagugcugugcccguagacuggguuccaaccucuagaacuacauggagcauccaugcccaccaccaguggaugaccacugaggauauguuauccguguggaaucgcgucuggauugaagagaaccccuggauggaagacaagacccaugugucaagcugggaggaaguuccuuaucugggcaaacgggaggaccaguggugcgggucuuugauaggacugacagcaagggccacgugggcuaccaauauccagguggccauuaaccaaguccgaagacucaucgguaaugagaacuaccuugauuacaugacuuccaugaagcgguucaaaaaugaaagugacccagagggcgcacugugguga

SEQ ID NO: 13511 - RNA, 9879 nt, Artificial Sequence
  derived and/or modified CDS sequence (opt3) from DENV-1__JN819411__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucguuggccagcugaccuggaacgaccuuaucagauugugcauuauggugggggccaaugcauccgauaggaugggaaugggcacaacuuaucuggcuuuaauggccaccuuuaaaaugcgcccuauguucgcagucggucuccuguuucggagacuuacgucuagggaggugcugcuacucacaaucgggcugagcuugguugccucaguggaacugccaaacaguuuagaggaacucggagacggccuggcuaugggcauuaugaugcuuaagcuguugaccgaguuccaaccccaccagcucuggacuacccugcuaucccugacauuugucaaaacuacccuuucucucgauuacgcguggaagacgacagccaugguacugagcauaguguccuuguucccgcuguguuuaucaaccacuagccagaaaacaaccuggcucccuguucugcuugggaguuuuggaugcaagccacugacuauguucuugaucacagaaaacaagauuuggggucgaaaaucuuggccccucaaugagggcaucauggcaauugggaucguguccauacugcuaagcucgcugcuuaagaacgacgucccucucgcuggaccccugaucgccggcgguauguugauugccuguuaugugaucucagggucuagugcugauuuaucccuggagaaagcagccgaaguaagcugggagcaggaagcggagcauucuggagcuagccacaauauucucguggaaguccaagacgauggcaccaugaagaucaaagacgaggagcgcgaugacacgcugacuauacuucugaaggccaccuugcuagcaguuuccggcguguacccaaugucaauuccugccacacuguuugugugguauuucuggcagaaaaagaagcagcggagugggguccucugggauacccccagcccaccggaaguggagagagcuguucuggacgauggaaucuacaggauccuucagcgugguuuacugggccgcucucaaguaggggugggagucuuccaggacggcguguuucauacaauguggcacguuacucggggugcagugcucauguaucaggggaaaagauuggaaccuuccugggccucagucaagaaagaccugauuaguuacggaggcggcuggagguuccaggggagcuggaacaccggagaggaggugcaaguaauagcggucgaacccgguaagaauccaaaaaacgugcagacgacacccggcacuuuuaagaccccugagggggaaguuggagcuaucgcccucgauuucaagccaggcacauccgguucucccauugugaaucgagaggggaaaaucgucggacuguacggcaacggcgugguuaccacuucggggaccuaugugagcgcaauugcccaggcuaaggccucacaagaaggaccucuuccggagaucgaggacgaagucuuuaaaaagcggaaucugacaauaauggauuugcacccagguuccggcaaaacgcgcagauaccuacccgcaaucgugagggaggcuauuaagcggaagcugcgaacucucaucuuagccccuaccagaguaguggcgagugaaauggccgaggcacugaaagggaugccaauucgcuaucagacaaccgcuguuaagucugaacauacuggaagggagaucgucgaccuuaugugccacgccacauucaccaugcgucugcucagccccgugcgggugccuaacuacaauaugauaauuauggaugaggcucauuuuacggacccggcauccaucgccgccagaggcuauaucucaacuagggucgguaugggggaagcugcggcaauuuucaugacagccacccccccaggaucuguagaggcuuuuccucagagcaacgccgugauccaggaugaagagcgcgacauacccgaacgaaguuggaauuccggcuacgauuggauuaccgacuucccaggcaaaacuguuugguuugugccuagcaucaagucugggaacgauauugcaaauuguuugagaaaaaacggaaagcgggucauccaacugucaaggaagacauucgacaccgaguaucagaaaacaaagaacaaugacugggauuacgugguuacuacggacauauccgagaugggugccaacuuccgcgcugaucgugugauugaccccagacggugccucaaaccagucauccugaaggauggcccggaaagggugauccuugcggggccuaugcccguaaccguggccagugcagcucagcgccgaggaagaauuggccggaaucagaacaaagagggugaccaauacguuuauauggggcagccacuaaauaacgaugaagaccacgcccauuggacagaggcaaagaugcuguuggauaauaucaacacucccgagggcauuauaccugccuuauuugaaccagagagggaaaagagcgcugccaucgacggagaguaccgccugagaggcgaagcgaggaaaaccuucgucgagcucaugcggcguggggaucugcccguguggcuuucguauaagguggcaucugagggauuucaguacuccgaccgccgauggugcuucgauggugaaagaaauaaccagguccuggaggaaaauauggacguugagauuuggacaaaagaaggcgagaggaagaaacuccggccucgcugguuggacgccagaaccuauagcgauccgcuggcucuaagggaguuuaaggaauucgccgcugggcggcgaucagugaguggagaccugauccucgagaucggcaaacuuccacaacaccugacuuuaagagcacagaacgccuuggauaaucugguaaugcuccacaacucugaacagggugggaaggcuuaccgccaugccauggaggaacugcccgacacgauugagacccuuaugcugcucgcauugauagcggugcugacaggcggagucacuuuauuuuuccuauccggcaaggggcugggaaaaaccagcaucggucuccuuugugugacagccucaagugcucuguuguggauggccagcguugagccucacuggauugcagcuuccaucauucuggaauuuuuccucauggugcugcuuauccccgagccagauaggcagcggaccccucaagacaaucagcucgccuaugucguaauaggccuguuguuuaugauccugacuguggcagccaacgaaaugggguuacuagagacaacgaagaaagaucugggaauuggcuacguugcugcggagaaccaucagcacgccaccaugcucgacguggaucuucgucccgcaucugcuuggacucuguacgccgucgccacaaccgugaucaccccaaugaugagacacacaauugaaaauacuacggcaaacaucagcuugaccgcuauagccaaucaagcggcuauucugaugggucucgacaagggguggccuaucuccaaaauggauauuggcgucccgcugcuugccuuaggaugcuauucacaggugaacccccugacacucacugcagccguuuugaugcugguggcucauuacgcaaucauaggcccagggcuacaggccaaggcgaccagggaggcucagaagcgcacagccgcaggaaucaugaaaaauccuaccguagacggcauuguggccaucgaucuggaccccgucguuuaugacgcuaaguucgaaaaacaacucggucagauuaugcuucugaucuuguguacuucucagauacugcucaugcggacgacaugggcccugugcgagaguauuaccuuagcaacugggccacuuaccacacugugggaaggaucgccuggcaaguuuuggaacacuaccaucgcugugagcauggccaauaucuuccgagguuccuaccucgcgggcgccgggcuagcauucucucugaugaaaucauugggaggcgggagaaggggaacaggcgcucagggugagacgcugggggagaaguggaagcgccaacucaaccagcuuagcaaauccgaauuuaauaccuauaagcggaguggaauuauggaggucgauagaucugaagccaaagagggccugaagcguggugaaacuacaaaacacgcagugagcaggggcaccgcuaaguugcggugguucguagagcgcaaccuggugaagcccgaggggaaaguuaucgaccucggauguggccgagggggauggucauacuauugcgccggcuuaaagaaagugacugaagucaaggguuacacaaaagggggaccgggccaugaggaaccagugccuauggccaccuacggcuggaaucuggucaagcuucacuccgggaaagauguguuuuucaugcccccagagaagugugacacgcugcuaugcgauauaggagaaaguagccccaacccuaccauugaggaggguagaacacucaggguucugaagaugguagaaccgugguugaaaggcaaucaguuuuguaucaagauucugaaccccuauaugccaucuguggucgagacucucgaacagaugcaacggaaacaugggggaaugcuugugcgcaauccucuguccagaaacucaacccacgagauguacuggguuagcugcggcacagguaauaucgugucggcggucaacaugacuucuaggauguuacugaaccgauucaccauggcucaccggaagcccacauaugagcgugacguggauuugggggcaggaaccagacauguagccguggaaccugagguugcuaaucucgacauaaucggccagcgcauugaaaacaucaaaaaugagcacaagcugacuuggcauuacgaugaagacaacccauauaagacgugggccuaccacggcaguuaugaggucaaacccuccgggagcgcaucauccauggugaauggaguggucaggcuacuuacaaagccuugggauguuauuccaauggugacccagaucgccaugacugacaccacacccuuuggucaacagcggguauucaaagagaagguggacacgagaaccccgcgcgcuaaaaggggcacuacacagauuauggaagucaccgcgaaguggcuguggggguuucucucucgaaacaagaaaccucggaucuguacuagagaggaauucacaaggaaggugcgcagcaaugccgcaauaggagcuguuuuuguggaugagaaccaguggaauagugccaaagaagcagucgaggacgagcguuucugggaucuggugcaccgggaaagagaguugcauaagcaaggcaaaugcgccaccugcguauacaacaugauggguaagagggaaaagaaacugggggaguuuggaaaggcuaaaggcucccgcgccauuugguacauguggcucggcgcgcgauuccuugaauucgaggcacugggguuuaugaaugaggaccacugguucagccgggaaaacucuuuaucaggaguugagggugaaggccugcauaaguugggguauauccucagagauaucaguaaaauuccaggaggcaauauguacgccgacgauacagcugguugggacacuaggauaaccgaggaugaccugcagaacgaggccaagaucacggauauuauggaacccgagcacgcacuacuugcuaccuccaucuuuaaacugacauaucagaauaaggugguccgcgugcagagaccugccaagaacgggacugugauggacgucauuagccggagggaucaacguggaucuggccagguuggcaccuacgggcucaacacauucacuaauauggaagugcagcugauccgacagauggagucggaaggaauauuuucaccaagcgaguuggagacccccaacuuagcugaacgcguacuggacuggcucgagaaacauggugccgaaagacuuaagcggauggcaaucuccggcgacgauuguguggucaaaccgauugacgauagguucgcgacggcccugacagcucuaaaugacauggggaaggugcgcaaagauaucccucaaugggagcccaguaagggauggaacgacuggcagcagguuccauuuugcucucaccacuuccaucagcugauuaugaaggauggcagagaaaucguggucccuugucggaaucaagacgagcucguggguagggcccgaguaagccagggggcaggaugguccuugcgugagaccgcuugccugggcaaaucauaugcccagauguggcaacuuauguacuuucacagacgcgaucugcggcucgcagccaacgcgauauguagugcuguucccguggacugggucccaacuucuaggacaaccuggagcauucaugcccaccaccaguggaugacuaccgaagauauguuauccguguggaauagaguuuggaucgaggaaaaccccuggauggaggacaagacacaugugucaagcugggaagaggucccuuaucugggcaaacgcgaggaccaguggugcgggucuuugaucggacugacggcacgggccaccugggcuacuaauauucagguggccauaaaccaaguaaggcgacucaucgguaaugaaaacuaccuugauuacaugacauccaugaagagauucaaaaaugagagugacccagaaggcgcacugugguga

SEQ ID NO: 13512 - RNA, 9879 nt, Artificial Sequence
  derived and/or modified CDS sequence (opt3) from DENV-1__FJ639812__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugaugcugcucacaaugaaggagaaaagcuggcugguccauaagcagugguuucuugaccugccguugcccuggacgucuggcgcauccaccucacaagagacuuggaaucggcaggaucuccuggugacauucaaaaccgcucacgccaagaagcaggaaguaguuguguuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugucauguguacaggauccuucaaauuggagaaggaaguggcugagacucagcacgguaccguccuggugcagguuaaguacgagggcacggaugcgccuugcaaaauaccauucagcacacaagacgaaaagggggugacccagaacggacgccucaucacugcaaaucccauuguaacagauaaagagaagccugucaacaucgaaaccgagccacccuuuggcgagucguauauagugguuggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcguguuuacaagcgucgggaaauuggugcaucagguauucggaacggcauacggcgugcucuuuuccgguguuucuuggaccaugaagauugggaucggcauucuguuaacuuggcugggacuaaauagccgaucaacaagucucuccaugaccuguauagcggucggcauggugacacuguaccuuggggugaugguccaggcugacagcggaugcguuaucaacuggaaaggccgcgaauugaagugugguucugggauuuucgugacuaacgaggugcacaccuggacggaacaauauaaguuucaggccgauucaccgaaaagacugagugcagccaucggaaaggcuugggaggagggcguaugcgguaucaggagcgccacacggcucgaaaauauuauguggaaacagauauccaacgagcugaaucauaucuuacuggaaaacgacaugaaguucaccgucgugguuggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggagguggaggauuaugguuucgggauuuuuacuaccaacaucugguugaagcucagggacagcuacacacagaugugcgaucaccgucugauguccgcugcaauaaaagacucaaaggccguccaugcugauaugggauauuggauugaaagugagaaaaaugaaacguggaagcuagcccgggcaucuuucaucgaggugaagaccuguacuuggccaaaaagccacacacugugguccaacggcguucucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccgugguagucgacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgugaaagaaaaggaggaaaaucuuguccgcaguaugguuagcgccgguucuggcgagguggacuccuuuucacuggggaucuuguguguaaguauaaugauugaagaggugaugcgaagccgguggucgcguaagaugcucaugacuggaacacuggcugucuuccuacugcucaucaugggccagcugaccuggaacgaccuuaucagauugugcauuauggugggggccaaugcauccgauaggaugggaaugggcacaacuuaucuggcuuuaauggccaccuuuaaaaugcgcccuauguucgcaguuggucuccuguuucggagacuuacgucuagggaggugcugcuacucacaaucgggcugagcuuggucgccucaguggaacugccaaacaguuuagaggaacucggagacggccuggcuaugggcauuaugaugcuuaagcuguugaccgaguuccaaccccaccagcucuggacuacccugcuaucccugacauuuguuaaaacuacccuuucucucgauuacgcguggaagacgacagccauggugcugagcauagucuccuuguucccgcuguguuuaucaaccacuagccagaaaacaaccuggcucccuguacugcuugggaguuuuggaugcaagccacugacuauguucuugaucacagaaaacaagauuuggggucgaaaaucuuggccccucaaugagggcaucauggcaauugggaucguguccauacugcuaagcucgcugcuuaagaacgacguuccucucgcuggaccccugaucgccggcgguauguugauugccuguuaugugaucucagggucuagugcugauuuacugcucgagaaagcagccgaagucuccugggagcaggaagcggagcauagcggagcuucucacaauauucugguggaaguacaagacgauggcaccaugaagaucaaagacgaggagcgcgaugacacgcuuacuauacuguugaaggccacccuacuggcagugagcggcgucuacccaauguccauuccugccacacucuuuguuugguauuucuggcagaaaaagaagcagcggucaggggugcugugggauacccccaguccaccggaaguggagagagcuguccuugacgauggaaucuacaggaucuuacagcguggucugcucggccgcagccaaguggggguuggaguauuccaggacggcguguuucauacaauguggcacgucacucggggugcaguguugauguaucaggggaaaagacuggaaccuucuugggccuccguuaagaaagaccucauuucauacggaggcggcuggagguuccaggggaguuggaacaccggagaggaggugcaagucauagcgguggaacccgguaagaauccaaaaaacguacagacgacacccggcacuuuuaagaccccugagggggaagucggagcuaucgcccuggauuucaagccaggcacaagcgguucccccauugugaaucgagaggggaaaaucguuggacuuuacggcaacggcguggucaccacuucugggaccuaugugucggcaauugcccaggcuaaggccagccaagaaggaccucugccggagaucgaggacgaaguuuuuaaaaagcggaauuugacaauaauggaucuacacccagguucaggcaaaacgcgcagauaccugcccgcaaucgugagggaggcuauuaagcggaagcuccgaacuuuaauccuggccccuaccagagucguggcguccgaaauggccgaggcacuuaaagggaugccaauucgcuaucagacaaccgcuguaaagagugaacauacuggaagggagaucguggaccugaugugccacgccacauucaccaugcgucucuugucucccguucgggucccuaacuacaauaugauaauuauggaugaggcucauuuuacggacccggcaagcaucgccgccagaggcuauaucuccacuaggguggguaugggggaagcugcggcaauuuucaugacagccacccccccaggaucaguggaggcuuuuccucagucuaacgccgucauccaggaugaagagcgcgacauacccgaacgaagcuggaauaguggcuacgauuggauuaccgacuucccaggcaaaacuguaugguuugugccuuccaucaagagcgggaacgauauugcaaauugucugagaaaaaacggaaagcggguuauccaacucucuaggaagacauucgacaccgaguaucagaaaacaaagaacaaugacugggauuacguggucacuacggacauaucagagaugggugccaacuuccgcgcugaucgugugauugaccccagacggugccugaaaccaguuauccuuaaggauggcccggaaagggugauccuagcggggccuaugcccgucaccguggccuccgcagcucagcgccgaggaagaauuggccggaaucagaacaaagagggugaccaauacguauauauggggcagccacugaauaacgaugaagaccacgcccauuggacagaggcaaagauguuguuagauaauaucaacacucccgagggcauuauaccugcccuguuugaaccagagagggaaaagagugcugccaucgacggagaguaccgccucagaggcgaagcgaggaaaaccuucguggagcugaugcggcguggggaucuucccguuuggcugagcuauaaggucgcaucggagggauuucaguacucugaccgccgauggugcuucgauggugaaagaaauaaccaggugcucgaggaaaauauggacguggagauuuggacaaaagaaggcgagaggaagaaauugcggccucgcuggcuggacgccagaaccuauuccgauccgcuagcucugagggaguuuaaggaauucgccgcugggcggcgaagcgucucaggagaccucauccuugagaucggcaaacugccacaacacuuaacuuugagagcacagaacgcccuggauaaucucguuaugcugcacaacagugaacagggugggaaggcuuaccgccaugccauggaggaacuucccgacacgauugagacccugaugcucuuggcacugauagcgguguuaacaggcggaguaacucuauuuuuccugucuggcaaggggcucggaaaaaccuccaucggucuucugugugugacagccagcucagcuuugcuguggauggccagugucgagccucacuggauugcagcuagcaucauucucgaauuuuuccugauggugcuucucauccccgagccagauaggcagcggaccccucaagacaaucagcuggccuauguugugauaggcuugcuguuuaugaucuuaacugucgcagccaacgaaauggggcuacuggagacaacgaagaaagaucucggaauuggcuacguagcugcggagaaccaucagcacgccaccaugcuugacguggaucugcgucccgcauccgcuuggacuuuguacgccguugccacaaccgugaucaccccaaugaugagacacacaauugaaaauacuacggcaaacaucucucugaccgcuauagccaaucaagcggcuauucucaugggucuggacaagggguggccuaucagcaaaauggauauuggcgucccgcuuuuagcccugggaugcuauucccaggugaacccccucacauugacugcagccguccugaugcuaguggcucauuacgcaaucauaggcccagggcugcaggccaaggcgaccagggaggcucagaagcgcacagccgcaggaaucaugaaaaauccuaccguugacggcauuguggccaucgaucucgaccccguaguguaugacgcuaaguucgaaaaacaacuuggucagauuaugcuguugauccuguguacuucacagauacuccugaugcggacgacaugggccuuaugcgagucuauuacccuugcaacugggccacugaccacacucugggaaggaaguccuggcaaguuuuggaacacuaccaucgcugucucgauggccaauaucuuccgagguagcuaccuagcgggcgccgggcuggcauucuccuugaugaaaucucugggaggcgggagaaggggaacaggcgcucagggugagacgcucggggagaaguggaagcgccaacuuaaccagcugucaaaaagcgaauuuaauaccuauaagcgguccggaauuauggagguugauagaagugaagccaaagagggcuugaagcguggugaaacuacaaaacacgcagugucuaggggcaccgcuaagcugcggugguucgucgagcgcaaccucgugaagcccgaggggaaaguaaucgacuuaggauguggccgagggggauggagcuacuauugcgccggccugaagaaagugacugaaguuaaggguuacacaaaagggggaccgggccaugaggaaccaauaccuauggccaccuacggcuggaaucuugugaagcugcacucagggaaagaugucuuuuucaugcccccagagaagugugacacgcuacucugcgauauuggagaauccagucccaacccuaccaucgaggaggguagaacacugaggguguugaagauggucgaaccguggcugaaaggcaaucaguuuuguauuaagauccucaaccccuauaugccaagcgugguugagacucuugaacagaugcaacggaaacaugggggaaugcugguacgcaauccuuuaucuagaaacuccacccacgagauguacugggugucaugcggcacagguaauauagucagcgcggugaacaugacuucgaggaugcuguugaaccgauucaccauggcucaccggaagcccacauaugagcgugacguugaucucggggcaggaaccagacauguggccgucgaaccugagguggcuaaucuggacaucauuggccagcgcaucgaaaacauuaaaaaugagcacaagucuacuuggcauuacgaugaagacaacccauauaagacgugggccuaccacggcaguuaugagguaaaacccuccgggagcgcaucauccauggugaauggaguugucaggcuacuuacaaagccuugggaugugaucccaauggugacccagauugccaugacugacaccacacccuuuggucaacagcgggucuucaaagagaagguugacacgagaaccccgcgcgcuaaaaggggcacuacacagaucauggaagugaccgcgaaguggcuguggggguuucucucucgaaacaagaaaccucggauauguacuagagaggaauucacaaggaagguacgcagcaaugccgcaauuggagcuguguuugucgaugagaaccaguggaauagugccaaagaagcaguggaggacgagcguuucugggaucugguucaccgggaaagagaguugcauaagcaaggcaaaugcgccaccugcguguacaacaugauggguaagagggaaaagaaacugggggaguuuggaaaggcuaaaggcucccgcgccaucugguacauguggcucggcgcgcgauuccuugaauucgaggcacugggguuuaugaaugaggaccacugguucagccgggaaaacucuuuaucaggagucgagggugaaggccugcauaaguugggguauauccucagagauauuaguaaaauaccaggaggcaauauguacgccgacgauacagcugguugggacacuaggaucaccgaggaugaccugcagaacgaggccaagauuacggauaucauggaacccgagcacgcacuacuugcuaccuccauuuuuaaacugacauaucagaauaaggugguacgcguucagagaccugccaagaacgggacugugauggacgucaucagccggagggaucaacguggaucuggccaggugggcaccuacgggcucaacacauucacuaauauggaagugcagcugauacgacagauggagucggaaggaaucuuuuugccaucagaguuagagacccccaaccuggcugaacgcguccucgacuggcuugagaaacauggugccgaaagacugaagcggauggcaauuagcggcgacgauuguguugugaaaccgaucgacgauagguucgcgacggcccuaacagcucugaaugacauggggaagguacgcaaagauauuccucaaugggagcccuccaagggauggaacgacuggcagcaggugccauuuugcagucaccacuuccaucagcucaucaugaaggauggcagagaaauagucgugccuugucggaaucaagacgaguugguugguagggcccgagugucucagggggcaggauggagccugcgugagaccgcuugccuuggcaaauccuaugcccagauguggcaacugauguacuuucacagacgcgaucuccgguuagcagccaacgcgauuuguucagcuguccccguggacuggguaccaacuaguaggacaaccuggucuauccaugcccaccaccaguggaugacuaccgaagauaugcugagcguuuggaauagaguguggaucgaggaaaaccccuggauggaggacaagacacaugucuccucaugggaagaggugccuuauuugggcaaacgcgaggaccaguggugcgggagccugauuggacucacggcacgggccaccugggcuacuaauauacagguugccaucaaccaagugaggcgacuuauugguaaugaaaacuaccuggauuacaugacaucuaugaagagauucaaaaaugaguccgacccagaaggcgcacuaugguga

SEQ ID NO: 13513 - RNA, 9879 nt, Artificial Sequence
  derived and/or modified CDS sequence (opt3) from DENV-1__FJ639813__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaugaacccugccgugcuuaggaaacugugcauugaagcuaagaucuccaauaccacgaccgacucucgguguccaacacaaggagaggccacuuuggucgaagagcaggaugcaaacuucguuugccgccgaaccuuuguggacagaggcugggguaauggguguggacucuucggcaaaggcagccuguuaacaugcgcuaaguuuaagugcguaacuaaacuggaggggaagauagugcaguacgaaaaccucaaauauuccgucauugugaccguucacacaggagaucagcaucaaguggguaaugagaccacugaacacggcacgaucgccacaauuaccccccaggcgccuacuucagagauccagcuuaccgacuacggggcccugacauuggacuguaguccaaggaccggacuagauuucaacgaaaugguccugcucacuaugaaggagaaaagcuggcuggugcauaagcagugguuucuugaccugccguugcccuggacaucuggcgcauccacgucacaagagaccuggaaucggcaggaucuccugguaacuuucaaaacagcucacgccaagaagcaggaaguuguggucuuagguagccaagagggggcuaugcacaccgcccugacaggcgcaacugaaauccagaccaguggaacgaccacaauuuuugccggccaucuaaaaugccgucucaagauggacaaacugacucuuaaggggaugucuuaugugauguguaccggauccuucaaauuggagaaggaagucgcugagacacagcacgguacugugcugguucaggugaaguacgagggcaccgaugcgccuugcaaaauaccauucagcacgcaagacgaaaaggggguaacacagaacggacgccucaucaccgcaaaucccauugucacugauaaagagaagccugugaacaucgaaacagagccacccuuuggcgagucguauauaguugugggugccggggaaaaagcucugaagcuuucuugguucaagaaaggcuccucaauuggaaagauguuugaggccaccgcaagaggcgccaggcggauggcuauccugggggacacugccugggauuucggaaguaucgguggcgucuuuaccagcguggggaaauugguacaucagguguucggaacagcauacggcguucucuuuuccggugucucuuggacgaugaagauugggaucggcauucuguuaaccuggcugggacuaaauagccgaucaacuaguuucuccaugacauguauagcggugggcauggugacccucuaccugggggucaugguucaggcugacagcggaugcgugaucaacuggaaaggccgcgaacuuaagugugguucugggauuuuugugacaaacgagguacacacuuggaccgaacaauauaaguuccaggccgauucaccgaaaagauugagugcagccaucggaaaggcuugggaggagggcgucugcgguaucaggagcgccacgcggcuggaaaauauuauguggaaacagauauccaacgagcucaaucauauccuguuagaaaacgacaugaaguuuacagugguugugggcgacgcaaaugggauucuggcucagggaaaaaagaugauccgcccucaacccauggagcacaaauacucuuggaagucguggggcaaggccaaaauuaucggggcggauauacagaacaccacuuucaucauugacggaccagauaccccugaaugucccgacggccagagagccuggaauaucugggaggucgaggauuaugguuuugggauuuucacaacuaacaucuggcuuaaguugagggacagcuacacccagaugugcgaucaccgucucauguccgcugcaauaaaagacucaaaggccgugcaugcugauaugggauauuggauugaaagugagaaaaaugaaacauggaagcuggcccgggcaucuuucaucgagguuaagacguguaccuggccaaaaagccacacucuaugguccaacggcgugcuggaaucagagaugauuauccccaagauauacgguggcccuaucagccaacauaauuaucgaccaggguacuuuacacagaccgcgggaccguggcaccucggcaaacuggagcuugacuucgauuugugcgaagggacuacaguagucguggacgagcacugcggaaacagaggccccucucugaggaccacgacugugaccgguaagauuauccaugaaugguguugccgcuccuguacauuaccuccacuccgguuuagaggggaggauggaugcugguacggcauggagauuaggcccgucaaagaaaaggaggaaaaucugguucgcaguauggugagcgccgguucuggcgagguagacuccuucucacuugggauccugugugugaguauaaugauugaagaggucaugcgaagccgguggucgcguaagauguugaugaccggaacucucgcuguguuucugcuacugaucaugggccagcucacauggaacgaccugaucagacuuugcauuaugguuggggccaaugcauccgauaggaugggaaugggcaccacauauuuggcucugauggccacuuucaaaaugcgcccuauguuugcaguggguuuacucuuccggagacugaccucuagggagguccuucugcuaacgaucgggcucagccugguggccucaguugaauugccaaacagucuggaggaauuaggagacggccucgcuaugggcauuaugaugcugaagcuucugacagaguuucaaccccaccaguuguggaccacucuccugucccuaaccuucgugaaaacaacucugucucuugauuacgcguggaagaccacggccaugguccucagcauaguaucccuguuuccguugugucugucaacaaccagccagaaaacuacaugguuaccugugcuccuggggaguuucggaugcaagccacuuaccauguuucugaucacugaaaacaagauuuggggucgaaaaucuuggcccuugaaugagggcaucauggcaauugggaucguuuccauacuccugagcucgcuacugaagaacgacgugccucuugcuggaccccucaucgccggcgguaugcugauugccuguuaugucaucucagggucuagugcugauuuguccuuagagaaagcagccgaagugagcugggagcaggaagcggagcauucuggagcuagccacaauauucugguagaagugcaagacgauggcacaaugaagaucaaagacgaggagcgcgaugacacccucacgauacugcuuaaggccacucuguuggcagucuccggcguuuacccaaugucaauuccugccacccuauucgugugguauuucuggcagaaaaagaagcagcggaguggggugcugugggauacacccagcccaccggaagucgagagagcugugcucgacgauggaaucuacaggauccugcagcguggucuuuuaggccgcucucaaguugggguaggaguguuucaggacggcgucuuccauaccauguggcacgugacacggggugcaguucugauguaucaggggaaaagacucgaaccuuccugggccucagugaagaaagacuugauuaguuacggaggcggcuggagguuucaggggagcuggaacacuggagaggagguccaagugauagcgguagaacccgguaagaauccaaaaaacguccagaccacgcccggcacauucaagacuccugagggggaagugggagcuaucgcccuggauuuuaagccaggcaccuccgguucucccauuguuaaucgagaggggaaaaucgugggacucuacggcaacggcgucgugacaaccucggggacuuauguuagcgcaauugcccaggcuaaggccucacaagaaggaccucugccggagaucgaggacgaaguguucaaaaagcggaaucuuaccauaauggaucugcacccagguuccggcaaaacacgcagauacuugcccgcaaucgucagggaggcuauuaagcggaagcuacgaacgcugauccucgccccuacuagagugguagcgagugaaauggccgaggcauuaaaagggaugccaauucgcuaucagaccacagcugugaagucugaacauaccggaagggagaucguugaccugaugugccacgccacuuuuacaaugcgucuucugagccccguccgggugccuaacuacaauaugauaauuauggaugaggcucauuucaccgacccggcauccaucgccgccagaggcuauaucucaacgaggguggguaugggggaagcugcggcaauuuuuaugacugccacacccccaggaucugucgaggcuuucccucagagcaacgccguaauccaggaugaagagcgcgacauacccgaacgaaguuggaauuccggcuacgauuggauuaccgacuuuccaggcaaaaccgugugguucguuccuagcaucaagucugggaacgauauugcaaauugucucagaaaaaacggaaagcgggugauccaauugucaaggaagacuuucgacacagaguaucagaaaaccaagaacaaugacugggauuacgucgugacaacugacauauccgagaugggugccaacuuucgcgcugaucguguuauugaccccagacggugccugaaaccagugauccucaaggauggcccggaaagggucauccuggcggggccuaugcccgugacgguagccagugcagcucagcgccgaggaagaauuggccggaaucagaacaaagagggugaccaauacguguauauggggcagccacuuaauaacgaugaagaccacgcccauuggaccgaggcaaagaugcuacuggauaauaucaacacacccgagggcauuauaccugccuuguucgaaccagagagggaaaagagcgcugccaucgacggagaguaccgcuuaagaggcgaagcgaggaaaacuuuuguugagcugaugcggcguggggaucuccccgucuggcugucguauaagguggcaucugagggauuccaguacuccgaccgccgauggugcuuugauggugaaagaaauaaccaggugcuugaggaaaauauggacgucgagauuuggaccaaagaaggcgagaggaagaaacugcggccucgcuggcucgacgccagaacauauagcgauccguuggcucugagggaguucaaggaauuugccgcugggcggcgaucaguuaguggagaccuaauccuggagaucggcaaacucccacaacaccuuacccugagagcacagaacgccuuagauaauuuggugaugcugcacaacucugaacagggugggaaggcuuaccgccaugccauggaggaacuccccgacacuauugagacgcugaugcuucuggcacucauagcgguauugaccggcggagugacacuguucuuuuuauccggcaaggggcuaggaaaaacuagcaucggucugcucugugucaccgccucaagugcucuucuguggauggccagcguggagccucacuggauugcagcuuccaucauuuuggaauucuuucugaugguucuccugauccccgagccagauaggcagcggacaccucaagacaaucagcuugccuauguggucauaggccuccuguucaugaucuugaccguagcagccaacgaaauggggcuguuagagacuacaaagaaagaucuaggaauuggcuacguggcugcggagaaccaucagcacgccacgaugcuggacguugaucuccgucccgcaucugcuuggacccuuuacgccguggccacuacagucaucaccccaaugaugagacacaccauugaaaauacaacugcaaacaucagccugacggcuauagccaaucaagcggcuauuuugaugggucuggacaagggguggccuaucuccaaaauggauauuggcgugccgcuccuggcccuuggaugcuauucacaggucaaccccuuaacccugacagcagccgugcucauguugguugcucauuacgcaaucauaggcccagggcugcaggccaaggcgacuagggaggcucagaagcgcaccgccgcaggaaucaugaaaaauccuacaguggacggcauuguagccaucgaucuagaccccguggucuaugacgcuaaguuugaaaaacaacugggucagauuaugcuccuuauccuguguaccucucagauauugcugaugcggacuacgugggcccucugcgagaguauuacacuggcaaccgggccauuaacuacccuuugggaaggaucgccuggcaaguucuggaacacaacuaucgcuguuagcauggccaauaucuuccgagguuccuaccuggcgggcgccgggcucgcauuuucucuaaugaaaucacugggaggcgggagaaggggaaccggcgcucagggugagacauugggggagaaguggaagcgccaacugaaccagcucagcaaauccgaauucaauacguauaagcggaguggaauuauggagguggauagaucugaagccaaagagggccuuaagcguggugaaaccacuaaacacgcagucagcaggggcacagcuaagcugcggugguuuguggagcgcaacuugguaaagcccgaggggaaagugaucgaccugggauguggccgagggggauggucauacuauugcgccggccucaagaaaguuaccgaagugaaggguuacacuaaagggggaccgggccaugaggaaccaaugccuauggccacauacggcuggaauuuagucaagcugcacuccgggaaagauguguucuuuaugcccccagagaagugugacacccuucugugcgauauaggagaaaguagccccaacccuacgauugaggaggguagaacccuaaggguccucaagaugguggaaccguggcugaaaggcaaucaguucuguaucaagauuuugaaccccuauaugccaucuguuguagagacacuggaacagaugcaacggaaacaugggggaaugcucgugcgcaauccucuuuccagaaacucaacucacgagauguacugggucagcugcggcaccgguaauaucgugucggcgguuaacaugacaucuaggaugcuguuaaaccgauuuacuauggcucaccggaagcccaccuaugagcgugacguggaucugggggcaggaacaagacaugucgccguggaaccugagguagcuaauuuggacauaaucggccagcgcauugaaaacaucaaaaaugagcacaagaguaccuggcauuacgaugaagacaacccauauaagacuugggccuaccacggcuccuaugaggugaaacccagcgggucagcauccucuaugguuaauggagucgugaggcuccugacgaagccuugggaugugauuccaauggucacacagaucgccaugaccgacacuacccccuucggucaacagcggguuuuuaaagagaagguggacacaagaacgccgcgcgcuaaaaggggcaccacucagauuauggaaguaacagcgaaguggcuauggggguuccuuagccgaaacaagaaaccucggaucuguaccagagaggaauuuacuaggaaggugcgcaguaauuccgccauaggagcagucuucguggaugagaaccaguggaauagcgcuaaagaagccguugaggacgagcguuuuugggaucuggugcaccgggaaagagagcuccauaagcaaggcaaaugcgcaacaugcgucuacaacaugauggguaagagggaaaagaaacugggggaguucggaaaggccaaaggcucucgcgcuauuugguacaugugguugggcgcccgauuccuggaauuugaggcgcucggguucaugaaugaggaccacugguuuucacgggaaaacagucuuuccggaguggagggugaaggccugcauaaguuaggguauauccugagagauaucagcaaaauuccaggaggcaauauguacgcagacgauaccgccgguugggacacaaggauaacugaggaugacuugcagaacgaggcuaagaucaccgauauuauggaacccgagcacgcccuccuggcaacgucuaucuucaaacuaaccuaucagaauaagguaguucgcgugcagagaccugcuaagaacgggacagucauggacgugauuucgcggagggaucaacguggaucaggccaggugggcacuuacgggcuuaacaccuuuacaaauauggaaguccagcugauccgacagauggagagcgaaggaauauucuccccaagugagcucgagacucccaaccuggccgaacgcguuuuggacugguuagagaaacauggugcugaaagacugaagcggauggccaucucuggcgacgauugugugguaaaaccgauugacgauagguuugcaaccgcgcucacggcccuuaaugacauggggaaggugcgcaaagauaucccucaaugggagcccagcaagggauggaacgacuggcagcaggucccauucugcucccaccacuuucaucagcugauuaugaaggauggcagagaaaucgugguuccuugucggaaucaagacgagcuaguggguagggcucgagucucacagggggccggauggagucugcgugagacagcaugccucggcaaaucuuaugcucagauguggcaauugauguacuuccacagacgcgaucugcggcuugccgcaaacgccauauguagcgcggugcccguagacuggguuccaaccuccaggacuacauggucaauucaugcucaccaccaguggaugaccacugaagauaugcugagcguguggaauagagucuggaucgaggaaaaccccuggauggaggacaagacccaugugucuuccugggaagagguuccuuaucucggcaaacgcgaggaccaguggugcgggaguuuaaucggacugacagcccgggcaacgugggccaccaauauucagguggcuauaaaccaagucaggcgauugaucgguaaugaaaacuaccuggauuacaugacuagcaugaagagauuuaaaaaugagucggacccagaaggcgcccucugguga

SEQ ID NO: 13514 - RNA, 9879 nt, Artificial Sequence
  derived and/or modified CDS sequence (opt3) from DENV-1__JN819412__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacuuaucuggcuuuaauggccaccuuuaaaaugcgcccuauguucgcagugggucuccuguuucggagacuuacgucuagggagguccugcuacucacaaucgggcugagcuugguggccucaguugaacugccaaacaguuuagaggaacucggagacggccuggcuaugggcauuaugaugcuuaagcuguugaccgaguuccaaccccaccagcucuggacuacccugcuaucccugacauuugugaaaacuacccuuucucucgauuacgcguggaagacgacagccaugguccugagcauaguauccuuguucccgcuguguuuaucaaccacuagccagaaaacaaccuggcucccugugcugcuugggaguuuuggaugcaagccacugacuauguucuugaucacagaaaacaagauuuggggucgaaaaucuuggccccucaaugagggcaucauggcaauugggaucguuuccauacugcuaagcucgcugcuuaagaacgacgugccucucgcuggaccccugaucgccggcgguauguugauugccuguuaugucaucucagggucuagugcugauuuacugcucgagaaagcagccgaaguguccugggagcaggaagcggagcauagcggagcuucucacaauauucugguagaagugcaagacgauggcaccaugaagaucaaagacgaggagcgcgaugacacgcuuacuauacuguugaaggccacccuacuggcagucagcggcguuuacccaauguccauuccugccacacucuuugugugguauuucuggcagaaaaagaagcagcggucaggggugcugugggauacccccaguccaccggaagucgagagagcugugcuugacgauggaaucuacaggaucuuacagcguggucugcucggccgcagccaaguugggguaggaguguuccaggacggcgucuuucauacaauguggcacgugacucggggugcaguuuugauguaucaggggaaaagacuggaaccuucuugggccuccgugaagaaagaccucauuucauacggaggcggcuggagguuccaggggaguuggaacaccggagaggagguccaagugauagcgguagaacccgguaagaauccaaaaaacguccagacgacacccggcacuuuuaagaccccugagggggaagugggagcuaucgcccuggauuucaagccaggcacaagcgguucccccauuguuaaucgagaggggaaaaucgugggacuuuacggcaacggcgucgugaccacuucugggaccuauguuucggcaauugcccaggcuaaggccagccaagaaggaccucugccggagaucgaggacgaaguguuuaaaaagcggaauuugacaauaauggaucuacacccagguucaggcaaaacgcgcagauaccugcccgcaaucgucagggaggcuauuaagcggaagcuccgaacuuuaauccuggccccuaccagagugguagcguccgaaauggccgaggcacuuaaagggaugccaauucgcuaucagacaaccgcugugaagagugaacauacuggaagggagaucguugaccugaugugccacgccacauucaccaugcgucucuugucucccguccgggugccuaacuacaauaugauaauuauggaugaggcucauuuuacggacccggcaagcaucgccgccagaggcuauaucuccacuaggguggguaugggggaagcugcggcaauuuucaugacagccacccccccaggaucagucgaggcuuuuccucagucuaacgccguaauccaggaugaagagcgcgacauacccgaacgaagcuggaauaguggcuacgauuggauuaccgacuucccaggcaaaacugugugguuuguuccuuccaucaagagcgggaacgauauugcaaauugucugagaaaaaacggaaagcgggugauccaacucucuaggaagacauucgacaccgaguaucagaaaacaaagaacaaugacugggauuacgucgugacuacggacauaucagagaugggugccaacuuccgcgcugaucguguuauugaccccagacggugccugaaaccagugauccuuaaggauggcccggaaagggucauccuagcggggccuaugcccgugaccguagccuccgcagcucagcgccgaggaagaauuggccggaaucagaacaaagagggugaccaauacguguauauggggcagccacugaauaacgaugaagaccacgcccauuggacagaggcaaagauguuguuagauaauaucaacacucccgagggcauuauaccugcccuguuugaaccagagagggaaaagagugcugccaucgacggagaguaccgccucagaggcgaagcgaggaaaaccuucguugagcugaugcggcguggggaucuucccgucuggcugagcuauaagguggcaucggagggauuucaguacucugaccgccgauggugcuucgauggugaaagaaauaaccaggugcucgaggaaaauauggacgucgagauuuggacaaaagaaggcgagaggaagaaauugcggccucgcuggcuggacgccagaaccuauuccgauccgcuagcucugagggaguuuaaggaauucgccgcugggcggcgaagcguuucaggagaccucauccuugagaucggcaaacugccacaacacuuaacuuugagagcacagaacgcccuggauaaucucgugaugcugcacaacagugaacagggugggaaggcuuaccgccaugccauggaggaacuucccgacacgauugagacccugaugcucuuggcacugauagcgguauuaacaggcggagugacucuauuuuuccugucuggcaaggggcucggaaaaaccuccaucggucuucugugugucacagccagcucagcuuugcuguggauggccaguguggagccucacuggauugcagcuagcaucauucucgaauuuuuccugaugguucuucucauccccgagccagauaggcagcggaccccucaagacaaucagcuggccuauguggucauaggcuugcuguuuaugaucuuaacuguagcagccaacgaaauggggcuacuggagacaacgaagaaagaucucggaauuggcuacguggcugcggagaaccaucagcacgccaccaugcuugacguugaucugcgucccgcauccgcuuggacuuuguacgccguggccacaaccgucaucaccccaaugaugagacacacaauugaaaauacuacggcaaacaucucucugaccgcuauagccaaucaagcggcuauucucaugggucuggacaagggguggccuaucagcaaaauggauauuggcgugccgcuuuuagcccugggaugcuauucccaggucaacccccucacauugacugcagccgugcugaugcuaguugcucauuacgcaaucauaggcccagggcugcaggccaaggcgaccagggaggcucagaagcgcacagccgcaggaaucaugaaaaauccuaccguggacggcauuguagccaucgaucucgaccccguggucuaugacgcuaaguucgaaaaacaacuuggucagauuaugcuguugauccuguguacuucacagauacuccugaugcggacgacaugggccuuaugcgagucuauuacccuugcaacugggccacugaccacacucugggaaggaaguccuggcaaguuuuggaacacuaccaucgcuguuucgauggccaauaucuuccgagguagcuaccuagcgggcgccgggcuggcauucuccuugaugaaaucucugggaggcgggagaaggggaacaggcgcucagggugagacgcucggggagaaguggaagcgccaacuuaaccagcugucaaaaagcgaauuuaauaccuauaagcgguccggaauuauggagguggauagaagugaagccaaagagggcuugaagcguggugaaacuacaaaacacgcagucucuaggggcaccgcuaagcugcggugguucguggagcgcaaccucguaaagcccgaggggaaagugaucgacuuaggauguggccgagggggauggagcuacuauugcgccggccugaagaaaguuacugaagugaaggguuacacaaaagggggaccgggccaugaggaaccaauaccuauggccaccuacggcuggaaucuugucaagcugcacucagggaaagauguguuuuucaugcccccagagaagugugacacgcuacucugcgauauuggagaauccagucccaacccuaccaucgaggaggguagaacacugagggucuugaagaugguggaaccguggcugaaaggcaaucaguuuuguauuaagauccucaaccccuauaugccaagcguuguagagacucuugaacagaugcaacggaaacaugggggaaugcuggugcgcaauccuuuaucuagaaacuccacccacgagauguacugggucucaugcggcacagguaauauagugagcgcgguuaacaugacuucgaggaugcuguugaaccgauucaccauggcucaccggaagcccacauaugagcgugacguggaucucggggcaggaaccagacaugucgccguggaaccugagguagcuaaucuggacaucauuggccagcgcaucgaaaacauuaaaaaugagcacaagucuacuuggcauuacgaugaagacaacccauauaagacgugggccuaccacggcaguuaugaggugaaacccuccgggagcgcaucauccaugguuaauggagucgugaggcuacuuacaaagccuugggaugugaucccaauggucacccagauugccaugacugacaccacacccuuuggucaacagcggguuuucaaagagaagguggacacgagaaccccgcgcgcuaaaaggggcacuacacagaucauggaaguaaccgcgaaguggcuguggggguuucucucucgaaacaagaaaccucggauauguacuagagaggaauucacaaggaaggugcgcagcaaugccgcaauuggagcugucuuuguggaugagaaccaguggaauagugccaaagaagcaguugaggacgagcguuucugggaucuggugcaccgggaaagagaguugcauaagcaaggcaaaugcgccaccugcgucuacaacaugauggguaagagggaaaagaaacugggggaguuuggaaaggcuaaaggcucccgcgccaucugguacauguggcucggcgcgcgauuccuugaauucgaggcacugggguuuaugaaugaggaccacugguucagccgggaaaacucuuuaucaggaguggagggugaaggccugcauaaguugggguauauccucagagauauuaguaaaauaccaggaggcaauauguacgccgacgauacagcugguugggacacuaggaucaccgaggaugaccugcagaacgaggccaagauuacggauaucauggaacccgagcacgcacuacuugcuaccuccauuuuuaaacugacauaucagaauaagguaguucgcgugcagagaccugccaagaacgggacugucauggacgugaucagccggagggaucaacguggaucuggccaggugggcaccuacgggcucaacacauucacuaauauggaaguccagcugauacgacagauggagucggaaggaaucuuuuugccaucagaguuagagacccccaaccuggcugaacgcguucucgacuggcuugagaaacauggugccgaaagacugaagcggauggcaauuagcggcgacgauugugugguaaaaccgaucgacgauagguucgcgacggcccuaacagcucugaaugacauggggaaggugcgcaaagauauuccucaaugggagcccuccaagggauggaacgacuggcagcaggucccauuuugcagucaccacuuccaucagcucaucaugaaggauggcagagaaauagugguuccuugucggaaucaagacgaguugguggguagggcccgagucucucagggggcaggauggagccugcgugagaccgcuugccuuggcaaauccuaugcccagauguggcaacugauguacuuucacagacgcgaucuccgguuagcagccaacgcgauuuguucagcugugcccguagacuggguuccaacuaguaggacaaccuggucuauccaugcccaccaccaguggaugacuaccgaagauaugcugagcguguggaauagagucuggaucgaggaaaaccccuggauggaggacaagacacauguguccucaugggaagagguuccuuauuugggcaaacgcgaggaccaguggugcgggagccugauuggacucacggcacgggccaccugggcuacuaauauacagguggccaucaaccaagucaggcgacuuauugguaaugaaaacuaccuggauuacaugacaucuaugaagagauucaaaaaugaguccgacccagaaggcgcacuaugguga

SEQ ID NO: 13515 - RNA, 9879 nt, Artificial Sequence
  derived and/or modified CDS sequence (opt3) from DENV-1__FJ810415__SS-prME
agcgugaccaugcugcucaugcuucugcccacagccuuggcuuuccacuuaacuacgaggggcggggagccucauaugaucgucuccaaacaggaaaggggaaaaucucugcuauuuaagaccucagcugguguuaacaugugcacccucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuggcuccccaugucggcuugggucucgaaacuagaaccgagacauggauguccucugaaggggccuggaaacagauccagaggguggagacuugggcccugcggcacccuggauucaccguuauugcauuuuuccuggcccaugcuaucggcacaucgauuacccagaagggcgugaucuuuauacucuuaaugcuggucacgccaucaauggccaugcgcugcguggggaucggaaacagggacuucguagagggucuuagcggcgcgacuuggguugauguggucuuggaacacgggaguugugugacaaccauggcaaagaauaaacccacucuggacauugagcuacucaagacagaagugaccaacccugccguccugaggaaacuuugcaucgaggcuaagauuuccaauacgaccacagauucucgguguccaacucaaggagaagccacccugguugaggagcaggacgcaaacuuugugugccgccgaacauucguagauagaggcugggguaauggguguggauuguuuggcaaaggcagccuccugacuugcgcuaaguucaagugcgugaccaaauuagaagggaagaucguccaguacgagaaccugaaauauuccgugauaguuacagugcacaccggagaccagcaucaagucgguaaugaaacuacggagcacggcacaauugccaccaucacuccccaggcgccuaccucagaaauucagcucacagauuacggggcccuuacccuggacuguaguccaaggacuggauuggacuuuaacgagauggugcuacugacaaugaaggagaaaagcuggcucguacauaagcagugguuccuggaucuuccgcugcccuggacgucuggcgcauccaccucacaagaaacuuggaaucggcaggacuugcucguuacauuuaaaaccgcucacgccaagaagcaggagguggucgugcuggguagccaagaaggggcuaugcacacagccuuaacuggcgcaaccgagauccagacgaguggaaccacaacuaucuucgccggccaucugaaaugccgucuaaagauggauaaacucacccugaaggggaugucuuaugucauguguacaggauccuucaaacuugaaaaggagguggcugagacucagcacgguaccguuuuggugcagguaaaguacgaaggcacggacgcgccuugcaaaauuccauuuagcacacaagaugagaagggggucacccagaacggacgccugauaacugcaaaucccaucgugacagacaaagaaaagccuguuaacauugagaccgagccacccuucggcgaaucguauaucguggucggugccggggagaaagcucucaagcugaauugguuuaagagaggaucuuccauaggaaaaauguucgaagccacugcaaggggcgcccggcgaauggcuauucuuggggauaccgccugggacuuuggaucaaucgguggcguguucacaaguguagggaagcuggugcaucagguuuuuggaacggcauacggcgucuuguucagcgguguguccuggaccaugaaaaucgggauuggcauccuccugacuugguuaggacugaacucucgcagcacaucacuaaguaugaccuguauugcggugggcauggucacacucuaccuggggguuauggugcaggcugauuccggaugcgugauaaacuggaagggcagagagcuuaaaugugguagcgggaucuuuguaacuaaugaaguccacaccuggacggagcaauauaaguuccaggccgacucuccgaagagguugucagcagccauuggaaaggcuugggaggaaggcgugugcgguauccggagugccacacgccuggagaacaucauguggaagcagauuagcaaugaacucaaccauauacuguuagagaaugauaugaaauuuaccguuguggucggcgacgcaaacgggauccuggcucagggaaagaaaaugauuagaccucaacccauggaacacaaguacuccuggaaaucuuggggcaaggccaagaucauuggggcggacauccagaauacuaccuucauaaucgauggaccagacacaccugagugucccgauggccagagggccuggaacauuugggagguggaagacuaugguuuugggguuuucacuaccaauaucuggcuuaaauugcgugauucguacacacagaugugcgaccaccggcucaugagcgcugcaauuaaggauuccaaagccgugcaugcugacaugggauauuggaucgagucagaaaagaacgagacguggaaacuggcccgagcaaguuucauagaaguaaagaccuguacuuggccaaagucucacacacuauggagcaauggcguccuggaguccgagaugauuauccccaaaauuuacgguggcccuaucucacaacauaacuauagaccaggguacuuuacccagacugcgggaccguggcaccucggcaagcuggaacuugauuucgacuugugcgaggggacaaccgugguggucgaugaacacugcggaaauaggggccccagccugcgcacgacuaccguuacagguaaaauaauccaugagugguguugccggucuuguaccuuaccuccacucagauuuagaggggaagacggaugcugguacggcauggaaauucgccccgugaaggagaaagaagagaaccugguacgauccauggugagugccgguagcggcgaagucgauucuuucucccuugggauccugugugugucaauuaugaucgaggagguuaugcggagucguuggagcagaaagauguugaugacuggaacacucgcuguguuucugcuacugauaaugggccagcucaccuggaaugaccugauuaggcuuugcaucauggucggggccaacgcaucggaccgcaugggaaugggcacaacuuauuuggcucugauggccaccuucaagaugcggccuauguuugcaguggguuuacucuucagaaggcugacgucccgagaaguucuucugcuaacaaucgggcucucucugguggccagcgucgaguugccaaacucacuggaagaguuaggagauggccucgcuaugggcauuaugaugcugaaacuucugaccgaauuucaaccccaccaguuguggacuacccuccugagucuaacauucguaaagacuacccugucccuugacuacgcguggaaaacgacagccauggugcucucuaucguuagccuguuuccguugugucuguccaccacuucacagaagacaaccugguuaccugugcuccuggggagcuucggaugcaaaccacuuacuauguuucugauuacagagaauaagauauggggucgcaagaguuggcccuugaacgagggcaucauggcaauugggaucgucucuauucuccuguccagccuacugaaaaaugaugugccucuugcuggaccccucaucgccggcgguaugcugauagccuguuauguaaucucggggucaucugcugacuugaguuuagaaaaggcagccgagguguccugggaacaggaggcggaacauagcggagcuucucacaacauucuggucgagguucaagaugacggcaccaugaaaaucaaggaugaggaacgggacgauacgcucacuauucugcuuaaagccacccuguuggcagugagcggcguguacccaauguccaucccugccacacuauucgucugguauuucuggcagaagaaaaagcagagaucaggggugcugugggacacccccaguccaccggagguugaaagggcuguacucgaugacggaauauaccguauucugcagcgcggucuuuuaggccggagccaagugggggucggaguguuucaggauggcguuuuccauacaauguggcacgugacuagaggugcaguccugauguaucaggggaagaggcucgagccuucuugggccuccgugaaaaaggacuugaucucauacggaggcggcuggcgauuucaggggaguuggaauaccggagaggaaguacaagucaucgcgguggagcccgguaaaaacccaaagaauguucagacgacacccggcacuuucaaaaccccugaaggggaggugggagcuauugcccuggacuuuaagccaggcacaagcgguucccccauagucaaccgggaagggaagaucgugggacucuacggcaauggcguugugaccacuucugggaccuaugucucggcaauugcccaggcuaaagccagccaagagggaccucugccggagaucgaagaugagguguucaagaaacgcaaccuuacaauuauggaccugcacccagguucaggcaagacgagaagguacuugcccgcaaucguacgggaagcuauaaaacgaaagcuaagaacucugauccucgccccuacccgcgugguugcguccgagauggccgaagcauuaaaggggaugccaauuagguaucagacaaccgcugucaaaagugagcauacuggacgugagaucguggaucugaugugccacgccacauuuaccaugcggcuucugucucccgugagagucccuaauuacaacaugauuaucauggacgaagcucauuucacggauccggcaagcauagccgccaggggcuauauuuccacucgcguagguaugggggaggcugcggcaaucuuuaugacagccacacccccaggaucaguggaggcuuucccucagucuaaugccguuauccaggacgaggaacgagauauucccgagagaagcuggaacaguggcuacgacuggaucaccgauuuuccaggcaagacugugugguucgucccuuccauaaaaagcgggaaugacauugcaaacugucuccggaagaacggaaaaagggugauccaauugucucgcaagacauucgauaccgaguaucagaagacuaaaaauaacgacugggacuacguugugacuacggauauuucagaaaugggugccaauuuucgugcugacagagucaucgauccccggaggugccugaagccagugauacucaaagacggcccggagcgcguaauucuggcggggccuaugcccgugaccguugccuccgcagcucagcgaagaggacggaucggcaggaaccagaauaaggaaggugaucaauacgucuauauggggcagccacuuaacaaugacgaggaucacgcccauuggacagaggcaaaaaugcuacuggacaacaucaauacucccgaaggcauuaucccugccuuguucgagccagaacgcgagaagagugcugccauugauggagaauacagauuaaggggcgaggcgcggaagaccuuuguggagcugaugcgucgcggggaccuccccguguggcugagcuauaaagucgcaucggaaggauuccaguacucugaucgaagauggugcuuugacggugagaggaacaaucagguucuugaagagaacauggauguggaaauauggacaaaggagggcgagcggaaaaagcugcgcccuagauggcucgacgccaggaccuauuccgacccguuggcucugcgggaguucaaagaguuugccgcugggcgaagaagcguaucaggagaucuaauccuggaaauuggcaagcucccacaacaccuuacucugcgcgcacagaaugccuuagacaacuuggugaugcugcacaauagugagcagggugggaaggcuuacaggcaugccauggaggaacuccccgauacgaucgagacccugaugcuucuggcacucaucgcggucuugacaggcggagugacucuguucuuuuuaucuggcaaggggcuaggaaagaccuccauuggucugcucuguguuacagccagcucagcacuucuguggauggccaguguggaaccucacuggauagcagcuagcaucauuuuggaguucuuucugaugguccuccugauccccgaaccagaccggcagcguaccccucaagauaaccagcuugccuauguagugauuggccuccuguucaugaucuugacuguugcagccaacgagauggggcuguuagagacaacgaaaaaggaccuaggaauaggcuacguggcugcggaaaaucaucagcacgccaccaugcuggaugucgaccuccaccccgcauccgcuuggacucuuuacgccguggccacaaccgucaucaccccaaugaugagacauacaauugagaacacuacggcaaauaucucucugaccgcuauugccaaccaagcggcuaucuugaugggucuggauaaaggguggccuauaagcaagauggacauuggcgugccgcuccuggcccuuggaugcuauucccagguuaaucccuuaacacugacugcagccgugcucauguugguagcucacuacgcaaucauuggcccagggcugcaggccaaagcgaccagggaagcucagaagcgcacagccgcaggaaucaugaagaacccuaccguggauggcauagucgccaucgaccuagaucccguuguguaugacgcuaaauuugagaagcaacugggucagauuaugcuccuuauccuguguacuucacagauuuugcugaugcggacgacaugggcccucugcgaaucuaucacccuggcaacugggccauuaaccacacuuugggagggaaguccuggcaaauucuggaauacuaccauagcugucucgauggccaacauuuuccgagguagcuaccuggcgggcgccgggcucgcauuuucccuaaugaagucucugggaggcgggagaaggggaacaggcgcucagggugagacguugggggaaaaauggaagcgccaacugaaucagcucucaaagagcgaguucaacaccuauaaacgguccggaaucauggaaguggacagaagugaggccaaggaaggccuuaaacguggugagacuacaaagcaugcaguaucuaggggcaccgcuaaacugcggugguuuguggagcgcaauuugguuaagcccgaagggaaggugaucgaucugggauguggccgagggggauggagcuacuauugcgccggccucaaaaaggucacugaggugaaagguuacacaaaagggggcccgggccacgaagaaccaauuccuauggccaccuacggcuggaacuuagucaaacugcauucagggaaggacguguucuuuaugcccccagaaaaaugugauacgcuucugugcgacaucggagaguccagucccaauccuaccauagaggaagguagaacacuaaggguucucaagaugguagagccguggcugcggggcaaccaguucuguauuaagaucuugaaucccuauaugccaagcguggucgaaacucuggagcagaugcaacgcaaacacgggggaaugcucgugagaaacccucuuucuagaaauuccacccacgagauguacuggguuucaugcggcacagguaacauugugagcgcggucaacaugacuucgcgaaugcuguuaaaucgguuuaccauggcucaucguaagcccacauaugaaagagauguggaccugggggcaggaacccgccacguagccguggagccugaaguugcuaacuuggauaucauaggccagaggaucgagaauauuaaaaacgaacauaagucuacuuggcacuacgacgaggauaauccauauaaaacgugggccuaccacggcaguuaugaggucaagcccuccgggagcgcaucauccauggugaacggagugguccggcuccugacaaagccuugggacguuaucccaauggugacccagauugccaugacugauaccacacccuucggucaacagagaguauuuaaagaaaagguggacacgcgcaccccgagggcuaaacgaggcacuacacagaucauggaggucaccgcgaaguggcuauggggguuccuuucucggaauaaaaagccuagaauuuguacuagggaagaguuuacacgcaaggugcguagcaacgccgcaaucggagcuguuuucguggacgaaaaucaguggaacagugccaaagaggcagucgaggaugaacgguuuugggaccuggugcauagagagagggaacuccacaagcaaggcaaaugcgcaaccugcguauacaauaugauggguaagcgcgagaaaaagcugggggaguucggaaaggcuaaaggcucccgagccauaugguacaugugguugggcgcgcgguuccuggaguuugaggcacucggguucaugaacgaagaucauugguuuagcagagaaaauucucuuucaggaguugaaggugagggccugcacaaguuaggguauauucugagggacaucaguaaaaucccaggaggcaacauguacgccgaugacacagcugguugggauacucgcauuaccgaggacgauuugcagaaugaagccaagauaacggacaucauggagcccgaacaugcacuccuggcuaccuccauuuucaaacuaacauaucagaacaagguggucagagugcagcggccugccaaaaacgggacugugauggaugucaucagcaggcgugaccaacgaggaucuggccagguuggcaccuacgggcuuaauacauuuacuaacauggaggugcagcugauucgccagauggaaucggagggaaucuuccucccaucagagcuggaaacccccaauuuggcugagagagccuuagauuggcuggaaaagcacggugcagagcggcucaagaggauggcgauaagcggcgacgacuguguagugaaaccgaucgaugaccgcuuugccacggcucuuacagcccugaacgauauggggaaggucagaaaagacauuccucaaugggaacccuccaagggauggaaugauuggcaacaggugccauucugcagucaccauuuucaccagcuaaucaugaaagacggccgggagauuguugugccuuguaggaaccaagaugagcuggucggucgagcacgugugucucagggggcuggauggagccucagagaaaccgccugcuugggcaaguccuaugcacagauguggcaacugauguacuuccaucgccgggaccuuaggcuggccgcgaaugcuaucuguucagccguacccguugauugggugccaacaaguagaacaaccuggucuauacacgcacaccaucaguggaugacuaccgaggacaugcucagcgucuggaaccgcguguggauugaagagaaucccuggauggaagauaagacacacguuuccucaugggaggaggugccuuauuuaggcaaacgggaagaccaguggugcgggagccugaucggauugacggccagggcuaccugggccacuaacauccaggucgcaauuaaucaagugcgaagacugauagguaacgagaauuaccucgacuacaugacaucuaugaagcgguuuaaaaacgaauccgauccagagggcgcucuuugguga

SEQ ID NO: 13516 - RNA, 9879 nt, Artificial Sequence
  derived and/or modified CDS sequence (opt3) from DENV-1__FJ639814__SS-prME
agcgugaccaugcugcucaugcuucugcccaccgccuuggcuuuccacuuaacuacgaggggcggggagccucauaugaucgucuccaagcaggaaaggggaaaaucucugcuauuuaagaccucagcugguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcuccccaugucggcuugggucucgaaacuagaaccgagacauggauguccucugaaggggccuggaaacagauccagaggguggagacuugggcccugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagggacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuacgguggcccuauaagccaacauaauuauagaccaggguacuuuacccagacugcgggaccguggcaccucggcaagcuggaacuugauuucaacuugugcgaggggacaaccgucgugguggacgaacacugcggaaauaggggccccucucugcgcacgacuaccgucacagguaaaaucauucaugagugguguugccgguccuguaccuuaccuccacucagauuuagaggggaagauggaugcugguacggcauggaaauccgccccguuaaggagaaagaagagaaccuggugcgaaguaugguaagcgccgguucuggcgaaguggacuccuucucacuugggauucugugugucaguaucaugauagaggaggugaugcggagccguuggucgagaaagauguugaugacuggaacacucgcuguuuuucugcuacugauuaugggccagcucaccuggaaugaucugaucaggcuuugcaucauggugggggccaacgcauccgaccgcaugggaaugggcacaacuuauuuggcucugauggccaccuucaagaugcggccuauguuugcagucgguuuacucuucagaaggcugacgucucgagaagugcuucugcuaacaauugggcucagccugguugccucaguggaguugccaaacagucuggaagaguuaggagacggccucgcuaugggcaucaugaugcugaaacuucugaccgaauuucaaccccaccaguuguggacuacccuccugucccuaacauucgucaagacuacccugucucuugauuacgcguggaaaacgacagccaugguacucagcauugugucccuguuuccguugugucugucaaccacuagccagaagacaaccugguuaccuguucuccuggggaguuucggaugcaaaccacuuacuauguuucugauaacagagaauaagaucuggggucgcaagucuuggcccuugaacgagggcauuauggcaaucgggauuguguccauccuccugagcucgcuacugaaaaaugacgucccucuugcuggaccccucauagccggcgguaugcugaucgccuguuaugugauuucagggucuagugcugauuuguccuuagaaaaggcagccgagguaagcugggaacaggaggcggaacauucuggagcuagccacaacauccugguggagguccaagacgauggcaccaugaaaauuaaggacgaggaacgggaugacacgcucacuauccugcuuaaagccacccuguuggcaguuuccggcguguacccaaugucaauaccugccacacuauucgugugguauuucuggcagaagaaaaagcagagaagugggguccugugggauacccccagcccaccggagguggaaagggcuguucucgacgauggaauuuaccguauccugcagcgcggucuuuuaggccggucucaaguaggggugggagucuuucaggacggcguguuccauacaauguggcacguuacuagaggugcagugcugauguaucaggggaagaggcucgagccuuccugggccucagucaaaaaggauuugaucaguuacggaggcggcuggcgauuucaggggagcuggaauaccggagaggaagugcaaguaauugcggucgagcccgguaaaaacccaaagaaugugcagacgacacccggcacuuucaaaaccccugaaggggagguuggagcuauagcccuggacuuuaagccaggcacauccgguucucccaucgugaaccgggaagggaagauugucggacucuacggcaauggcgugguuaccacuucggggaccuaugugagcgcaaucgcccaggcuaaagccucacaagagggaccucugccggagauugaagacgaggucuucaagaaacgcaaccuuacaaucauggaucugcacccagguuccggcaagacgagaagguacuugcccgcaauagugcgggaagcuaucaaacgaaagcuaagaacucugauucucgccccuacccgcguaguggcgagugagauggccgaagcauuaaaggggaugccaaucagguaucagacaaccgcuguuaaaucugagcauacuggacgugagauugucgaccugaugugccacgccacauuuaccaugcggcuucugagccccgugagagugccuaauuacaacaugaucauaauggaugaagcucauuucacggacccggcauccauugccgccaggggcuauaucucaacucgcgucgguaugggggaggcugcggcaaucuuuaugacagccacacccccaggaucuguagaggcuuucccucagagcaaugccgugauucaggaugaggaacgagacauccccgagagaaguuggaacuccggcuacgauuggauaaccgacuuuccaggcaagacuguuugguucgugccuagcauuaaaucugggaaugauaucgcaaacugucuccggaagaacggaaaaagggucauucaauugucacgcaagacauucgacaccgaguaucagaagaccaaaaauaacgauugggacuacgugguuacuacggacaucuccgaaaugggugccaauuuucgugcugauagagugauagacccccggaggugccugaagccagucauucucaaagauggcccggagcgcgugauccuggcggggccuaugcccguaaccguggccagugcagcucagcgaagaggacggaucggcaggaaccagaauaaggaaggugaccaauacguuuauauggggcagccacuuaacaaugaugaggaccacgcccauuggacagaggcaaaaaugcuacuggauaacauuaauacucccgaaggcaucauuccugccuuguucgagccagaacgcgagaaaagcgcugccauagacggagaauacagauuaaggggcgaagcgcggaagaccuuugucgagcugaugcgucgcggggaucuccccguguggcugucguauaaaguggcaucugaaggauuccaguacuccgaccgaagauggugcuuugauggugagaggaacaaucagguccuugaagagaacauggacguugaaaucuggacaaaggagggcgagcggaaaaagcugcgcccuagauggcucgaugccaggaccuauagcgacccguuggcucugcgggaguucaaagaguuugccgcugggcgaagaucagugaguggagaccuaauucuggaaaucggcaagcucccacaacaccuuacucugcgcgcacagaaugccuuagauaacuugguaaugcugcacaauucugagcagggugggaaggcuuacaggcaugccauggaggaacuccccgacacgaucgagacccugaugcuucuggcacucauugcgguguugacaggcggagucacucuguucuuuuuauccggcaaggggcuaggaaagaccagcauaggucugcucugugugacagccucaagugcacuucuguggauggccagcguugaaccucacuggaucgcagcuuccauuaucuuggaguucuuucugauggugcuccugauucccgaaccagaucggcagcguaccccucaagacaaccagcuugccuaugucguaaucggccuccuguucaugauauugacuguggcagccaacgagauggggcuguuagagacaacgaaaaaggaucuaggaaucggcuacguugcugcggaaaaucaucagcacgccaccaugcuggacguggaucuccaccccgcaucugcuuggacucuuuacgccgucgccacaaccgugauuaccccaaugaugagacauacaaucgagaacacuacggcaaauauuagccugaccgcuaucgccaaccaagcggcuauauugaugggucuggacaaaggguggccuauuuccaagauggauaucggcgucccgcuccuggcccuuggaugcuauucacaggugaaucccuuaacacugacugcagccguucucauguugguggcucacuacgcaauuaucggcccagggcugcaggccaaagcgaccagggaagcucagaagcgcacagccgcaggaauaaugaagaacccuaccguagacggcaucguggccauugaucuagaccccgucguuuaugaugcuaaauuugagaagcaacugggucagaucaugcuccuuauucuguguacuucucagaucuugcugaugcggacgacaugggcccucugcgaaaguauaacccuggcaacugggccauuaaccacacuuugggagggaucgccuggcaaauucuggaauacuaccauugcugugagcauggccaacaucuuccgagguuccuaccuggcgggcgccgggcucgcauuuucucuaaugaagucacugggaggcgggagaaggggaacaggcgcucagggugagacguugggggaaaaauggaagcgccaacugaaucagcucagcaaguccgaguucaacaccuauaaacggaguggaaucauggaagucgacagaucugaggccaaggaaggccuuaaacguggugagacuacaaagcaugcagugagcaggggcaccgcuaaacugcggugguuuguagagcgcaauuuggugaagcccgaagggaagguuauugaccugggauguggccgagggggauggucauacuauugcgccggccucaaaaaggugacugaggucaaagguuacacaaaagggggaccgggccacgaggaaccaaucccuauggccaccuacggcuggaacuuagugaaacugcauuccgggaaggaugucuucuuuaugcccccagaaaaaugugacacgcuucugugcgauauaggagagaguagccccaauccuaccauugaggaagguagaacacuaagggugcucaagaugguugagccguggcugcggggcaaccaguucuguaucaagauuuugaaucccuauaugccaucuguaguggaaacucuggagcagaugcaacgcaaacacgggggaaugcucgucagaaacccucuuuccagaaauucaacccacgagauguacugggugagcugcggcacagguaacaucguuucggcggugaacaugacuucucgaaugcuguuaaaucgguuuaccauggcucaucguaagcccacauaugaaagagacgucgaucugggggcaggaacccgccacguggccguagagccugaaguggcuaacuuggacauaaucggccagaggauugagaauaucaaaaacgaacauaagaguacuuggcacuacgaugaggacaauccauauaaaacgugggccuaccacggcuccuaugagguuaagcccagcgggucagcauccucuauggucaacggaguggugcggcuccugacaaagccuugggaugucauuccaaugguuacccagaucgccaugacugacaccacacccuucggucaacagagaguguuuaaagaaaagguagauacgcgcaccccgagggcuaaacgaggcacuacacagauuauggaggugaccgcgaaguggcuauggggguuccuuagccggaauaaaaagccuagaaucuguacuagggaagaguuuacacgcaagguccguaguaacgccgcaauaggagcuguguucguugacgaaaaucaguggaacuccgccaaagaggcaguggaggacgaacgguuuugggaucugguccauagagagagggaacuccacaagcaaggcaaaugcgcaaccugcguguacaauaugauggguaagcgcgagaaaaagcugggggaguucggaaaggcuaaaggcagccgagccauuugguacaugugguugggcgcgcgguuccuggaguuugaggcacucggguucaugaacgaagaccauugguuuucuagagaaaauucacuuaguggaguagaaggugagggccugcacaaguuaggguauauccugagggauaucuccaaaauuccaggaggcaacauguacgccgacgauacagcugguugggacacucgcauaaccgaggaugacuugcagaaugaagccaagaucacggauauuauggagcccgaacaugcacuccuggcuaccagcaucuucaaacuaacauaucagaacaagguugugagaguccagcggccugccaaaaacgggacugugauggacgugauuucuaggcgugaucaacgaggaucgggccaggucggcaccuacgggcuuaauacauuuacuaacauggagguucagcugauccgccagauggaaucagagggaauauuccucccaagcgagcuggaaacccccaauuuggcugagagagccuuagacuggcuggaaaagcacggugcagagcggcucaagaggauggcgaucuccggcgaugacugugugguaaaaccgauugacgaucgcuuugccacggcucuuacagcccugaacgacauggggaaggugagaaaagauaucccucaaugggaacccaguaagggauggaaugacuggcagcaggucccauucugcucucaccauuuucaccagcuaauuaugaaagauggccgggagaucgugguuccuuguaggaaccaagacgagcuggugggucgagcacgugucagccagggggcuggauggucccucagagaaaccgccugcuugggcaagucauaugcacagauguggcaacugauguacuuccaucgccgggaucuuaggcuggccgcgaaugcuauauguagugccgugcccguagacuggguuccaacuucuagaacaaccuggagcauucacgcacaccaucaguggaugacuaccgaggauaugcucuccguguggaaccgcgucuggaucgaagagaaucccuggauggaagacaagacacacgugucaagcugggaggagguuccuuauuuaggcaaacgggaagaucaguggugcgggucucugaucggauugacggccagggcuaccugggccacuaacauucagguggcaauaaaucaaguccgaagacugaucgguaacgagaauuaccucgacuacaugacauccaugaagcgguuuaaaaacgaaagugacccagagggcgcucuuugguga

SEQ ID NO: 13517 - RNA, 9879 nt, Artificial Sequence
  derived and/or modified CDS sequence (opt3) from DENV-1__FJ639815__SS-prME
agcgugaccaugcugcucaugcuucugcccaccgccuuggcuuuccacuuaacuacgaggggcggggagccucauaugaucgucuccaagcaggaaaggggaaaaucucuguuauuuaagaccucagccgguguuaauaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuacgguggcccuauaagccaacauaauuauagaccaggguacuuuacccagacugcgggaccguggcaccucggcaagcuggaacuugauuucgacuugugcgaggggacaaccgucgugguggaugaacacugcggaaacaggggccccucucugcgcacgacuaccgucacagguaaaaucauucaugagugguguugccgguccuguaccuuaccuccacucagauuuagaggggaagacggaugcugguacggcauggaaauccgccccguuaaggagaaagaagagaaucuggugcgaaguaugguaagcgccgguucuggcgaaguggauuccuucucacuugggauucugugugucaguaucaugauagaggaggugaugcggagccguuggucgagaaagauguugaugacuggaacacucgcuguuuuucugcuacugauuaugggccagcucaccuggaacgaccugaucaggcuuugcaucauggugggggccaaugcauccgaccgcaugggaaugggcacaacuuauuuggcucugauggccaccuucaagaugcggccuauguuugcagucgguuuacucuucagaaggcugacgucucgagaagugcuucugcuaacaauugggcucagccugguugccucaguggaguugccaaacagucuggaagaguuaggagauggccucgcuaugggcaucaugaugcugaaacuucugaccgaauuucaaccccaccaguuguggacuacccuccugucccuaacauucgucaagacuacccugucucuugacuacgcguggaaaacgacagccaugcuccugagcauuguauccuuguuuccgcuguguuuaucaaccacuagccagaagacaaccuggcucccugugcugcuugggaguuucggaugcaaaccacugacuauguuuuugauaacagagaacaagaucuggggucgcaagucuuggccccucaaugagggcauuauggcaaucgggauuguuuccauccugcuaagcucgcugcuuaaaaacgaugugccucucgcuggaccccugauagccggcgguauguugaucgccuguuaugucauuucagggucuagugcugacuuaucccuggaaaaggcagccgaggugagcugggaacaggaggcggaacauucuggagcuagccacaauauccucguagaggugcaagaugacggcaccaugaaaauuaaggaugaggaacgggacgauacgcugacuauccuucugaaagccaccuugcuagcagucuccggcguuuacccaaugucaauaccugccacacuguucgugugguauuucuggcagaagaaaaagcagagaaguggggugcucugggacacccccagcccaccggaggucgaaagggcugugcuggaugacggaauuuaccguauccuucagcgcgguuuacugggccggucucaaguugggguaggaguguuucaggauggcgucuuccauacaauguggcacgugacuagaggugcaguucucauguaucaggggaagagguuggagccuuccugggccucagugaaaaaggaccugaucaguuacggaggcggcuggcgauuucaggggagcuggaacaccggagaggaaguccaagugauugcgguagagcccgguaaaaauccaaagaacguccagacgacacccggcacuuucaaaaccccugaaggggaggugggagcuauagcccucgacuuuaagccaggcacauccgguucucccaucguuaaucgggaagggaagauugugggacuguacggcaacggcgucgugaccacuucggggaccuauguuagcgcaaucgcccaggcuaaagccucacaagagggaccucuuccggagauugaagaugagguguucaagaaacgcaaucugacaaucauggacuugcacccagguuccggcaagacgagaagguaccuacccgcaauaguccgggaagcuaucaaacgaaagcugagaacucucauuuuagccccuacccgcgugguagcgagugagauggccgaagcacugaaggggaugccaaucagguaucagacaaccgcugugaaaucugagcauacuggacgugagauuguugaucuuaugugccacgccacauuuaccaugcggcugcucagccccgucagagugccuaacuacaauaugaucauaauggacgaagcucauuucacggauccggcauccauugccgccaggggcuauaucucaacucgcguggguaugggggaggcugcggcaaucuuuaugacagccacacccccaggaucugucgaggcuuucccucagagcaacgccguaauucaggacgaggaacgagauauccccgagagaaguuggaacuccggcuacgacuggauaaccgauuuuccaggcaagacugugugguucguuccuagcauuaaaucugggaacgacaucgcaaauuguuugcggaagaacggaaaaagggugauucaacugucacgcaagacauucgauaccgaguaucagaagaccaagaauaaugacugggacuacgucgugacuacggauaucuccgaaaugggugccaacuuucgugcugacagaguuauagauccccggaggugccucaagccagugauucugaaagacggcccggagcgcgucauccuugcggggccuaugcccgugaccguagccagugcagcucagcgaagaggacggaucggcaggaaucagaacaaggaaggugaucaauacguguauauggggcagccacuaaauaacgacgaggaucacgcccauuggacagaggcaaaaaugcuguuggacaauauuaacacucccgaaggcaucauuccugccuuauucgagccagaacgcgagaaaagcgcugccauagauggagaauacagacugaggggcgaagcgcggaagaccuuuguugagcucaugcgucgcggggaccugcccgucuggcuuucguauaaaguggcaucugaaggauuccaguacuccgaucgaagauggugcuuugacggugagaggaauaaccaggugcuggaagagaauauggaugucgaaaucuggacaaaggagggcgagcggaaaaagcuccgcccuagaugguuggacgccaggaccuauagcgacccgcuggcucuacgggaguucaaagaguuugccgcugggcgaagaucaguuaguggagaucugauucucgaaaucggcaaacuuccacaacaccugacuuuacgcgcacagaacgccuuggacaaucuggugaugcuccacaacucugagcagggugggaaggcuuacaggcaugccauggaagaacugcccgauacgaucgagacccuuaugcugcucgcauugauugcgguacugacaggcggagugacuuuauucuuucuauccggcaaggggcugggaaagaccagcauaggucuccuuugugucacagccucaagugcucuguuguggauggccagcguggaaccucacuggaucgcagcuuccauuauccuggaguucuuucucaugguucugcuuauucccgaaccagaccggcagcguaccccucaagauaaucagcucgccuauguggucaucggccuguuguucaugauacugacuguagcagccaacgagaugggguuacuagagacaacgaaaaaggaccugggaaucggcuacguggcugcggaaaaccaucagcacgccaccaugcucgauguugaccuucaccccgcaucugcuuggacucuguacgccguggccacaaccgucauuaccccaaugaugagacauacaaucgagaauacuacggcaaacauuagcuugaccgcuaucgccaaucaagcggcuauacugaugggucucgauaaaggguggccuauuuccaagauggacaucggcgugccgcugcuugccuuaggaugcuauucacaggucaacccccugacacucacugcagccguguugaugcugguugcucacuacgcaauuaucggcccagggcuacaggccaaagcgaccagggaagcucagaagcgcacagccgcaggaauaaugaagaauccuaccguggauggcaucguagccauugaccuggaucccguggucuaugacgcuaaauuugagaagcaacucggucagaucaugcuucugauuuuguguacuucucagauccugcucaugcggacgacaugggcccugugcgaaaguauaaccuuagcaacugggccacuuaccacacugugggagggaucgccuggcaaauucuggaacacuaccauugcuguuagcauggccaauaucuuccgagguuccuaccucgcgggcgccgggcuagcauuuucucugaugaagucauugggaggcgggagaaggggaacaggcgcucagggugagacgcugggggaaaaauggaagcgccaacucaaccagcuuagcaaguccgaguucaauaccuauaaacggaguggaaucauggaaguggacagaucugaggccaaggaaggccugaaacguggugagacuacaaagcaugcagucagcaggggcaccgcuaaauugcggugguuuguggagcgcaaccugguaaagcccgaagggaaggugauugaucucggauguggccgagggggauggucauacuauugcgccggccugaaaaagguuacugaggugaaagguuacacaaaagggggaccgggccacgaggaaccaaucccuauggccaccuacggcuggaaucuagucaaacuucauuccgggaaggacguguucuuuaugcccccagaaaaaugugauacgcugcuaugcgacauaggagagaguagccccaacccuaccauugaggaagguagaacacucaggguccugaagaugguggagccgugguugcggggcaaucaguucuguaucaagauucugaaccccuauaugccaucuguuguagaaacucucgagcagaugcaacgcaaacacgggggaaugcuugugagaaauccucuguccaggaacucaacccacgagauguacugggucagcugcggcacagguaauaucgugucggcgguuaacaugacuucucgaauguuacugaaccgguuuaccauggcucaucguaagcccacauaugaaagagauguggacuugggggcaggaacccgccacgucgccguggagccugaaguagcuaaucucgauauaaucggccagaggauugagaacaucaaaaaugaacauaagaguacuuggcacuacgacgaggauaacccauauaaaacgugggccuaccacggcuccuaugaggugaagcccagcgggucagcauccucuaugguuaauggagucgugcggcugcuaacaaagccuugggacgugauuccaauggucacccagaucgccaugacugauaccacacccuucggucaacagagaguuuuuaaagaaaagguggacacgcgcaccccgagggcuaaacgaggcacuacacagauuauggagguaaccgcgaaguggcuuuggggguuccugagccggaacaaaaagccuagaaucuguacuagggaagaguuuacacgcaaggugcguaguaaugccgcaauaggagcugucuucguggacgaaaaccaguggaacuccgccaaagaggcaguugaggaugaacgguuuugggaccucgugcauagagagagggaacugcacaagcaaggcaaaugcgcaaccugcgucuacaacaugauggguaagcgcgagaaaaaguugggggaguucggaaaggcuaaaggcagccgagccauuugguacauguggcugggcgcgcgguuccucgaguuugaggcacuuggguucaugaaugaagaucauugguuuucuagagagaacucacugaguggaguggaaggugagggcuuacacaagcugggguauaucuugagggacaucuccaaaauuccaggaggcaauauguacgccgaugacacagcugguugggauacucgcauaaccgaggacgaucuccagaacgaagccaagaucacggacauuauggagcccgaacaugcacugcuagcuaccagcaucuucaaacuuacauaucagaauaagguaguuagagugcagcggccugccaaaaacgggacugucauggaugugauuucuaggcgugaccaacgaggaucgggccaggugggcaccuacgggcugaacacauuuacuaauauggagguccagcucauccgccagauggaaucagagggaauauuccugccaagcgaguuggaaacccccaacuuagcugagagagcccuggauuggcucgaaaagcacggugcagagcggcuuaagaggauggcgaucuccggcgacgacuguguugugaaaccgauugaugaccgcuuugccacggcucugacagcccuaaaugauauggggaagguaagaaaagacaucccucaaugggaacccaguaagggauggaacgauuggcaacaggugccauucugcucucaccauuuucaccagcugauuaugaaagacggccgggagaucgucgugccuuguaggaaucaagaugagcucguuggucgagcacgugugagccagggggcuggaugguccuugagagaaaccgccugccugggcaagucauaugcacagauguggcaacuuauguacuuccaucgccgggaccugaggcucgccgcgaacgcuauauguagugccguccccguggauuggguaccaacuucuagaacaaccuggagcauucacgcacaccaucaguggaugacuaccgaggacauguuauccguuuggaaucgcguguggaucgaagagaaccccuggauggaagauaagacacacgucucaagcugggaggaggugccuuaucugggcaaacgggaagaccaguggugcgggucuuugaucggacugacggccagggcuaccugggccacuaauauucagguugcaauaaaccaagugcgaagacucaucgguaaugagaacuaccuugacuacaugacauccaugaagcgguuuaaaaaugaaagugauccagagggcgcucugugguga

SEQ ID NO: 13518 - RNA, 9879 nt, Artificial Sequence
  derived and/or modified CDS sequence (opt3) from DENV-1__FJ639818__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaauaccacugauacauggguaaccuaugggacguguagucaaacuggagagcaccgccgagacaagcguagcguggcucuggccccccaugucggcuugggucucgagaccagaacagaaacuuggauguccucugagggggcauggaaacagauccagaggguggaaaccugggcccugcggcacccuggauucacaguuauugcucuguuucucgcacaugccaucggcaccucgauuacgcagaagggcaucauauucaucuuacugaugcuugugacuccaucaauggcuaugcgcugcgucgggauuggaaacagagauuuuguggaggguuugagcggcgccacauggguagacguugugcuggagcacgggaguugugucaccacuauggcgaagaauaaacccacacuagauaucgaacuccugaagaccgaggugacgaacccugcagugcuuaggaaacugugcauugaagccaagaucuccaauaccacaacugacucucgguguccaacccaaggagaggcuacauuggucgaagagcaggaugccaacuucguuugccgccgaacuuuuguggacagaggcugggguaauggguguggacucuucggcaaaggcagccuguuaaccugcgcaaaguuuaagugcguaacaaaacuggaggggaagauagugcaguacgaaaaccucaaauauuccgucauugugaccguucacacuggagaucagcaucaaguggguaaugagacgacagaacacggcaccaucgcuacuauuaccccccaggccccuacaucagagauccagcuuaccgacuacggggcgcugacuuuggacuguaguccaaggacaggacuagauuucaacgaaaugguccugcucacgaugaaggagaaaagcuggcuggugcauaagcagugguuucuugaccugccguugcccuggaccucuggcgccuccacuucacaagagacauggaaucggcaggaucuccugguaaccuucaaaacagcacacgcuaagaagcaggaaguuguggucuuagguagccaagagggggccaugcacacugcucugaccggcgccacggaaauccagaccaguggaacaacuaccauuuuugcaggccaucuaaaaugccgucucaagauggagaaacugacacuuaaggggaugucuuaugugauguguacuggauccuucaaauuggaaaaggaggucgccgagacccagcacgguacggugcugguucaggugaaguacgaaggcacagacgcuccuugcaaaauaccauucagcacccaagaugagaaggggguaacucagaacggacgccucaucacagcgaaucccauugucaccgacaaagaaaagccugugaacaucgagacugagccacccuuuggcgaaucguauauaguugugggugcaggggagaaagcccugaagcuuucuugguucaagaaaggcuccucaauuggaaagauguuugaagcuaccgccagaggcgcaaggcggauggccauccugggggauacagcuugggacuucggaaguaucgguggcgucuuuacgagcguggggaaauugguacaucagguguucggaaccgccuacggcguucucuuuuccggugucucuuggacuaugaagauugggaucggcauucuguuaacauggcugggacuaaauagccgaucaaccagucucuccaugacauguauagcagugggcauggugacucuguaccuuggggucaugguucaggcggauagcggaugcgugaucaacuggaaaggccgcgaguugaagugugguucugggauuuucgugaccaacgaaguacacacguggacagagcaauauaaguuucaggcugacucaccgaaaagacugagugccgcaaucggaaaggccugggaggaaggcgucugcgguaucaggagcgcuacccggcucgagaauauuauguggaaacagauauccaacgaacugaaucauaucuuacuggagaacgauaugaaguucacugugguugugggcgacgccaaugggauucuugcacagggaaaaaagaugauccgcccucaacccauggaacacaaauacucuuggaagucguggggcaaggcuaaaauuaucggggccgacauacagaacaccacauuuaucauugauggaccagacacuccugagugucccgauggccagagagcguggaauaucugggaggucgaagacuaugguuucgggauuuuuaccacaaacaucugguugaagcucagggauagcuacacgcagaugugcgaccaccgucugauguccgccgcuauaaaagauucaaaggcagugcaugccgacaugggauauuggauugagagugaaaaaaaugagaccuggaagcuagcucgggccucuuucaucgaaguuaagacuuguacauggccaaaaagccacacccugugguccaacggcgugcucgagucagagaugauuauccccaagauauacgguggcccuaucagccaacauaauuaucgaccaggguacuucacucagacagcaggaccguggcaccugggcaaacuugaauuggauuuugaccugugcgaggggaccacgguagucguggaugaacacugcggaaacagaggccccucuuuaaggacuaccacagugaccgguaagauuauccaugagugguguugccgcuccuguacucucccuccacugcgguucagaggggaggacggaugcugguacggcauggaaauuaggcccgucaaagagaaggaagagaaucuuguucgcaguauggugagcgcggguucuggcgaaguagauuccuuuucacuggggaucuugugugugaguauaaugauugaggaggucaugcgaagccgguggucgcguaagaugcucaugacaggaacccuggccguguuccuacugcucaucaugggccagcugacauggaacgaccuuaucagauugugcauuaugguuggggcuaaugccuccgacaggaugggaaugggcacuacccaccuggcauuaauggcuacguuuaaaaugcgcccuauguucgccgugggucuccuguuucggagacuuacaucuagggaaguccugcuacucaccaucgggcugagcuugguggcaucaguugagcugccaaacaguuuagaagagcucggagauggccuggccaugggcauuaugaugcuuaagcuguugacugaauuccaaccccaucagcucuggaccacacugcuaucccugacuuuugugaaaaccacgcuuucucucgacuaugcuuggaagacaaccgcgaugguccugagcauaguauccuuguucccgcuguguuuaucaacuacaagccagaaaaccacuuggcucccugugcugcuugggaguuuuggaugcaagccacugacaauguucuugaucaccgagaacaagauuuggggucgaaaaucuuggccccucaaugagggcaucauggccauugggaucguuuccauacugcuaagcucgcugcuuaagaacgaugugccucucgcaggaccccugaucgcuggcgguauguugauugccuguuacgucaucucagggucuagugccgacuuaucccuggaaaaagcugcagaggugagcugggaacaggaggccgaacacucuggagcgagccauaauauucucguagaggugcaagaugacggcacgaugaagaucaaagaugaggaacgcgacgauacucugaccauacuucugaaggcuacauugcuagccgucuccggcguuuauccaaugucaauuccugcaacccuguuugugugguacuucuggcagaaaaagaagcagcggaguggggugcucugggacacacccagcccaccggaggucgaaagagccgugcuggaugacggaaucuauaggauccuucagcgugguuuacugggccgcucucaaguugggguaggaguguuccaggauggcgucuuucacacuauguggcacgugacccggggugcuguucucauguaccaggggaaaagauuggagccuuccugggcaucagugaagaaagaccugauuaguuauggaggcggcuggagguuccaggggagcuggaacacgggagaggaaguccaagugauagccguagagcccgguaagaauccaaaaaacguccagacaacucccggcaccuuuaagacaccugaaggggaggugggagcgaucgcucucgacuucaagccaggcaccuccgguucucccauuguuaaucgagaagggaaaaucgugggacuguacggcaacggcgucgugacuaccucggggacauacguuagcgccauugcacaggccaaggcuucacaagagggaccucuuccggagaucgaagaugagguguuuaaaaagcggaaucugacgauaauggacuugcauccagguuccggcaaaacucgcagauaucuacccgccaucgucagggaagcaauuaagcggaagcugcgaacccucaucuuagcuccuacaagagugguagccagugagauggcggaagcccugaaagggaugccaauucgcuaccagaccacugcagugaagucugagcacacaggaagggagaucguugaucuuaugugccaugcuaccuucacgaugcgucugcucagccccguccgggugccuaacuauaauaugauaauuauggacgaagcccacuuuacugauccggcuuccaucgcagccagaggcuacaucucaacaaggguggguaugggggaggccgcugcgauuuucaugaccgcaacccccccaggaucugucgaagccuuuccucagagcaacgcuguaauccaggacgaggaacgcgauauacccgagcgaaguuggaauuccggcuaugacuggauuacugauuucccaggcaaaacagugugguuuguuccuagcaucaagucugggaacgacauugccaauuguuugagaaaaaacggaaagcgggugauccaacugucaaggaagaccuucgauacagaguaccagaaaacuaagaacaaugacugggacuaugucgugacgaccgauauauccgaaaugggugcaaacuuccgcgccgaccguguuauugaucccagacggugccucaaaccagugauccugaaggacggcccggagagggucauccuugcugggccuaugcccgugacaguagcgagugccgcacagcgccgaggaagaauuggccggaaucagaacaaagaaggugaucaauacguguacauggggcagccacuaaauaacgacgaggaucaugcucacuggacugaggccaagaugcuguuggacaauaucaacacccccgaaggcauuauaccugcauuauuugagccagaaagggagaagagcgccgcuaucgauggagaauaucgccugagaggcgaggccaggaaaacauucguugagcucaugcggcguggggaccugcccgucuggcuuucguacaagguggcgucugaaggauuucaguauuccgaucgccgauggugcuucgacggugagagaaauaaccaggugcuggaagagaauauggaugucgaaauuuggaccaaagagggcgagaggaagaaacuccggccucgcugguuggacgcaagaacuuacagcgacccgcuggcccuaagggaauuuaaggaguucgcugccgggcggcgaucaguuaguggagaucugauccucgaaaucggcaaacuuccacaacaccugacguuaagagcucagaacgcauuggacaaucuggugaugcuccauaacucugagcagggugggaaggccuaucgccacgcuauggaagagcugcccgauaccauugagacacuuaugcugcucgccuugauagcaguacugacuggcggagugaccuuauuuuuccuauccggcaaggggcugggaaaaacaagcaucggucuccuuugugucaccgcgucaagugcccuguuguggauggcuagcguggaaccucauuggauugccgcauccaucauucuggaguuuuuccucaugguucugcuuauccccgaaccagacaggcagcggacuccucaagauaaucagcucgcuuacguggucauaggccuguuguuuaugauccugacaguagccgcaaacgagaugggguuacuagagacgaccaagaaagaccugggaauuggcuauguggccgcugaaaaccaccagcacgcgacuaugcucgauguugaccuucgucccgccucugcauggacacuguacgcuguggccaccaccgucaucacaccaaugaugagacauacuauugagaauacgaccgccaacaucagcuugacagcaauagcuaaucaagccgcgauucugaugggucucgauaagggguggccuaucuccaaaauggacauuggcgugccgcugcuugcuuuaggaugcuacucacaggucaacccccugacucucaccgccgcaguguugaugcugguugcccacuaugcuaucauaggcccagggcuacaggcaaaggccacaagggaagcgcagaagcgcaccgcugccggaaucaugaaaaauccuacuguggauggcauuguagcaaucgaccuggaucccguggucuacgacgccaaguucgagaaacaacucggucagauuaugcuucugaucuuguguacgucucagauacugcucaugcggacaaccugggcucugugcgaaaguauuacuuuagccaccgggccacuuacaacucugugggagggaucgccuggcaaguuuuggaacaccacaaucgcaguuagcauggcuaauaucuuccgagguuccuaucucgccggcgcggggcuagccuucucucugaugaaaucauugggaggcgggagaaggggaacgggcgcacagggugagacccugggggaaaaguggaagcgccaacucaaccagcuuagcaaauccgaguuuaauacuuacaagcggaguggaauuauggaaguggacagaucugaggcuaaagaaggccugaagcguggugagacaaccaaacaugccgucagcaggggcacugcaaaguugcggugguucguggagcgcaaccugguaaagcccgaagggaaagugaucgaucucggauguggccgagggggauggucauauuacugcgcuggcuuaaagaaaguuacagaggugaaggguuauaccaaagggggaccgggccacgaagagccaauaccuauggccacguacggcuggaaucuggucaagcuucauuccgggaaagacguguuuuucaugcccccagaaaagugugauacccugcuaugcgacauuggagagaguagccccaacccuacaaucgaggaagguagaacucucaggguccugaagaugguggagccgugguugaaaggcaaucaguuuuguauuaagauccugaaccccuacaugccaucuguuguagaaacccucgagcagaugcaacggaaacacgggggaaugcuugugcgcaauccucuguccagaaacucaacacacgagauguauugggucagcugcggcacugguaauauagugucggccguuaacaugaccucuaggauguuacugaaccgauucacaauggcgcaucggaagcccaccuacgaacgugauguggacuugggggcuggaacuagacacgucgcaguggagccugaaguagccaaucucgauaucauuggccagcgcaucgagaacauuaaaaaugaacauaagaguacguggcacuaugacgaggauaacccauacaagacaugggcuuaucacggcuccuacgaggugaaacccagcgggucagccuccucuaugguuaauggagucgugaggcugcuaaccaagccuugggacgugaucccaauggucacucagauugcaaugaccgauacaacgcccuuuggucaacagcggguuuucaaagaaaagguggacaccagaacuccgcgcgccaaaaggggcacaacccagaucauggagguaacugcuaaguggcuuuggggguuucugagccgaaacaagaaaccucggauauguacaagagaagaguucaccaggaaggugcgcaguaaugcggccauuggagcagucuuuguggacgaaaaccaguggaauuccgcuaaagaggccguugaggaugaacguuucugggaccucgugcaucgggagagagaacugcacaagcaaggcaaaugcgcaacaugcgucuauaacaugauggguaagagggagaagaaauugggggaauuuggaaaggccaaaggcagccgcgcuaucugguacauguggcugggcgcccgauuccucgaguucgaggcgcuuggguuuaugaaugaagaucauugguucucucgggagaacucacugaguggaguggaaggugagggcuuacacaagcugggguacaucuugagagacauuuccaaaauaccaggaggcaauauguaugcagaugacacugccgguugggauaccaggaucacggaggacgaucuccagaacgaagcuaagauuaccgacaucauggagcccgaacaugcccugcuagcaacaagcauuuuuaaacuuacuuaccagaauaagguaguucgcgugcagagaccugcuaagaacgggaccgucauggaugugaucucucggagggaccaacguggaucgggccaggugggcacauaugggcugaacacuuucaccaauauggagguccagcucauacgacagauggaaucagagggaaucuuucugccaagcgaguuggaaacgcccaacuuagccgagcgcguucuggauuggcucgaaaaacacggugcugagagacuuaagcggauggccauuuccggcgacgacugugugguaaaaccgaucgaugacagguucgcaacagcgcugaccgcccuaaaugauauggggaaggugcgcaaagacauuccucaaugggaacccaguaagggauggaacgauuggcagcaggucccauuuugcucucaccauuuccaccagcugaucaugaaggacggcagagagauagugguuccuugucggaaucaagaugagcucguggguagggcucgagucagccagggggccggaugguccuugcgugaaacugcaugccugggcaaaucauacgcucagauguggcaacuuauguauuuucauagacgcgaccugcggcucgccgcaaacgccauuuguagugcggugcccguagauuggguuccaacaucuaggaccacuuggagcauccacgcucaccaucaguggaugaccacagaggacauguuauccguguggaauagagucuggaucgaagagaaccccuggauggaagauaagacgcacgugucaagcugggaggagguuccuuaccugggcaaacgcgaagaccaguggugcgggucuuugauuggacugaccgcccgggcaacuugggccacaaauauacagguggcuaucaaccaagucaggcgacucauugguaaugagaacuaucuugacuacaugaccuccaugaagagauucaaaaaugaaagugauccagagggcgcccugugguga

SEQ ID NO: 13519 - RNA, 9879 nt, Artificial Sequence
  derived and/or modified CDS sequence (opt3) from DENV-1__FJ639819__SS-prME
agcgugaccaugcugcucaugcuucugcccaccgcauuggcuuuccacuuaacuacgaggggcggggagccucauaugaucgucuccaagcaggaaaggggaaaaucucuguuauuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggauuuucacuaccaacaucuggcuuaaauugcgugauagcuacacacagaugugcgaccaccggcucauguccgcugcaauaaaggauucaaaagccgugcaugcugacaugggauauuggauugagagugaaaagaaugagacguggaaacuggcccgagcaucuuucaucgaaguuaagaccuguacuuggccaaagagccacacacuaugguccaacggcgugcuggagucagagaugauuauccccaaaauauacgguggcccuaucagccaacauaauuauagaccaggguacuuuacccagacugcgggaccguggcaccucggcaagcuggaacuugauuucgacuugugcgaggggacaaccguagucguggaugaacacugcggaaacaggggccccucucugcgcacgacuaccgugacagguaaaauuauccaugagugguguugccgguccuguaccuuaccuccacucagauuuagaggggaagacggaugcugguacggcauggaaauucgccccgucaaggagaaagaagagaaucugguucgaaguauggugagcgccgguucuggcgaaguagauaacuucucccuugggauccugugugugucaauaaugauugaggaggucaugcggagucguuggagcagaaagauguugaugacuggaacacucgcuguguuucugcuacugaucaugggccagcucaccuggaaugaccugaucaggcuuugcauuaugguuggggccaacgcaucggaccgcaugggaaugggcacaacuuauuuggcucugauggccaccuucaagaugcggccuauguuugcaguggguuuacucuucagaaggcugacgucccgagaaguccuucugcuaacaaucgggcucucucugguggccagcguugaguugccaaacucacuggaagaguuaggagauggccucgcuaugggcauuaugaugcugaaacuucugaccgaauuucaaccccaccaguuguggacuacccuccugagucuaacauucgugaagacuacccugucccuugacuacgcguggaaaacgacagccaugguccucucuauaguaagccuguuuccguugugucuguccaccacuucacagaagacaaccugguuaccugugcuccuggggagcuucggaugcaaaccacuuacuauguuucugaucacagagaauaagauuuggggucgcaagaguuggcccuugaacgagggcaucauggcaauugggaucguuucuauacuccuguccagccuacugaaaaaugaugugccucuugcuggaccccucaucgccggcgguaugcugauugccuguuaugucaucucggggucaucugcugacuugaguuuagaaaaggcagccgagguguccugggaacaggaggcggaacauagcggagcuucucacaacauucugguagaggugcaagaugacggcaccaugaaaaucaaggaugaggaacgggacgauacgcucacuauacugcuuaaagccacccuguuggcagucagcggcguuuacccaauguccauuccugccacacuauucgugugguauuucuggcagaagaaaaagcagagaucaggggugcugugggacacccccaguccaccggaggucgaaagggcugugcucgaugacggaaucuaccguauccugcagcgcggucuuuuaggccggagccaaguugggguaggaguguuucaggauggcgucuuccauacaauguggcacgugacuagaggugcaguucugauguaucaggggaagaggcucgagccuucuugggccugcgugaaaaaggacuugauuuccuacggaggcggcuggcgauuucaggggcuguggaauaccggagaggaaguccaagugauagcgguagagcccgguaaaaacccaaagaauguccagacgacacccggcacuuucaaaaccccugaaggggaggugggagcuaucgcccucgacuuuaagccaggcacaucagguagucccauuguuaaccgggaagggaagaucgugggacuguacggcaauggcgucgugaccacuagcgggaccuauguuuccgcaauugcccaggcuaaagccucucaagagggaccucuuccggagaucgaagaugagguguucaagaaacgcaaccugacaauaauggacuugcacccagguucgggcaagacgagaagguaccuacccgcaaucguccgggaagcuauuaaacgaaagcugagaacucucaucuuagccccuacccgcgugguagcgagcgagauggccgaagcacugaaggggaugccaauuagguaucagacaaccgcugugaaaucagagcauacuggacgugagaucguugaucuuaugugucacgccacauuuaccaugcggcugcucucccccgucagagugccuaauuacaacaugauaauuauggacgaagcucauuucacggauccggcaaguaucgccgccaggggcuauaucucuacucgcguggguaugggggaggcugcggcaauuuuuaugacagccacacccccaggaagcgucgaggcuuucccucaguccaaugccguaauccaggacgaggaacgagauauacccgagagaucauggaacucuggcuacgacuggauuaccgauuuuccaggcaagacugugugguucguuccuagcaucaaaagugggaaugacauugcaaacugcuugcggaagaacggaaaaagggugauccaacugucccgcaagacauucgauaccgaguaucagaagaccaagaauaacgacugggacuacgucgugacuacggauauaagcgaaaugggugccaauuuucgugcugacagaguuauugauccccggaggugccucaagccagugauccugaaagacggcccggagcgcgucauccuugcggggccuaugcccgugaccguagccucugcagcucagcgaagaggacggauuggcaggaaccagaauaaggaaggugaucaauacguguauauggggcagccacuaaacaaugacgaggaucacgcccauuggacagaggcaaaaaugcuguuggacaacaucaauacucccgaaggcauuauaccugccuuauucgagccagaacgcgagaagucagcugccaucgauggagaauacagacugaggggcgaggcgcggaagaccuuuguugagcucaugcgucgcggggaccugcccgucuggcuuuccuauaaaguggcaagugaaggauuccaguacagcgaucgaagaugguguuuugacggugagaggaacaaucaggugcuggaagagaacauggaugucgaaauuuggacaaaggagggcgagcggaaaaagcuccgcccuagaugguuggacgccaggaccuauucggacccgcuggcucuacgggaguucaaagaguuugccgcugggcgaagaucuguuuccggagaucugauccucgaaaucggcaaacuuccacaacaccugacuuuacgcgcacagaaugccuuggacaaccuggugaugcuccacaauagcgagcagggugggaaggcuuacaggcaugccauggaggaacugcccgauacgauugagacccuuaugcugcucgcauugauagcgguacugacaggcggagugacuuuauucuuucuaucaggcaaggggcugggaaagaccaguaucggucuccuuugcgucacagccucuuccgcucuguuguggauggccagcguggaaccucacuggauugcagcuucaaucauucuggaguucuuucucaugguucugcuuauccccgaaccagaccggcagcguaccccucaagauaaccagcucgccuauguggucauaggccuguuguucaugauccugacuguagcagccaacgagaugggguuacuagagacaacgaaaaaggaccugggaauuggcuacguggcugcggaaaaucaucagcacgccaccaugcucgauguugaccuucaccccgcaagugcuuggacucuguacgccguggccacaaccgucaucaccccaaugaugagacauacaauugagaacacuacggcaaauaucagcuugaccgcuauagccaaccaagcggcuauucugaugggucucgauaaaggguggccuaucuccaagauggacauuggcgugccgcugcuugccuuaggauguuauucucaggucaauccccugacacucacugcagccguguugaugcugguugcucacuacgcaaucauaggcccagggcuacaggccaaagcgaccagggaagcucagaagcgcacagccgcaggaaucaugaagaacccuaccguggauggcauuguagccaucgaccuggaucccguggucuaugacgcuaaauuugagaagcaacucggucagauuaugcuucugaucuugugcacuagccagauacugcucaugcggacgacaugggcccugugugaauccauuaccuuagcaacugggccacuuaccacacugugggagggaucaccuggcaaauucuggaauacuaccaucgcuguuucuauggccaacaucuuccgagguaguuaccucgcgggcgccgggcuagcauuuucgcugaugaaaagccuaggaggcgggagaaggggaacaggcgcucagggugagacgcugggggaaaaauggaagcgccaacucaaucagcuuuccaagucugaguucaacaccuauaaacggucaggaauuauggaaguggacagaagcgaggccaaggaaggccugaaacguggugagacuacaaagcaugcagucuccaggggcaccgcuaaauugcggugguuuguggagcgcaaucugguaaagcccgaagggaaggugaucgaucucggaugcggccgagggggauggaguuacuauugugccggcuugaaaaagguuacugaggugaaagguuacacaaaagggggaccgggccacgaagaaccaauaccuauggccaccuacggcuggaaccuggucaaacuucauucugggaaggacguguucuuuaugcccccagaaaaaugcgauacgcugcuaugugacauuggagagagcucacccaauccuaccaucgaggaagguagaacacucaggguccugaagaugguggagccgugguugcggggcaaccaguucugcauuaagauccugaaucccuauaugccauccguuguagaaacucucgagcagaugcaacgcaaacacgggggaaugcuugugagaaacccucugaguaggaauagcacccacgagauguacugggucucuuguggcacagguaacauaguguccgcgguuaacaugacuucacgaauguuacugaaucgguuuaccauggcucaucguaagcccacauaugaaagagauguggacuugggggcaggaacccgccacgucgccguggagccugaaguagcuaaccucgauaucauuggccagaggaucgagaauauuaaaaacgaacauaagagcacuuggcacuacgacgaggauaauccauauaaaacgugggccuaccacggcucguaugaggugaagcccucugggagugcauccagcaugguuaacggagucgugcggcugcuaacaaagccuugggacgugaucccaauggucacccagauugccaugacugauaccacacccuucggucaacagagaguuuuuaaagaaaagguggacacgcgcaccccgagggcuaaacgaggcacuacacagaucauggagguaaccgcgaaguggcuuuggggguuccugucacggaauaaaaagccuagaauaugcacuagggaagaguuuacacgcaaggugcguuccaacgccgcaauuggagcugucuucguggacgaaaaucaguggaacucugccaaagaggcaguugaggaugaacgguuuugggaccucgugcauagagagagggaacugcacaagcaaggcaaaugcgccaccugugucuacaauaugauggguaagcgcgagaaaaaguugggggaguucggaaaggcuaaaggcagccgagccaucugguacauguggcugggcgcgcgguuccucgaguuugaggcacuuggguucaugaacgaagaucauugguuuaguagagaaaauucccugagcggaguggaaggugagggcuuacacaagcugggguauaucuugagggacauuucuaaaauaccaggaggcaacauguacgccgaugacacagcugguugggauacucgcaucaccgaggacgaucuccagaaugaagccaagauuacggacaucauggagcccgaacaugcacugcuagcuaccucaauuuucaaacuuacauaucagaacaagguaguuagagugcagcggccugccaaaaacgggacugucauggaugugaucaguaggcgugaccaacgaggauccggccaggugggcaccuacgggcugaauacauuuacuaacauggagguccagcucauacgccagauggaaagcgagggaaucuuccugccaucugaguuggaaacccccaauuuagcugagagaguucuggauuggcucgaaaagcacggugccgagcggcuuaagaggauggcaauuucgggcgacgacugcgugguaaaaccgaucgaugaccgcuuugcgacggcccugacagcucuaaacgauauggggaaggugagaaaagacauuccucaaugggaacccucaaagggauggaaugauuggcagcaggucccauucuguagccaccauuuucaccagcugaucaugaaagacggccgggagauagugguuccuugcaggaaccaagaugagcucgugggucgagcccgugucucccagggggcaggauggaguuugagagaaaccgcuugucugggcaagucuuaugcccagauguggcaacuuauguacuuccaucgccgggaccugaggcucgcagccaaugcgauuugcagcgcugugcccguagauuggguuccaacuuccagaacaaccuggucaauccacgcccaccaucaguggaugacuaccgaggacauguuaaguguguggaaccgcgucuggaucgaagagaaucccuggauggaagauaagacacacgugucuagcugggaggagguuccuuaucugggcaaacgggaagaccagugguguggguccuugauuggacugacggcaagggccaccugggcuacuaacauacagguggccaucaaucaaguccgaagacucauugguaacgagaauuaccuugacuacaugacaucaaugaagcgguuuaaaaacgaaagcgauccagagggcgcacugugguga

SEQ ID NO: 13520 - RNA, 9879 nt, Artificial Sequence
  derived and/or modified CDS sequence (opt3) from DENV-1__FJ639820__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacuuaucuggcuuuaauggccaccuuuaaaaugcgcccuauguucgcagugggucuccuguuucggagacuuacgucuagggagguccugcuacucacaaucgggcugagcuugguggccucaguugaacugccaaacaguuuagaggaacucggagacggccuggcuaugggcauuaugaugcuuaagcuguugaccgaguuccaaccccaccagcucuggacuacccugcuaucccugacauuugugaaaacuacccuuucucucgauuacgcguggaagacgacagccaugguccugagcauaguauccuuguucccgcuguguuuaucaaccacuagccagaaaacaaccuggcucccugugcugcuugggaguuuuggaugcaagccacugacuauguucuugaucacagaaaacaagauuuggggucgaaaaucuuggccccucaaugagggcaucauggcaauugggaucguuuccauacugcuaagcucgcugcuuaagaacgacgugccucucgcuggaccccugaucgccggcgguauguugauugccuguuaugucaucucagggucuagugcugauuuaucccuggagaaagcagccgaagugagcugggagcaggaagcggagcauucuggagcuagccacaauauucucguagaagugcaagacgauggcaccaugaagaucaaagacgaggagcgcgaugacacgcugacuauacuucugaaggccaccuugcuagcagucuccggcguuuacccaaugucaauuccugccacacuguuugugugguauuucuggcagaaaaagaagcagcggaguggggugcucugggauacccccagcccaccggaagucgagagagcugugcuggacgauggaaucuacaggauccuucagcgugguuuacugggccgcucucaaguugggguaggaguguuccaggacggcgucuuucauacaauguggcacgugacucggggugcaguucucauguaucaggggaaaagauuggaaccuuccugggccucagugaagaaagaccugauuaguuacggaggcggcuggagguuccaggggagcuggaacaccggagaggagguccaagugauagcgguagaacccgguaagaauccaaaaaacguccagacgacacccggcacuuuuaagaccccugagggggaagugggagcuaucgcccucgauuucaagccaggcacauccgguucucccauuguuaaucgagaggggaaaaucgugggacuguacggcaacggcgucgugaccacuucggggaccuauguuagcgcaauugcccaggcuaaggccucacaagaaggaccucuuccggagaucgaggacgaaguguuuaaaaagcggaaucugacaauaauggauuugcacccagguuccggcaaaacgcgcagauaccuacccgcaaucgucagggaggcuauuaagcggaagcugcgaacucucaucuuagccccuaccagagugguagcgagugaaauggccgaggcacugaaagggaugccaauucgcuaucagacaaccgcugugaagucugaacauacuggaagggagaucguugaccuuaugugccacgccacauucaccaugcgucugcucagccccguccgggugccuaacuacaauaugauaauuauggaugaggcucauuuuacggacccggcauccaucgccgccagaggcuauaucucaacuaggguggguaugggggaagcugcggcaauuuucaugacagccacccccccaggaucugucgaggcuuuuccucagagcaacgccguaauccaggaugaagagcgcgacauacccgaacgaaguuggaauuccggcuacgauuggauuaccgacuucccaggcaaaacugugugguuuguuccuagcaucaagucugggaacgauauugcaaauuguuugagaaaaaacggaaagcgggugauccaacugucaaggaagacauucgacaccgaguaucagaaaacaaagaacaaugacugggauuacgucgugacuacggacauauccgagaugggugccaacuuccgcgcugaucguguuauugaccccagacggugccucaaaccagugauccugaaggauggcccggaaagggucauccuugcggggccuaugcccgugaccguagccagugcagcucagcgccgaggaagaauuggccggaaucagaacaaagagggugaccaauacguguauauggggcagccacuaaauaacgaugaagaccacgcccauuggacagaggcaaagaugcuguuggauaauaucaacacucccgagggcauuauaccugccuuauuugaaccagagagggaaaagagcgcugccaucgacggagaguaccgccugagaggcgaagcgaggaaaaccuucguugagcucaugcggcguggggaucugcccgucuggcuuucguauaagguggcaucugagggauuucaguacuccgaccgccgauggugcuucgauggugaaagaaauaaccaggugcuggaggaaaauauggacgucgagauuuggacaaaagaaggcgagaggaagaaacuccggccucgcugguuggacgccagaaccuauagcgauccgcuggcucuaagggaguuuaaggaauucgccgcugggcggcgaucaguuaguggagaccugauccucgagaucggcaaacuuccacaacaccugacuuuaagagcacagaacgccuuggauaaucuggcuaugcuccacaacucugaacagggugggaaggccuaccgccaugcaauggaggaacugcccgacacgauugagacccuuaugcugcucgcguugauagccgugcugacaggcggaguaacuuuauuuuuccuauccggcaaggggcugggaaaaaccagcaucggucuccuuugugugacagcuucaagugcccuguuguggauggcaagcgucgagccucacuggauugcugccuccaucauucuggaauuuuuccucauggugcugcuuauccccgagccagauaggcagcggaccccucaagacaaucagcucgcauauguugugauaggccuguuguuuaugauccugacugucgccgcuaacgaaaugggguuacuagagacaacgaagaaagaucugggaauuggcuacguagcggccgagaaccaucagcacgcaaccaugcucgacguggaucuucgucccgcuucugccuggacucuguacgccguugcaacaaccgugaucaccccaaugaugagacacacaauugaaaauacuacggcuaacaucagcuugaccgccauagcgaaucaagcugccauucugaugggucucgacaagggguggccuaucuccaaaauggauauuggcgucccgcugcuugcauuaggaugcuauucacaggugaacccccugacacucacugccgcugucuugaugcugguggcacauuacgccaucauaggcccagggcuacaggcgaaggcuaccagggaggcccagaagcgcacagcagccggaaucaugaaaaauccuaccguugacggcauuguggcuaucgaucuggaccccguaguguaugacgccaaguucgaaaaacaacucggucagauuaugcuucugaucuuguguacuucucagauacugcucaugcggacgacaugggcacugugcgagaguauuaccuuagcuacugggccacuuaccacacugugggaaggaucgccuggcaaguuuuggaacacuaccaucgccgucagcauggcgaauaucuuccgagguuccuaccucgccggcgcagggcuagcuuucucucugaugaaaucauugggaggcgggagaaggggaacaggcgcccagggugagacgcugggggagaaguggaagcgccaacucaaccagcuuagcaaauccgaauuuaauaccuauaagcggaguggaauuauggagguugauagaucugaagcaaaagagggccugaagcguggugaaacuacaaaacacgcugugagcaggggcaccgccaaguugcggugguucgucgagcgcaaccuggugaagcccgaggggaaaguaaucgaccucggauguggccgagggggauggucauacuauugcgccggcuuaaagaaagugacugaaguuaaggguuacacaaaagggggaccgggccaugaggaaccaauaccuauggcgaccuacggcuggaaucuggugaagcuucacuccgggaaagaugucuuuuucaugcccccagagaagugugacacgcugcuaugcgauauuggagaaaguagccccaacccuaccaucgaggaggguagaacacucagggugcugaagauggucgaaccgugguugaaaggcaaucaguuuuguauuaagauccugaaccccuauaugccaucugugguugagacucucgaacagaugcaacggaaacaugggggaaugcuuguacgcaauccucuguccagaaacucaacccacgagauguacugggugagcugcggcacagguaauauagucucggcugugaacaugacuucuaggauguuacugaaccgauucaccauggcacaccggaagcccacauaugagcgugacguugauuugggggccggaaccagacauguggcugucgaaccugagguggccaaucucgacaucauuggccagcgcaucgaaaacauuaaaaaugagcacaagaguacuuggcauuacgaugaagacaacccauauaagacgugggcauaccacggcuccuaugagguaaaacccagcgggucagccuccucuauggugaauggaguugucaggcugcuaacaaagccuugggaugugaucccaauggugacccagauugcuaugacugacaccacacccuuuggucaacagcgggucuucaaagagaagguugacacgagaaccccgcgcgcgaaaaggggcacuacacagaucauggaagugaccgccaaguggcuuuggggguuucugagccgaaacaagaaaccucggauauguacuagagaggaauucacaaggaagguacgcaguaaugcagcuauuggagccguguuugucgaugagaaccaguggaauuccgcaaaagaagccguggaggacgagcguuucugggaucucguucaccgggaaagagagcugcauaagcaaggcaaaugcgcuaccugcguguacaacaugauggguaagagggaaaagaaauugggggaguuuggaaaggccaaaggcagccgcgcgaucugguacauguggcugggcgcacgauuccucgaauucgaggcccuuggguuuaugaaugaggaccacugguucucucgggaaaacucacugaguggagucgagggugaaggcuuacauaagcugggguauaucuugagagauauuuccaaaauaccaggaggcaauauguacgcugacgauacagccgguugggacacuaggaucaccgaggaugaccuccagaacgaggcaaagauuacggauaucauggaacccgagcacgcucugcuagccaccagcauuuuuaaacuuacauaucagaauaaggugguacgcguucagagaccugcuaagaacgggacugugauggacgucaucucucggagggaucaacguggaucgggccaggugggcaccuacgggcugaacacauucacuaauauggaagugcagcucauacgacagauggagucagaaggaaucuuucugccaagcgaguuggagacccccaacuuagccgaacgcguccuggacuggcucgagaaacauggugcagaaagacuuaagcggauggcgauuuccggcgacgauuguguugugaaaccgaucgacgauagguucgccacggcucugacagcccuaaaugacauggggaagguacgcaaagauauuccucaaugggagcccaguaagggauggaacgacuggcagcaggugccauuuugcucucaccacuuccaucagcugaucaugaaggauggcagagaaauagucgugccuugucggaaucaagacgagcucguugguagggcacgagugagccagggggcuggaugguccuugcgugagaccgccugccugggcaaaucauaugcacagauguggcaacuuauguacuuucacagacgcgaucugcggcucgccgcgaacgcuauuuguagugccguccccguggacuggguaccaacuucuaggacaaccuggagcauccaugcacaccaccaguggaugacuaccgaagauauguuauccguuuggaauagaguguggaucgaggaaaaccccuggauggaggacaagacacaugucucaagcugggaagaggugccuuaucugggcaaacgcgaggaccaguggugcgggucuuugauuggacugacggcccgggcuaccugggccacuaauauacagguugcaaucaaccaagugaggcgacucauugguaaugaaaacuaccuugauuacaugacauccaugaagagauucaaaaaugagagugacccagaaggcgcucugugguga

SEQ ID NO: 13521 - RNA, 9879 nt, Artificial Sequence
  derived and/or modified CDS sequence (opt3) from DENV-1__FJ639821__SS-prME
agcgccaccaugcugcucaugcuucugcccacagcuuuggcauuccacuuaacuacgaggggaggggaaccucauaugaucguguccaagcaggaaaggggaaaaucucugcuauuuaagaccucagccggugucaacaugugcacccucauugcgauggaccugggagaacuuugugaagauacuaugaccuacaaaugcccacggauaacagaagcugaaccggacgauguugacuguuggugcaaugccaccgauacuugggugacauaugggaccuguagucaaacgggagaacaccgccgagaaaagcguagcguagcacuggccccacaugugggcuugggucucgaaacuagaaccgaaacauggauguccucugaaggggcuuggaaacagauccagagggucgagacuugggcacugcggcacccuggauucaccgugauugccuuuuuccuggcucaugccaucggcacaucgauuacccagaagggcaucauauuuauccucuuaaugcugguuacgccaucaauggcgaugcgcugcguggggauuggaaacagagacuucgucgagggucuuagcggcgcaacuuggguggauguaguuuuggaacacgggaguugugugacaaccauggccaagaauaaacccacucuggacaucgagcuacucaagacagaagucaccaacccugcugugcugaggaaacuuugcauugaggccaagaucuccaauacgaccacagauucucgguguccaacucaaggagaagcaacccugguggaggagcaggacgcuaacuuugucugccgccgaacauucguugauagaggcugggguaauggguguggauuguuuggcaaaggcagccuccugacuugcgccaaguucaagugcgugaccaaauuagaagggaagauaguacaguacgagaaccugaaauauuccgugauugucacagugcacaccggagaccagcaucaaguugguaaugaaacuacggagcacggcacaaucgcgaccauuacuccccaggccccuaccucagaaauccagcucacagauuacggggcacuuacccuggacuguaguccaaggacuggauuggacuuuaacgagauggugcuacugacaaugaaggagaaaagcuggcucguccauaagcagugguuccuggaucuuccgcugcccuggacgucuggcgcuuccaccucacaagaaacuuggaaucggcaggacuugcucgugacauuuaaaaccgcccacgcuaagaagcaggagguaguugugcuggguagccaagaaggggccaugcacacagcauuaacuggcgccaccgagauccagacgaguggaaccacaacuauuuucgcuggccaucugaaaugccgucuaaagauggauaaacucacccugaaggggaugucuuaugucauguguacaggauccuucaaacuugaaaaggagguggcggagacucagcacgguaccgucuuggugcagguucgcuacgaaggcacggacgcaccuugcaagauaccauuuagcacacaagaugagaaaggggugacccagaacggaagacugaucacugccaaucccauuguaacagacaaggaaaaaccugucaacaucgagaccgagccacccuucggcgaaucguauauagugguuggugcuggggagaaggcccucaaacugucuugguuuaagaggggcuccucaauuggaaagauguucgaagcaacugcccggggcgcucgacgcauggccauccuuggggauaccgcaugggacuuuggaaguaucgguggcguguucacaagcgucgggaaacuggugcaucagguauuuggaacggcguacggcguguuguucuccgguguuucuuggaccaugaagauugggaucggcauucuccugacuugguuaggacugaauagcagaucaacaagucuauccaugaccuguauagcugucggcauggugacacucuaccugggggugaugguccaggccgauagcggaugcguuaucaacuggaaaggcagggagcuuaagugugguucugggauuuuugugacuaacgaagugcacaccuggacggagcaauauaaauuccaggcagacucaccgaagcgguugagugccgcuaucggaaaggccugggaggaaggcguaugcgguauccgcagcgcaacaagacuggagaauauuauguggaaacagauauccaacgaacucaaucauauccuguuagagaacgauaugaaguuuaccgucgugguuggcgacgcuaaugggauucuggcccagggcaagaagaugaucaggccucaacccauggaacacaaauacucuuggaagucguggggcaaagcgaagauuaucggggccgacauacagaacacuaccuucaucauugauggaccagacacaccugagugucccgauggccagcgugcuuggaauaucugggagguggaagacuaugguuuugggauuuucacuaccaacaucuggcuuaaguugcgggauagcuacacacagaugugcgaccaccgacucauguccgcagccauaaaagauucaaaggcuguccaugccgacaugggauauuggauugagagugagaaaaaugagacguggaagcuggcaagagcgucuuucaucgaagugaaaaccuguacuuggccaaagagccacacacuaugguccaacggcguucuggagucagagaugauuauccccaagauauacgguggcccuaucagccaacauaauuauaggccaggguacuacacccagacugccggaccguggcaccucggcaaacuggaacuugauuuugacuugugcgaggggacaaccgugguagucgaugaacacugcggaaaccgcggccccucucugcggacgacuaccgugacagguaagauuauccaugagugguguugcagauccuguaccuuaccuccacucagguuccgcggggaggacggaugcugguauggcauggaaauucgacccgugaaagagaaggaagagaaucugguccggaguaugguuagcgcugguucuggcgaaguggauaacuuuucccuugggauccuguguguaucaauaaugauugaggaggugaugcguaguagauggagcaggaaaauguugaugacuggaacacucgccgucuuccugcuacugaucaugggccagcucaccuggaaugaccugauccgccuuugcauuauggugggggcaaacgcuucggacggaaugggcauggguacaacuuacuuggcccugauggcaaccuuuaagaugcggccuauguucgccguuggguuacucuuuagaaggcugacgucccgagaagugcuucugcuaacaaucggacucucucuggucgcuagcguggaguugccaaacucacuggaagaguuaggcgauggccucgcgauggggauuaugaugcugaaacuucugaccgaguuccaaccccaccaguuguggacuacccuccugagucuaacauuuguuaaaacuacccugucccuugacuaugccuggaagacgacagcaauggugcucucuauagucagccuguucccguugugucuguccaccacuucacagaaaacaaccugguuaccuguacuccugggcagcuuugguugcaagccacuuacuauguuccugaucacagagaauaaaauuuggggccgcaagaguuggcccuugaacgaggggaucauggcuauuggaaucgugucuauacuccuguccagccuacugaagaaugauguuccucuugccggcccccucaucgccggugggaugcugauugcuuguuacgugaucucgggaucaucugcagacuugaguuuagauaaagccgcggaagucuccugggagcaggaagcugagcauagcggcgccucucacaacauuagcguggaaguacaagacgauggcaccaugaagaucaaagacgaggagcgggaugacacgcugacuauacuccugaaggcaacccuucuggccguguccggggucuauccaaugucaauuccugcuacauuguuuguuugguacuucuggcagaaaaagaaacagagaaguggagugcuaugggauacccccagcccaccggaaguggagagggcaguccuggacgaugguaucuaucguauccuccagcgcggccugcuugggcggucucaagugggaguuggcguauuccaggacgguguguuucauacaauguggcacgucacuagaggggccguguuaauguaccagggaaagaggcuggaaccuuccugggcgugcguuaagaaagaccucauuucauacggcggcggguggcgauuccagggaaguuggaauaccggugaggaggugcaagucauagcuguggaacccggcaagaaccccaaaaauguacagacgacacccgggacuuuuaagaccccugagggagaagucggcgccaucgcauuggauuucaaaccagguacaagcgggucccccauugugaaccgggagggaaagaucguuggccuguauggcaaugggguggucaccacuucuggaaccuacgugucggccauugcucaggccaaggcaagccaagaagguccucucccggagaucgaggacgaaguuuuuaaaaagcgcaaccugacaauaauggaucuucacccaggcucagggaaaacgagaagguaucugcccgcuaucgugcgggaggccauuaagcgaaaauugagaacucuaauccuggcgccuacccgcgucguggccuccgaaauggcagaggcucucaagggaaugccaauuagguaccagacaaccgccguaaagagugaacauacuggccgugagaucguggacuuaaugugucacgcuacauucaccaugcggcugcuuucucccguuagagucccuaauuauaacaugauaauuauggaugaggcacauuuuacggacccggccagcaucgccgcuagggguuacaucuccacucgcguggggaugggagaagcggcagccauuuucaugacagcuacacccccaggcucaguggaggccuuuccucagucuaaugcagucauccaggaugaagaacgagacauacccgaaagaagcuggaacaguggcuaugauuggauuaccgacuucccagggaaaacuguaugguuugugccuuccaucaagagcggaaaugauauugccaacugccugcggaaaaacgguaagaggguuauccaacucucucgcaaaacauucgacaccgaguaccagaagacaaagaauaacgacugggauuacguggucacuacggacauaucagagaugggcgcuaauuuccgugcggauagagugauugacccccggaggugcuugaaaccaguuauccugaaggaugggccggaacgcgugauccucgccggaccuaugcccgucaccguggcauccgcugcccagcgaagaggccggauugguaggaaccagaauaaagagggggaccaauauguauacaugggccagccacugaacaaugaugaagaccacgcacauuggacagaggccaagaugcuucuagauaacaucaauacucccgagggaauuauaccugcucuguuugaaccagagcgcgagaaaagugccgcgaucgacggcgaguauagauugagaggggaagcacggaagaccuucguggaguuaaugcgucgcggagaucugcccguuuggcucagcuacaaggucgccucggaggguuuucaguauucugaccgaagaugguguuucgauggcgaaaggaacaaucaggugcuggaggaaaacauggacguggagauuuggacaaaagaaggggagcggaagaaacuucgcccuagauggcuggacgcuaggaccuacuccgauccgcucgccuugcgggaguuuaaggaguucgcugcaggacgaagaagcgucucaggcgaccugauccuagagaucgguaaacugccacaacaccucacucuucgcgcccagaaugcucuggauaacuuaguuauguugcacaauagugaacaagggggaaaggccuauaggcaugcaauggaggaacugcccgacacgauugagacccucaugcugcuugcgcugauagccgugcucacaggaggcguaacuuuguuuuuccugucugggaaaggauuagguaagaccuccaucggccuacugugcgugacagcuagcucagcccuccuuuggauggcaagugucgagccucacuggauugcugccagcaucauucuggaauuuuucuugauggugcugcucauccccgagccagaucggcagcguaccccucaggacaaccagcuggcauacguugugauagggcuucucuuuaugauccugacugucgccgcuaacgaaaugggauugcuggagacaacgaagaaagauuuaggcauugguuacguagcggccgagaaucaucagcacgcaaccaugcuagacguggaucugcaccccgcuuccgccuggacucucuaugccguugcaacaaccgugaucaccccaaugaugagacauacaauugaaaacacuacggcuaauaucucucuuaccgccauagcgaaccaagcugccauucugaugggguuggacaagggcuggccuaucagcaaaauggauauuggagucccgcugcucgcacugggcuguuacucccaggugaauccccuuacauuaacugccgcuguccugaugcucguggcacacuaugccaucauagggccaggauugcaggcgaaggcuaccagggaggcccagaaacgcacagcagccggcaucaugaagaacccuaccguugacgguauuguggcuaucgaucuggaccccguaguguacgacgucaaguucgaaaaacaacuagggcagauuaugcugcucauccuuugcacuucacagauacuguugaugcggacgacaugggcccugugugagucuauuacccucgcaacuggaccacugaccacauuaugggaaggcaguccugguaaguuuuggaauacuaccaucgcuguuucgauggccaacaucuuccgaggcagcuaucuugcgggggccggacuggcauucucccucaugaaaucucuaggcgggggaagaaggggcacaggugcucagggggagacgcugggagagaaguggaaacgccaauugaaucagcugucaaagagcgaauuuaacaccuacaagcgguccggcauuauggagguggauagaagugaagccaaagagggucucaagcguggcgaaacuacaaaucaugcagucucuagggggaccgcuaaacuucggugguucguggagcgcaaccugguaaagcccgagggaaaagugaucgacuugggcugcgggcgaggaggcuggagcuauuacugugccggucugaagaagguuacugaagugaaaggguacacaaagggaggcccgggccacgaggaaccaauaccuauggccaccuauggguggaaucucgucaaauuacauucaggaaaggauguguuuuucaugcccccagagaaaugcgacacgcugcuuugugauauuggugaauccagucccaacccuaccaucgaggagggcagaacacugaggguccuaaagaugguggaaccguggcuccgggggaaucaguuuugcauuaaaauccugaaccccuacaugccaagcguuguagagacuuuggaacagaugcaacgcaagcacggaggcaugcuggugagaaauccucucucuaggaacuccacccacgagauguauugggucucaugugguacagggaacauagugagcgcgguuaauaugacuucgcgaaugcuucugaaccgguucaccauggcucaucguaagcccacauacgagagagacguggauuuaggagcaggcacccgccacgucacuguggaaccugagguagccaaucuggacaucauuggccagaggaucgaaaacauuaaaaaugagcauaagucuacguggcacuaugaugaagacaacccauacaaaacaugggcuuaucacgggaguuacgaggugaagcccuccggaagcgccucauccaugguuaauggugucgugcgguugcucaccaaaccuugggaugugaucccaauggucacucagauugcaaugaccgacacaacgcccuuuggccaacagagaguuuucaaggagaagguggacacccgcacuccgagggccaaacgagggacaacccagaucauggaaguaacugcuaaguggcuguggggauuucuaucucggaacaaaaagccuagaauaugcacaagggaggaguucacccgcaaagugcguagcaaugcggccauuggcgcagucuuuguggaugagaaccaguggaauagugcuaaggaagccguugaggacgagcgguucugggaucuugugcauagagaaagggagcugcacaagcaagguaaaugcgcaacaugugucuacaacaugauggggaagcgcgagaaaaagcucggagaguuuggcaaagccaagggcucccgagcuaucugguauauguggcugggggcccgguucuuggaguucgaggcgcugggauuuaugaaugaggaccauugguucagcagagaaaacucucucucagguguggagggcgaagggcuucacaagcugggauacaucuuaagggauauuaguaaaauaccaggcgguaauauguaugcagacgauacugccgggugggacacccgcaucacggaggaugaccugcagaacgaggcuaagauuaccgauaucauggaacccgagcaugccuugcucgcaacauccauuuuuaaacugacuuaccagaacaagguaguuagagugcagcggccugcuaaaaauggaaccgucauggacgugaucagcaggcgugaucaacgaggcucuggccagguggggacauauggacuaaacacuuucaccaauauggaaguccagcuuauacgccagauggagucggaagguaucuuucugccaucagagcucgagacgcccaaccuggccgaaagaguuuuggacugguuagagaagcacggcgcugaacggcugaaaaggauggccauuagcggggacgauugcgugguaaagccgaucgacgaucgcuucgcaacagcgcucaccgcccuuaaugacaugggaaaggugagaaaagauauuccucaaugggagcccuccaagggcuggaacgacuggcagcaggucccauuuuguagucaccauuuccaccagcugaucaugaaagauggucgggaaauagugguuccuugcaggaaucaagacgagcuaguggggcgagcucgugucucucagggagccggcuggagccugagagagacugcaugucucggcaaguccuacgcucagauguggcaauugauguauuuucaucgccgggaucugaggcuugccgcaaacgccauuugcucagcggugcccguagacuggguuccaacaaguagaaccacuuggucuauccacgcucaccaucaguggaugaccacagaagauaugcugagcguguggaaucgcgucuggaucgaggaaaaccccuggauggaggacaaaacgcacguguccucaugggaagagguuccuuaccucgggaagcgggaggaccagugguguggcagcuuaauuggucugaccgccagggcaacuugggccacaaauauacagguggcuaucaaccaaguccgaagauugauuggcaaugaaaacuaccuggauuauaugaccucuaugaagcgguucaaaaaugaguccgacccagaaggggcccucugguga

SEQ ID NO: 13522 - RNA, 9879 nt, Artificial Sequence
  derived and/or modified CDS sequence (opt3) from DENV-1__FJ639824__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacuuaucuggcuuuaauggccaccuuuaaaaugcgcccuauguucgcagugggucuccuguuucggagacuuacgucuagggagguccugcuacucacaaucgggcugagcuugguggccucaguugaacugccaaacaguuuagaggaacucggagacggccuggcuaugggcauuaugaugcuuaagcuguugaccgaguuccaaccccaccagcucuggacuacccugcuaucccugacauuugugaaaacuacccuuucucucgauuacgcguggaagacgacagccaugguccugagcauaguauccuuguucccgcuguguuuaucaaccacuagccagaaaacaaccuggcucccugugcugcuugggaguuuuggaugcaagccacugacuauguucuugaucacagaaaacaagauuuggggucgaaaaucuuggccccucaaugagggcaucauggcaauugggaucguuuccauacugcuaagcucgcugcuuaagaacgacgugccucucgcuggaccccuggucgccggcgguauguugaucgccuguuaugugauuucagggucuagugcugauuuaucccuggagaaagcagccgaaguaagcugggagcaggaagcggagcauucuggagcuagccacaauauccucguggaaguccaagacgauggcaccaugaagauuaaagacgaggagcgcgaugacacgcugacuauccuucugaaggccaccuugcuagcaguuuccggcguguacccaaugucaauaccugccacacuguuugugugguauuucuggcagaaaaagaagcagcggagugggguccucugggauacccccagcccaccggaaguggagagagcuguucuggacgauggaauuuacaggauccuucagcgugguuuacugggccgcucucaaguaggggugggagucuuccaggacggcguguuucauacaauguggcacguuacucggggugcagugcucauguaucaggggaaaagauuggaaccuuccugggccucagucaagaaagaccugaucaguuacggaggcggcuggagguuccaggggagcuggaacaccggagaggaggugcaaguaauugcggucgaacccgguaagaauccaaaaaacgugcagacgacacccggcacuuuuaagaccccugagggggaaguuggagcuauagcccucgauuucaagccaggcacauccgguucucccaucgugaaucgagaggggaaaauugucggacuguacggcaacggcgugguuaccacuucggggaccuaugugagcgcaaucgcccaggcuaaggccucacaagaaggaccucuuccggagauugaggacgaagucuuuaaaaagcggaaucugacaaucauggauuugcacccagguuccggcaaaacgcgcagauaccuacccgcaauagugagggaggcuaucaagcggaagcugcgaacucucauuuuagccccuaccagaguaguggcgagugaaauggccgaggcacugaaagggaugccaauccgcuaucagacaaccgcuguuaagucugaacauacuggaagggagauugucgaccuuaugugccacgccacauucaccaugcgucugcucagccccgugcgggugccuaacuacaauaugaucauaauggaugaggcucauuuuacggacccggcauccauugccgccagaggcuauaucucaacuagggucgguaugggggaagcugcggcaaucuucaugacagccacccccccaggaucuguagaggcuuuuccucagagcaacgccgugauucaggaugaagagcgcgacauccccgaacgaaguuggaauuccggcuacgauuggauaaccgacuucccaggcaaaacuguuugguuugugccuagcauuaagucugggaacgauaucgcaaauuguuugagaaaaaacggaaagcgggucauucaacugucaaggaagacauucgacaccgaguaucagaaaacaaagaacaaugacugggauuacgugguuacuacggacaucuccgagaugggugccaacuuccgcgcugaucgugugauagaccccagacggugccucaaaccagucauucugaaggauggcccggaaagggugauccuugcggggccuaugcccguaaccguggccagugcagcucagcgccgaggaagaaucggccggaaucagaacaaagagggugaccaauacguuuauauggggcagccacuaaauaacgaugaagaccacgcccauuggacagaggcaaagaugcuguuggauaauauuaacacucccgagggcaucauuccugccuuauuugaaccagagagggaaaagagcgcugccauagacggagaguaccgccugagaggcgaagcgaggaaaaccuucgucgagcucaugcggcguggggaucugcccguguggcuuucguauaagguggcaucugagggauuucaguacuccgaccgccgauggugcuucgauggugaaagaaauaaccagguccuggaggaaaauauggacguugagaucuggacaaaagaaggcgagaggaagaaacuccggccucgcugguuggacgccagaaccuauagcgauccgcuggcucuaagggaguuuaaggaauucgccgcugggcggcgaucagugaguggagaccugauucucgagaucggcaaacuuccacaacaccugacuuuaagagcacagaacgccuuggauaaucugguaaugcuccacaacucugaacagggugggaaggcuuaccgccaugccauggaggaacugcccgacacgaucgagacccuuaugcugcucgcauugauugcggugcugacaggcggagucacuuuauuuuuccuauccggcaaggggcugggaaaaaccagcauaggucuccuuugugugacagccucaagugcucuguuguggauggccagcguugagccucacuggaucgcagcuuccauuauccuggaauuuuuccucauggugcugcuuauucccgagccagauaggcagcggaccccucaagacaaucagcucgccuaugucguaaucggccuguuguuuaugauacugacuguggcagccaacgaaaugggguuacuagagacaacgaagaaagaucugggaaucggcuacguugcugcggagaaccaucagcacgccaccaugcucgacguggaucuucgucccgcaucugcuuggacucuguacgccgucgccacaaccgugauuaccccaaugaugagacacacaaucgaaaauacuacggcaaacauuagcuugaccgcuaucgccaaucaagcggcuauacugaugggucucgacaagggguggccuauuuccaaaauggauaucggcgucccgcugcuugccuuaggaugcuauucacaggugaacccccugacacucacugcagccguuuugaugcugguggcucauuacgcaauuaucggcccagggcuacaggccaaggcgaccagggaggcucagaagcgcacagccgcaggaauaaugaaaaauccuaccguagacggcaucguggccauugaucuggaccccgucguuuaugacgcuaaguucgaaaaacaacucggucagaucaugcuucugauuuuguguacuucucagauccugcucaugcggacgacaugggcccugugcgagaguauaaccuuagcaacugggccacuuaccacacugugggaaggaucgccuggcaaguuuuggaacacuaccauugcugugagcauggccaauaucuuccgagguuccuaccucgcgggcgccgggcuagcauucucucugaugaaaucauugggaggcgggagaaggggaacaggcgcucagggugagacgcugggggagaaguggaagcgccaacucaaccagcuuagcaaauccgaauuuaauaccuauaagcggaguggaaucauggaggucgauagaucugaagccaaagagggccugaagcguggugaaacuacaaaacacgcagugagcaggggcaccgcuaaguugcggugguucguagagcgcaaccuggugaagcccgaggggaaaguuauugaccucggauguggccgagggggauggucauacuauugcgccggcuuaaagaaagugacugaagucaaggguuacacaaaagggggaccgggccaugaggaaccaaucccuauggccaccuacggcuggaaucuggugaagcuucacuccgggaaagaugucuuuuucaugcccccagagaagugugacacgcugcuaugcgauauaggagaaaguagccccaacccuaccauugaggaggguagaacacucagggugcugaagaugguugaaccgugguugaaaggcaaucaguuuuguaucaagauucugaaccccuauaugccaucuguaguggagacucucgaacagaugcaacggaaacaugggggaaugcuuguccgcaauccucuguccagaaacucaacccacgagauguacugggugagcugcggcacagguaauaucguuucggcggugaacaugacuucuaggauguuacugaaccgauucaccauggcucaccggaagcccacauaugagcgugacgucgauuugggggcaggaaccagacauguggccguagaaccugagguggcuaaucucgacauaaucggccagcgcauugaaaacaucaaaaaugagcacaagaguacuuggcauuacgaugaagacaacccauauaagacgugggccuaccacggcuccuaugagguuaaacccagcgggucagcauccucuauggucaauggaguggugaggcugcuaacaaagccuugggaugucauuccaaugguuacccagaucgccaugacugacaccacacccuuuggucaacagcggguguucaaagagaagguagacacgagaaccccgcgcgcuaaaaggggcacuacacagauuauggaagugaccgcgaaguggcuuuggggguuucugagccgaaacaagaaaccucggaucuguacuagagaggaauucacaaggaagguccgcaguaaugccgcaauaggagcuguguuuguugaugagaaccaguggaauuccgccaaagaagcaguggaggacgagcguuucugggaucucguccaccgggaaagagagcugcauaagcaaggcaaaugcgccaccugcguguacaacaugauggguaagagggaaaagaaauugggggaguuuggaaaggcuaaaggcagccgcgccauuugguacauguggcugggcgcgcgauuccucgaauucgaggcacuuggguuuaugaaugaggaccacugguucucucgggaaaacucacugaguggaguagagggugaaggcuuacauaagcugggguauaucuugagagauaucuccaaaauuccaggaggcaauauguacgccgacgauacagcugguugggacacuaggauaaccgaggaugaccuccagaacgaggccaagaucacggauauuauggaacccgagcacgcacugcuagcuaccagcaucuuuaaacuuacauaucagaauaagguugugcgcguccagagaccugccaagaacgggacugugauggacgugauuucucggagggaucaacguggaucgggccaggucggcaccuacgggcugaacacauucacuaauauggaaguucagcucauccgacagauggagucagaaggaauauuucugccaagcgaguuggagacccccaacuuagcugaacgcgugcuggacuggcucgagaaacauggugccgaaagacuuaagcggauggcaaucuccggcgacgauuguguagugaaaccgauugacgauagguucgcgacggcccugacagcucuaaaugacauggggaagguccgcaaagauaucccucaaugggagcccaguaagggauggaacgacuggcagcaggugccauuuugcucucaccacuuccaucagcugauuaugaaggauggcagagaaaucguugugccuugucggaaucaagacgagcucgucgguagggcccgagugagccagggggcaggaugguccuugcgugagaccgcuugccugggcaaaucauaugcccagauguggcaacuuauguacuuucacagacgcgaucugcggcucgcagccaacgcgauauguagugcuguacccguugacugggugccaacuucuaggacaaccuggagcauucaugcccaccaccaguggaugacuaccgaagauauguuauccgucuggaauagaguguggaucgaggaaaaccccuggauggaggacaagacacauguuucaagcugggaagaggugccuuaucugggcaaacgcgaggaccaguggugcgggucuuugaucggacugacggcacgggccaccugggcuacuaauauucaggucgccauaaaccaagugaggcgacucaucgguaaugaaaacuaccuugauuacaugacauccaugaagagauucaaaaaugagagugacccagaaggcgcacugugguga

SEQ ID NO: 13523 - RNA, 9879 nt, Artificial Sequence
  derived and/or modified CDS sequence (opt3) from DENV-1__JN819425__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaagcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuacgguggcccuauaagccaacauaauuauagaccaggguacuuuacccagacugcgggaccguggcaccucggcaagcuggaacuugauuucgacuugugcgaggggacaaccgucgugguggaugaacacugcggaaacaggggccccucucugcgcacgacuaccgucacagguaaaaucauucaugagugguguugccgguccuguaccuuaccuccacucagauuuaggggggaggacggaugcugguacggcauggaaauccgccccguuaaggagaaagaagagaaucuggugcgaaguaugguaagcgccgguucuggcgaaguggauuccuucucacuugggauucugugugucaguaucaugauagaggaggugaugcggagccguuggucgagaaagauguugaugacuggaacacucgcuguuuuucugcuacugauuaugggccagcucaccuggaacgaccugaucaggcuuugcaucauggugggggccaaugcauccgaccgcaugggaaugggcacaacuuauuuggcucugauggccaccuucaagaugcggccuauguuugcagucgguuuacucuucagaaggcugacgucucgagaagugcuucugcuaacaauugggcucagccugguugccucaguggaguugccaaacagucuggaagaguuaggagauggccucgcuaugggcaucaugaugcugaaacuucugaccgaauuucaaccccaccaguuguggacuacccuccugucccuaacauucgucaagacuacccugucucuugacuacgcguggaaaacgacagccaugguacucagcauugugucccuguuuccguugugucugucaaccacuagccagaagacaaccugguuaccuguucuccuggggaguuucggaugcaaaccacuuacuauguuucugauaacagagaacaagaucuggggucgcaagucuuggcccuugaaugagggcauuauggcaaucgggauuguguccauccuccugagcucgcuacugaaaaacgaugucccucuugcuggaccccucauagccggcgguaugcugaucgccuguuaugugauuucagggucuagugcugacuuguccuuagaaaaggcaguaaaaaucagcugggagcaggaagccgagcauucuggagcgagccacaauauucugguggaaguccaagaugacggcaccaugaagaucaaagaugaggagcgggacgauacgcucacuauacugcuuaaggcuacccuguuggccguuuccggcguguacccaaugucaauuccugcaacacuauucgugugguauuucuggcagaaaaagaagcagagaagugggguccugugggacacccccagcccaccggaaguggagagggccguucucgaugacggaaucuaccguauccugcagcgcggucuuuuaggccggucucaaguaggggugggagucuuucaggauggcguguuccauacaauguggcacguuacuagaggugcugugcugauguaucaggggaaaaggcucgaaccuuccugggcaucagucaagaaagacuugauuaguuacggaggcggcuggcgauuucaggggagcuggaacaccggagaggaggugcaaguaauagccgucgaacccgguaagaauccaaaaaacgugcagacgacacccggcacuuucaagaccccugagggggaaguuggagcgaucgcucuggacuuuaagccaggcacauccgguucucccauugugaaucgggaggggaaaaucgucggacucuacggcaacggcgugguuaccacuucggggaccuaugugagcgccauugcacaggccaaggcuucacaagaaggaccucugccggagaucgaggaugaagucuucaaaaagcgcaaucuuacaauaauggaccugcacccagguuccggcaaaacgagaagguacuugcccgccaucgugcgggaggcaauuaagcgaaagcuaagaacucugauccucgcuccuacccgcguaguggccagugaaauggcggaggccuuaaaagggaugccaauuagguaucagacaaccgcaguuaagucugaacauacuggacgugagaucgucgaucugaugugccacgcuacauuuaccaugcggcuucugagccccgugagagugccuaacuacaauaugauaauuauggacgaggcccauuucacggauccggcuuccaucgcagccaggggcuauaucucaacucgcgucgguaugggggaagccgcugcgauuuuuaugacagcaacccccccaggaucuguagaggccuucccucagagcaacgcugugauccaggacgaagagcgagauauacccgaaagaaguuggaauuccggcuacgacuggauuaccgauuuuccaggcaaaacuguuugguucgugccuagcaucaagucugggaacgacauugccaauugucuccggaaaaacggaaagagggucauccaauugucacgcaagacauucgauaccgaguaucagaaaacaaagaacaaugacugggacuacgugguuacuacggauauauccgagaugggugcaaacuuucgugccgacagagugauugauccccggaggugccugaaaccagucauccucaaggacggcccggaacgcgugauccuggcugggccuaugcccguaaccguggcgagugccgcacagcgaagaggacggauuggcaggaaucagaacaaagagggugaucaauacguuuauauggggcagccacuuaauaacgacgaagaucacgcucauuggacagaggccaagaugcuacuggacaauaucaacacucccgagggcauuauaccugcauuguucgaaccagagcgcgaaaagagcgccgcuaucgauggagaguacagauuaaggggcgaagcccggaaaaccuuugucgagcugaugcgucgcggggaccuccccguguggcugucguauaagguggcgucugagggauuccaguacuccgaucgaagauggugcuuugacggugaaaggaauaaccagguccuugaggaaaauauggauguugagauuuggacaaaagaaggcgagcggaagaaacugcgcccuagauggcucgacgcaaggaccuauagcgacccguuggcccugcgggaguucaaggaauuugcugccgggcgaagaucagugaguggagaucuaauccuggagaucggcaaacucccacaacaccuuacucugcgcgcucagaacgcauuagacaauuugguaaugcugcacaacucugaacagggugggaaggccuacaggcaugcuauggaggaacuccccgauacgauugagacccugaugcuucuggcccucauagcaguguugacaggcggagucacucuguucuuuuuauccggcaaggggcuaggaaaaaccagcaucggucugcucugugugacagcgucaagugcccuucuguggauggcuagcguugagccucacuggauugccgcauccaucauuuuggaauucuuucugauggugcuccugauccccgagccagaccggcagcguaccccucaagauaaucagcuugcuuaugucguaauaggccuccuguucaugaucuugacuguggccgcaaacgaaauggggcuguuagagacaacgaagaaagaccuaggaauuggcuacguugccgcugagaaccaucagcacgcgaccaugcuggauguggaccuccaccccgccucugcauggacucuuuacgcugucgccacaaccgugaucaccccaaugaugagacauacaauugaaaauacuacggccaacaucagccugaccgcaauagcuaaucaagccgcgauuuugaugggucuggauaagggguggccuaucuccaaaauggacauuggcgucccgcuccuggcucuuggaugcuauucacaggugaaccccuuaacacugacugccgcaguucucauguugguggcccacuacgcuaucauaggcccagggcugcaggcaaaggccaccagggaggcgcagaagcgcacagcugccggaaucaugaaaaauccuaccguagauggcauuguggcaaucgaccuagaucccgucguuuaugacgccaaguuugaaaaacaacugggucagauuaugcuccuuauccuguguacuucucagauauugcugaugcggacgacaugggcucucugcgagaguauuacccuggccacugggccauuaaccacacuuugggaaggaucgccuggcaaguucuggaacacuaccaucgcagugagcauggcuaauaucuuccgagguuccuaccuggccggcgcggggcucgccuuuucucuaaugaaaucacugggaggcgggagaaggggaacaggcgcacagggugagacguugggggagaaguggaagcgccaacugaaccagcucagcaaauccgaauucaauaccuauaagcggaguggaauuauggaggucgacagaucugaagcuaaagagggccuuaagcguggugaaacuacaaaacaugccgugagcaggggcaccgcaaagcugcggugguuuguagagcgcaacuuggugaagcccgaggggaaaguuaucgaucugggauguggccgagggggauggucauacuauugcgcuggccucaagaaagugacugaagucaaggguuacacaaaagggggaccgggccacgaggaaccaauaccuauggccaccuacggcuggaauuuagugaagcugcauuccgggaaagacgucuucuuuaugcccccagagaagugugauacgcuucugugcgacauuggagaaaguagccccaacccuaccaucgaggaggguagaacacuaagggugcucaagaugguugaaccguggcugcggggcaaucaguucuguauuaaaaucuugaaccccuauaugccaucuguaguggagacucuggaacagaugcaacgcaagcacgggggaaugcucgucagaaauccucuuuccaggaacucaacccacgagauguacugggugagcugcggcacagguaauauaguuucggccgugaacaugacuucucgaaugcuguuaaaccgguuuaccauggcgcaucguaaacccacauaugagagagaugucgaccugggggcuggaacccgccacguggcaguagaaccugagguggccaauuuggauaucauuggccagaggaucgaaaacauuaagaaugagcauaaaaguacuuggcacuacgacgaagauaacccauauaagacgugggcuuaccacggcuccuaugagguuaagcccagcgggucagccuccucuauggucaauggaguggugcggcuccugacaaaaccuugggacgucaucccaaugguuacccagauugcaaugacugauaccacacccuucggucaacagagaguguuuaaggagaaaguagacacgcgcaccccgagggccaagcgaggcacuacacagaucauggaagugaccgcuaaauggcuauggggguuccuuagccggaacaagaagccuagaauauguacuagggaggaauuuacacgcaaaguccguaguaaugcggccauuggagcaguguucguugacgagaaccaguggaauuccgcuaaggaagccguggaggaugagcgguuuugggaccugguccauagagaaagggagcuccacaaacaaggcaagugcgcaaccugcguguacaacaugauggguaaacgcgaaaagaagcugggggaguucggaaaagccaagggcagccgagcuaucugguacaugugguugggcgcccgguuccuggaauuugaggcgcucggguucaugaaugaggaucauugguuuucuagagaaaacucacuuaguggaguagagggugaaggccugcacaaauuaggguauauccugagggacauuuccaagauaccaggaggcaauauguacgcagaugacacagccgguugggauacucgcaucaccgaggacgauuugcagaacgaggcuaaaauuacggacaucauggaacccgagcaugcccuccuggcaaccagcauuuucaagcuaacauaucagaauaaaguugugagaguccagcggccugcuaagaacgggacugugauggaugugaucucuaggcgugaccaacgaggaucgggccaggucggcaccuacgggcuuaacacauuuacuaauauggaaguucagcugauacgccagauggagucagaaggaaucuuccucccaagcgagcuggagacccccaacuuggccgaaagagcuuuagauuggcuggagaagcacggugccgaacggcucaaaaggauggcaauuuccggcgacgacugugugguaaagccgaucgaugaccgcuuugcgacggcccuuacagcucugaaugauauggggaaagugagaaaggacauuccucaaugggagcccaguaaaggauggaacgauuggcagcaggucccauucugcucucaccauuuucaccagcuaaucaugaaggacggccgggaaauagugguuccuuguaggaaucaagaugagcuggugggucgagcccgugucagccagggggcaggauggucccucagagagaccgcuugcuugggcaagucauaugcccagauguggcaacugauguacuuccaucgccgggaccuuaggcuggcagccaacgcgauuuguagugcugugcccguagauuggguuccaacuucuagaacaaccuggagcauccacgcccaccaucaguggaugacuaccgaagacaugcucuccguguggaaucgcgucuggaucgaggaaaaccccuggauggaggauaaaacacacgugucaagcugggaagagguuccuuauuuaggcaagcgggaggaccaguggugcgggucucugauuggauugacggcaagggccaccugggcuacuaauauacagguggccaucaaccaaguccgaagacugauugguaaugaaaacuaccucgacuacaugacauccaugaaacgguuuaagaaugagagugauccagaaggcgcacuuugguga

SEQ ID NO: 13524 - RNA, 9879 nt, Artificial Sequence
  derived and/or modified CDS sequence (opt3) from DENV-1__FJ850099__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacuuaucuggcuuuaauggccaccuuuaaaaugcgcccuauguucgcagugggucuccuguuucggagacuuacgucuagggagguccugcuacucacaaucgggcugagcuugguggccucaguugaacugccaaacaguuuagaggaacucggagacggccuggcuaugggcauuaugaugcuuaagcuguugaccgaguuccaaccccaccagcucuggacuacccugcuaucccugacauuugugaaaacuacccuuucucucgauuacgcguggaagacgacagccaugguccugagcauaguauccuuguucccgcuguguuuaucaaccacuagccagaaaacaaccuggcucccugugcugcuugggaguuuuggaugcaagccacugacuauguucuugaucacagaaaacaagauuuggggucgaaaaucuuggccccucaaugagggcaucauggcaauugggaucguuuccauacugcuaagcucgcugcuuaagaacgacgugccucucgcuggaccccugaucgccggcgguauguugauugccuguuaugucaucucagggucuagugcugauuuaucccuggagaaagcagccgaagugagcugggagcaggaagcggagcauucuggagcuagccacaauauucucguagaagugcaagacgauggcaccaugaagaucaaagacgaggagcgcgaugacacgcugacuauacuucugaaggccaccuugcuagcagucuccggcguuuacccaaugucaauuccugccacacuguuugugugguauuucuggcagaaaaagaagcagcggaguggggugcucugggauacccccagcccaccggaagucgagagagcugugcuggacgauggaaucuacaggauccuucagcgugguuuacugggccgcucucaaguugggguaggaguguuccaggacggcgucuuucauacaauguggcacgugacucggggugcaguucucauguaucaggggaaaagauuggaaccuuccugggccucagugaagaaagaccugauuaguuacggaggcggcuggagguuccaggggagcuggaacaccggagaggagguccaagugauagcgguagaacccgguaagaauccaaaaaacguccagacgacacccggcacuuuuaagaccccugagggggaagugggagcuaucgcccucgauuucaagccaggcacauccgguucucccauuguuaaucgagaggggaaaaucgugggacuguacggcaacggcgucgugaccacuucggggaccuauguuagcgcaauugcccaggcuaaggccucacaagaaggaccucuuccggagaucgaggacgaaguguuuaaaaagcggaaucugacaauaauggauuugcacccagguuccggcaaaacgcgcagauaccuacccgcaaucgucagggaggcuauuaagcggaagcugcgaacucucaucuuagccccuaccagagugguagcgagugaaauggccgaggcacugaaagggaugccaauucgcuaucagacaaccgcugugaagucugaacauacuggaagggagaucguugaccuuaugugccacgccacauucaccaugcgucugcucagccccguccgggugccuaacuacaauaugauaauuauggaugaggcucauuuuacggacccggcauccaucgccgccagaggcuauaucucaacuaggguggguaugggggaagcugcggcaauuuucaugacagccacccccccaggaucugucgaggcuuuuccucagagcaacgccguaauccaggaugaagagcgcgacauacccgaacgaaguuggaauuccggcuacgauuggauuaccgacuucccaggcaaaacugugugguuuguuccuagcaucaagucugggaacgauauugcaaauuguuugagaaaaaacggaaagcgggugauccaacugucaaggaagacauucgacaccgaguaucagaaaacaaagaacaaugacugggauuacgucgugacuacggacauauccgagaugggugccaacuuccgcgcugaucguguuauugaccccagacggugccucaaaccagugauccugaaggauggcccggaaagggucauccuugcggggccuaugcccgugaccguagccagugcagcucagcgccgaggaagaauuggccggaaucagaacaaagagggugaccaauacguguauauggggcagccacuaaauaacgaugaagaccacgcccauuggacagaggcaaagaugcuguuggauaauaucaacacucccgagggcauuauaccugccuuauuugaaccagagagggaaaagagcgcugccaucgacggagaguaccgccugagaggcgaagcgaggaaaaccuucguugagcucaugcggcguggggaucugcccgucuggcuuucguauaagguggcaucugagggauuucaguacuccgaccgccgauggugcuucgauggugaaagaaauaaccaggugcuggaggaaaauauggacgucgagauuuggacaaaagaaggcgagaggaagaaacuccggccucgcugguuggacgccagaaccuauagcgauccgcuggcucuaagggaguuuaaggaauucgccgcugggcggcgaucaguuaguggagaccugauccucgagaucggcaaacuuccacaacaccugacuuuaagagcacagaacgccuuggauaaucuggugaugcuccacaacucugaacagggugggaaggcuuaccgccaugccauggaggaacugcccgacacgauugagacccuuaugcugcucgcauugauagcgguacugacaggcggagugacuuuauuuuuccuauccggcaaggggcugggaaaaaccagcaucggucuccuuugugucacagccucaagugcucuguuguggauggccagcguggagccucacuggauugcagcuuccaucauucuggaauuuuuccucaugguucugcuuauccccgagccagauaggcagcggaccccucaagacaaucagcucgccuauguggucauaggccuguuguuuaugauccugacuguagcagccaacgaaaugggguuacuagagacaacgaagaaagaucugggaauuggcuacguggcugcggagaaccaucagcacgccaccaugcucgacguugaucuucgucccgcaucugcuuggacucuguacgccguggccacaaccgucaucaccccaaugaugagacacacaauugaaaauacuacggcaaacaucagcuugaccgcuauagccaaucaagcggcuauucugaugggucucgacaagggguggccuaucuccaaaauggauauuggcgugccgcugcuugccuuaggaugcuauucacaggucaacccccugacacucacugcagccguguugaugcugguugcucauuacgcaaucauaggcccagggcuacaggccaaggcgaccagggaggcucagaagcgcacagccgcaggaaucaugaaaaauccuaccguggacggcauuguagccaucgaucuggaccccguggucuaugacgcuaaguucgaaaaacaacucggucagauuaugcuucugaucuuguguacuucucagauacugcucaugcggacgacaugggcccugugcgagaguauuaccuuagcaacugggccacuuaccacacugugggaaggaucgccuggcaaguuuuggaacacuaccaucgcuguuagcauggccaauaucuuccgagguuccuaccucgcgggcgccgggcuagcauucucucugaugaaaucauugggaggcgggagaaggggaacaggcgcucagggugagacgcugggggagaaguggaagcgccaacucaaccagcuuagcaaauccgaauuuaauaccuauaagcggaguggaauuauggagguggauagaucugaagccaaagagggccugaagcguggugaaacuacaaaacacgcagucagcaggggcaccgcuaaguugcggugguucguggagcgcaaccugguaaagcccgaggggaaagugaucgaccucggauguggccgagggggauggucauacuauugcgccggcuuaaagaaaguuacugaagugaaggguuacacaaaagggggaccgggccaugaggaaccaauaccuauggccaccuacggcuggaaucuggucaagcuucacuccgggaaagauguguuuuucaugcccccagagaagugugacacgcugcuaugcgauauuggagaaaguagccccaacccuaccaucgaggaggguagaacacucaggguccugaagaugguggaaccgugguugaaaggcaaucaguuuuguauuaagauccugaaccccuauaugccaucuguuguagagacucucgaacagaugcaacggaaacaugggggaaugcuugugcgcaauccucuguccagaaacucaacccacgagauguacugggucagcugcggcacagguaauauagugucggcgguuaacaugacuucuaggauguuacugaaccgauucaccauggcucaccggaagcccacauaugagcgugacguggauuugggggcaggaaccagacaugucgccguggaaccugagguagcuaaucucgacaucauuggccagcgcaucgaaaacauuaaaaaugagcacaagaguacuuggcauuacgaugaagacaacccauauaagacgugggccuaccacggcuccuaugaggugaaacccagcgggucagcauccucuaugguuaauggagucgugaggcugcuaacaaagccuugggaugugaucccaauggucacccagauugccaugacugacaccacacccuuuggucaacagcggguuuucaaagagaagguggacacgagaaccccgcgcgcuaaaaggggcacuacacagaucauggaaguaaccgcgaaguggcuuuggggguuucugagccgaaacaagaaaccucggauauguacuagagaggaauucacaaggaaggugcgcaguaaugccgcaauuggagcugucuuuguggaugagaaccaguggaauuccgccaaagaagcaguugaggacgagcguuucugggaucucgugcaccgggaaagagagcugcauaagcaaggcaaaugcgccaccugcgucuacaacaugauggguaagagggaaaagaaauugggggaguuuggaaaggcuaaaggcagccgcgccaucugguacauguggcugggcgcgcgauuccucgaauucgaggcacuuggguuuaugaaugaggaccacugguucucucgggaaaacucacugaguggaguggagggugaaggcuuacauaagcugggguauaucuugagagauauuuccaaaauaccaggaggcaauauguacgccgacgauacagcugguugggacacuaggaucaccgaggaugaccuccagaacgaggccaagauuacggauaucauggaacccgagcacgcacugcuagcuaccagcauuuuuaaacuuacauaucagaauaagguaguucgcgugcagagaccugccaagaacgggacugucauggacgugaucucucggagggaucaacguggaucgggccaggugggcaccuacgggcugaacacauucacuaauauggaaguccagcucauacgacagauggagucagaaggaaucuuucugagcuccgaguuggagaccccaaacuuagcugaacgcguucuggacuggcucgagaaacauggugccgaaagacuuaagcggauggcaauuaguggcgacgauugugugguaaaacccaucgacgauagguucgcgacggcccugacagcucuaaaugacauggggaaggugcgcaaagauauuccgcaaugggagccuucuaagggauggaacgacuggcagcagguccccuuuugcagccaccacuuccaucagcugaucaugaaggauggcagagaaauagugguuccaugucggaaucaagacgagcucguggguagggcccgagucucccagggggcaggauggucauugcgugagaccgcuugccugggcaaaaguuaugcccagauguggcaacuuauguacuuucacagacgcgaucugcggcucgcagccaacgcgauuuguucugcugugccuguagacuggguucccacuagcaggacaaccugguccauccaugcccaccaccaguggaugacuaccgaagauauguuaucaguguggaauagagucuggaucgaggaaaacccauggauggaggacaagacacaugugagcucuugggaagagguucccuaucugggcaaacgcgaggaccaguggugcggguccuugauuggacugacggcacgggccaccugggcuacuaauauacagguggccaucaaccaagucaggcgacucauugguaaugaaaacuaccuugauuacaugacaaguaugaagagauucaaaaaugagagcgacccugaaggcgcacugugguga

SEQ ID NO: 13525 - RNA, 9879 nt, Artificial Sequence
  derived and/or modified CDS sequence (opt3) from DENV-1__FJ850100__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacucaccuggcuuuaauggccaccuuuaaaaugcgcccuauguucgcagugggucuccuguuucggagacuuacgucuagggagguccugcuacucacaaucgggcugagcuugauggccucaauggaacugccaaacaguuuagaggaacucggagacggccuggcuaugggcauuaugaugcuuaagcuguugaccgaguuccaaccccaucagcucuggacuacccugcuaucccugacauuugugaaaacuacccuuucucucgauuaugcguggaagacgacagccaugauacugagcaucguuuccuuguucccgcuguguuuaucaaccacuagccagaaaacaaccuggcucccugugcugcuugggaguuuuggaugcaagccacugacuauguucuugauuacagaaaacaagaucuggggucgaaaaucuuggccccucaaugagggcauuauggcaaucgggauagucuccauccugcuaagcucgcugcuuaagaacgacguaccucucgcuggaccccugauugccggcgguauguugaucgccuguuacgugauuucagggucuagugcugauuuaucccuggagaaagcagccgaaguuagcugggagcaggaagcggagcacucuggagcuagccauaauauccucguggaaguccaagacgauggcaccaugaagauaaaagacgaggagcgcgaugacacgcugacuauucuucugaaggccaccuugcuagcaguguccggcguauauccaaugucaaucccugccacacuguuugugugguacuucuggcagaaaaagaagcagcggagugggguccucugggauacccccagcccaccggaaguugagagagcugugcuggacgauggaaucuauaggauucuucagcgugguuuacugggccgcucucaagugggggucggaguguuccaggacggcguuuuucacacaauguggcacguaacucggggugcagugcucauguaccaggggaaaagauuggaaccuuccugggccucagucaagaaagaccugauaaguuauggaggcggcuggagguuccaggggagcuggaacaccggagaggaggugcaaguuaucgcgguggaacccgguaagaauccaaaaaacguccagacgacacccggcacuuuuaagaccccugagggggaagugggagcuauugcccucgauuucaagccaggcacauccgguucucccaucguaaaucgagaggggaaaauugucggacuguacggcaacggcgugguuaccacuucggggaccuacgugagcgcaaucgcccaggcuaaggccucacaagaaggaccucuuccggagauagaggacgaagucuuuaaaaagcggaaucugacaaucauggauuugcauccagguuccggcaaaacgcgcagauaucuacccgcaauugugagggaggcuaucaagcggaagcugcgaacucucauuuuagccccuaccagaguuguggcgagugaaauggccgaggcacugaaagggaugccaauccgcuaccagacaaccgcugucaagucugaacacacuggaagggagauaguggaccuuaugugccaugccacauucaccaugcgucugcucagccccguacgggugccuaacuauaauaugauuaucauggaugaggcucacuuuacggacccggcauccaucgccgccagaggcuacauuucaacuaggguugguaugggggaagcugcggcaaucuucaugacagccacccccccaggaucugucgaggcuuuuccucagagcaacgccgugauacaggaugaagagcgcgacauucccgaacgaaguuggaauuccggcuaugauuggaucaccgacuucccaggcaaaacugugugguuugucccuagcauuaagucugggaacgauaucgcaaauuguuugagaaaaaacggaaagcggguaauacaacugucaaggaagacauucgacaccgaguaccagaaaacaaagaacaaugacugggauuaugugguuacuacggacauuuccgagaugggugccaacuuccgcgcugaucgugugaucgaccccagacggugccucaaaccagucauccugaaggauggcccggaaagggugauucuugcggggccuaugcccguuaccguggccagugcagcucagcgccgaggaagaaucggccggaaucagaacaaagagggugaccaauacgucuacauggggcagccacuaaauaacgaugaagaccaugcccacuggacagaggcaaagaugcuguuggauaauauuaacacucccgagggcauaaucccugccuuauuugaaccagagagggaaaagagcgcugccauugacggagaguaucgccugagaggcgaagcgaggaaaaccuucguggagcucaugcggcguggggaucugcccguauggcuuucguacaagguggcaucugagggauuucaguauuccgaccgccgauggugcuucgauggugaaagaaauaaccagguucuggaggaaaauauggacgucgagaucuggacaaaagaaggcgagaggaagaaacuccggccucgcugguuggacgccagaaccuacagcgauccgcuggcucuaagggaguuuaaggaauucgccgcugggcggcgaucagugaguggagaccugauccucgagauuggcaaacuuccacaacaccugacuuuaagagcacagaacgccuuggauaaucuggugaugcuccauaacucugaacagggugggaaggcuuaucgccacgccauggaggaacugcccgacacgauagagacccuuaugcugcucgcauugaucgcgguccugacaggcggaguuacuuuauuuuuccuauccggcaaggggcugggaaaaaccagcauuggucuccuuugugugacagccucaaguacccuguuguggauggcuagcguagagccucauuggaucgccgcauccauuauccuggaauuuuuccucauggugcugcuuauacccgagccagauaggcagcggacuccucaagacaaucagcucgcuuacgucgugaucggccuguuguuuaugauucugacaguugccgcaaacgaaaugggguuacuagagacgaccaagaaagaucugggaaucggcuauguggccgcugagaaccaccagcacgcgacuaugcucgacgucgaucuucgucccgccucugcauggacacuguacgcuguagccaccaccgugauuacaccaaugaugagacauacuaucgaaaauacgaccgccaacauaagcuugacagcaauugcuaaucaagccgcgauccugaugggucucgacaagggguggccuauuuccaaaauggauaucggcguuccgcugcuugcuuuaggaugcuacucacaggugaacccccugacucucaccgccgcagucuugaugcugguggcccacuaugcuauaaucggcccagggcuacaggcaaaggccacaagggaggcgcagaagcgcaccgcugccggaauuaugaaaaauccuacugucgacggcaucguggcaauugaucuggaccccguuguguacgacgccaaguucgaaaaacaacucggucagaucaugcuucugauauuguguacgucucagauucugcucaugcggacaaccugggcucugugcgagaguaucacuuuagccaccgggccacuuacaacucugugggaaggaucgccuggcaaguuuuggaacaccacaaucgcaguaagcauggcuaauauuuuccgagguuccuaucucgccggcgcggggcuagccuucucucugaugaaaucauugggaggcgggagaaggggaacgggcgcacagggugagacccugggggagaaguggaagcgccaacucaaccagcuuagcaaauccgaauuuaauacuuacaagcggaguggaaucauggagguggauagaucugaagcuaaagagggccugaagcguggugaaacaaccaaacaugccgucagcaggggcacugcaaaguugcggugguucguugagcgcaaccuggugaagcccgaggggaaagucauagaccucggauguggccgagggggauggucauauuacugcgcuggcuuaaagaaagugacagaaguaaaggguuauaccaaagggggaccgggccacgaggaaccaauuccuauggccacguacggcuggaaucuggugaagcuucauuccgggaaagauguuuuuuucaugcccccagagaagugugacacccugcuaugcgauaucggagaaaguagccccaacccuacaauugaggaggguagaacucucagggugcugaagauggucgaaccgugguugaaaggcaaucaguuuuguaucaagauacugaaccccuacaugccaucuguggucgagacccucgaacagaugcaacggaaacacgggggaaugcuugugcgcaauccucuguccagaaacucaacacacgagauguauuggguuagcugcggcacugguaauaucguaucggccgugaacaugaccucuaggauguuacugaaccgauucacaauggcgcaucggaagcccaccuacgagcgugacgucgauuugggggcuggaacuagacacguggcaguugaaccugagguggccaaucucgacauuaucggccagcgcauugaaaacaucaaaaaugagcauaagaguacguggcacuaugaugaagacaacccauacaagacaugggcuuaucacggcuccuacgaggucaaacccagcgggucagccuccucuauggugaauggaguagugaggcugcuaaccaagccuugggauguuauuccaauggucacucagaucgcaaugaccgacacaacgcccuuuggucaacagcggguguucaaagagaagguggacaccagaacuccgcgcgccaaaaggggcacaacccagauaauggaagucacugcuaaguggcuuuggggguuucugagccgaaacaagaaaccucggauuuguacaagagaggaauucaccaggaagguucgcaguaaugcggccaucggagcaguguuuguagaugagaaccaguggaauuccgcuaaagaagccguggaggacgagcguuucugggaucucguccaucgggaaagagagcugcacaagcaaggcaaaugcgcaacaugcguguauaacaugauggguaagagggaaaagaaauugggggaguuuggaaaggccaaaggcagccgcgcuaucugguacauguggcugggcgcccgauuccucgaauucgaggcgcuuggguuuaugaaugaggaccauugguucucucgggaaaacucacugaguggaguugagggugaaggcuuacacaagcugggguacauuuugagagauauauccaaaaucccaggaggcaauauguaugcagacgauacugccgguugggacaccaggauuacggaggaugaccuccagaacgaggcuaagaucaccgauauuauggaacccgagcaugcccugcuagcaacaagcaucuuuaaacuuacuuaccagaauaaggugguccgcgugcagagaccugcuaagaacgggaccguaauggacguuauaucucggagggaucaacguggaucgggccaggugggcacauaugggcugaacacuuucaccaauauggaaguccagcucauccgacagauggagucagaaggaauuuuucugccaagcgaguuggagacgcccaacuuagccgaacgcgugcuggacuggcucgagaaacacggugcugaaagacuuaagcggauggccaucuccggcgacgauuguguggucaaaccgauugacgauagguucgcaacagcgcugaccgcccuaaaugacauggggaagguucgcaaagauaucccucaaugggagcccaguaagggauggaacgacuggcagcaggugccauuuugcucucaccauuuccaccagcugauaaugaaggauggcagagaaauuguagugccuugucggaaucaagacgagcucgucgguagggcucgagugagccagggggccggaugguccuugcgugagacugcaugccugggcaaaucauacgcucagauguggcaacuuauguauuuucauagacgcgaucugcggcucgccgcaaacgccaucuguagugcgguucccguggacugggucccaacaucuaggaccacuuggagcauccacgcucaccaucaguggaugaccacagaagauauguuauccguguggaauagaguauggauugaggaaaaccccuggauggaggacaagacgcacguuucaagcugggaagaggugccuuaccugggcaaacgcgaggaccaguggugcgggucuuugauaggacugaccgcccgggcaacuugggccacaaauauccaggucgcuauuaaccaagugaggcgacucaucgguaaugaaaacuaucuugauuacaugaccuccaugaagagauucaaaaaugagagugacccagaaggcgcccugugguga

SEQ ID NO: 13526 - RNA, 9879 nt, Artificial Sequence
  derived and/or modified CDS sequence (opt3) from DENV-1__FJ882579__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagauuucguggagggucuuagcggcgcgacuuggguagacguuguguuggagcacgggaguugugucacaaccauggcaaagaauaaacccacucuggauaucgaacuacucaagacagaggugaccaacccugccgugcugaggaaacuuugcauugaagcuaagaucuccaauacgaccacagacucucgguguccaacucaaggagaggccacccuggucgaagagcaggaugcaaacuuuguuugccgccgaacauucguggacagaggcugggguaauggguguggauuguuuggcaaaggcagccuccugacuugcgcuaaguucaagugcguaaccaaauuagaggggaagauagugcaguacgaaaaccugaaauauuccgucauugugacaguucacaccggagaucagcaucaaguggguaaugagacuacggaacacggcacaaucgccaccauuacuccccaggcgccuaccucagagauccagcucacagacuacggggcccuuacccuggacuguaguccaaggacuggauuggauuuuaacgaaaugguccuacugacaaugaaggagaaaagcuggcucgugcauaagcagugguuccuggaccuuccgcugcccuggacgucuggcgcauccaccucacaagagacuuggaaucggcaggauuugcucguaacauuuaaaaccgcucacgccaagaagcaggaaguugugguccuggguagccaagagggggcuaugcacacagccuuaacuggcgcaaccgaaauccagacgaguggaaccacaacuauuuucgccggccaucugaaaugccgucuaaagauggacaaacucacccugaaggggaugucuuaugugauguguacaggauccuucaaacuugagaaggaagucgcugagacucagcacgguaccguguugguucaggugaaguacgagggcacggaugcgccuugcaaaauaccauuuagcacacaagacgaaaaggggguaacccagaacggacgccugaucacugcaaaucccauugucacagauaaagagaagccugugaacaucgaaaccgagccacccuucggcgagucguauauaguugugggugccggggaaaaagcucucaagcugucuugguuuaagaaaggcuccucaauuggaaagauguucgaggccacugcaagaggcgccaggcggauggcuauccuuggggacaccgccugggauuuuggaaguaucgguggcgucuucacaagcguggggaaacugguacaucagguguuuggaacggcauacggcguuuuguucuccggugucucuuggaccaugaagauugggaucggcauucuccugacuugguuaggacugaauagccgaucaacaagucuauccaugaccuguauagcggugggcauggugacacucuaccugggggucaugguucaggcugacagcggaugcgugaucaacuggaaaggccgcgaacuuaagugugguucugggauuuuugugacuaacgagguacacaccuggacggaacaauauaaguuccaggccgauucaccgaaaagauugagugcagccaucggaaaggcuugggaggagggcgucugcgguaucaggagcgccacacggcuggaaaauauuauguggaaacagauauccaacgagcucaaucauauccuguuagaaaacgacaugaaguuuaccgugguugugggcgacgcaaaugggauucugacucagggaaaaaagaugauccgcccucaacccauggagcacaaauacucuuggaagucguggggcaaggcuaaaauuaucggggccgauauacagaacaccacauucaucauugacggaccagauacuccugaaugucccgacggccagagagcguggaauaucugggaggucgaggauuaugguuuugggauuuucaccacaaacaucuggcuuaaguugagggacagcuacacgcagaugugcgaucaccgucucauguccgccgcuauaaaagacucaaaggcagugcaugccgauaugggauauuggauugaaagugagaaaaaugaaaccuggaagcuggcucgggccucuuucaucgagguuaagacuuguacauggccaaaaagccacacccuaugguccaacggcgugcuggaaucagagaugauuauccccaagauauacgguggcccuaucagccaacauaauuaucgaccaggguacuuuacucagacagcaggaccguggcaccucggcaaacuggagcuugacuucgauuugugcgaagggaccacgguagucguggacgagcacugcggaaacagaggccccucucugaggacuaccacagugaccgguaagauuauccaugaaugguguugccgcuccuguacuuuaccuccacuccgguuuagaggggaggauggaugcugguacggcauggagauuaggcccgucaaagaaaaggaggaaaaucugguucgcaguauggugagcgcggguucuggcgagguagacuccuucucacuugggauccugugugugaguauaaugauugaagaggucaugcgaagccgguggucgcguaagauguugaugacaggaacccucgccguguuucugcuacugaucaugggccagcucacauggaacgaccugaucagacuuugcauuaugguuggggcuaaugccuccgauaggaugggaaugggcacuaccuauuuggcacugauggcuacguucaaaaugcgcccuauguuugccguggguuuacucuuccggagacugacaucuagggagguccuucugcuaaccaucgggcucagccugguggcaucaguugaauugccaaacagucuggaggaauuaggagacggccucgccaugggcauuaugaugcugaagcuucugacugaguuucaaccccaccaguuguggaccacacuccugucccuaacuuucgugaaaaccacgcugucucuugauuacgcuuggaagacaaccgcgaugguccucagcauaguaucccuguuuccguugugucugucaacuacaagccagaaaaccacuugguuaccugugcuccuggggaguuucggaugcaagccacuuacaauguuucugaucaccgaaaacaagauuuggggucgaaaaucuuggcccuugaaugagggcaucauggccauugggaucguuuccauacuccugagcucgcuacugaagaacgacgugccucuugcaggaccccucaucgcuggcgguaugcugauugccuguuaugucaucucagggucuagugccgauuuguuacuggagaaagcugcagaaguguccugggagcaggaagccgagcauagcggagcgucucacaauauucucguagaagugcaagacgauggcacgaugaagaucaaagacgaggagcgcgaugacacucugaccauacuucugaaggcuacauugcuagccgucagcggcguuuacccaauguccauuccugcaacccuguucgugugguauuucuggcagaaaaagaagcagcggucaggggugcucugggauacacccaguccaccggaagucgagagagccgugcuggacgauggaaucuacaggauccuucagcgugguuuacugggccgcagccaaguugggguaggaguguuucaggacggcgucuuccauacuauguggcacgugacccggggugcuguucucauguaucaggggaaaagauuggaaccuucuugggcauccgugaagaaagaccugauuucauacggaggcggcuggagguuucaggggaguuggaacacgggagaggagguccaagugauagccguagaacccgguaagaauccaaaaaacguccagacaacucccggcaccuucaagacaccugagggggaagugggagcgaucgcucucgauuuuaagccaggcaccagcgguucccccauuguuaaucgagaggggaaaaucgugggacuguacggcaacggcgucgugacuaccucugggacauauguuucggccauugcacaggccaaggcuagccaagaaggaccucuuccggagaucgaggacgaaguguucaaaaagcggaaucugacgauaauggauuugcacccagguucaggcaaaacucgcagauaccuacccgccaucgucagggaggcaauuaagcggaagcugcgaacccucaucuuagcuccuacaagagugguagccuccgaaauggcggaggcccugaaagggaugccaauucgcuaucagaccacugcagugaagagugaacauacaggaagggagaucguugaccuuaugugccacgcuaccuuuacgaugcgucugcucucucccguccgggugccuaacuacaauaugauaauuauggaugaggcccauuucacugacccggcuagcaucgcagccagaggcuauaucuccacaaggguggguaugggggaagccgcugcgauuuuuaugaccgcaacccccccaggaucagucgaggccuucccucagucuaacgcuguaauccaggaugaagagcgcgacauacccgaacgaagcuggaauaguggcuacgauuggauuacugacuuuccaggcaaaacagugugguucguuccuuccaucaagagcgggaacgauauugccaauuguuugagaaaaaacggaaagcgggugauccaacugucuaggaagaccuucgacacagaguaucagaaaacuaagaacaaugacugggauuacgucgugacgaccgacauaucagagaugggugcaaacuuucgcgccgaucguguuauugaccccagacggugccucaaaccagugauccugaaggauggcccggaaagggucauccuugcugggccuaugcccgugacaguagcguccgccgcacagcgccgaggaagaauuggccggaaucagaacaaagagggugaccaauacguguauauggggcagccacuaaauaacgaugaagaccacgcucauuggacugaggccaagaugcuguuggauaauaucaacacccccgagggcauuauaccugcauuauucgaaccagagagggaaaagagugccgcuaucgacggagaguaccgccugagaggcgaagccaggaaaacauuuguugagcucaugcggcguggggaucugcccgucuggcuuagcuauaagguggcgucggagggauuccaguacucugaccgccgauggugcuuugauggugaaagaaauaaccaggugcuggaggaaaauauggacgucgagauuuggaccaaagaaggcgagaggaagaaacuccggccucgcugguuggacgcaagaacuuauuccgauccgcuggcccuaagggaguucaaggaauuugcugccgggcggcgaagcguuucaggagaccugauccucgagaucggcaaacuuccacaacaccugacguuaagagcucagaacgcauuggauaaucuggugaugcuccacaacagugaacagggugggaaggccuaccgccaugcuauggaggaacugcccgacaccauugagacacuuaugcugcucgccuugauagcaguacugacuggcggagugaccuuauucuuucuaucuggcaaggggcugggaaaaacauccaucggucuccuuugugucaccgcgagcucagcccuguuguggauggcuaguguggagccucacuggauugccgcaagcaucauucuggaauucuuucucaugguucugcuuauccccgagccagauaggcagcggacuccucaagacaaucagcucgcuuauguggucauaggccuguuguucaugauccugacaguagccgcaaacgaaaugggguuacuagagacgaccaagaaagaucugggaauuggcuacguggccgcugagaaccaucagcacgcgacuaugcucgacguugaucuucgucccgccuccgcauggacacuguacgcuguggccaccaccgucaucacaccaaugaugagacacacuauugaaaauacgaccgccaacaucucuuugacagcaauagcuaaucaagccgcgauucugaugggucucgacaagggguggccuaucagcaaaauggauauuggcgugccgcugcuugcuuuaggaugcuauucccaggucaacccccugacucucaccgccgcaguguugaugcugguugcccauuacgcuaucauaggcccagggcuacaggcaaaggccacaagggaggcgcagaagcgcaccgcugccggaaucaugaaaaauccuacuguggacggcauuguagcaaucgaucuggaccccguggucuaugacgccaaguuugaaaaacaacucggucagauuaugcuucugaucuuguguacgucacagauacugcucaugcggacaaccugggcucugugcgagucuauuacuuuagccaccgggccacuuacaacucugugggaaggaaguccuggcaaguucuggaacaccacaaucgcaguuucgauggcuaauaucuuccgagguagcuaccucgccggcgcggggcuagccuuuucccugaugaaaucuuugggaggcgggagaaggggaacgggcgcacagggugagacccugggggagaaguggaagcgccaacucaaccagcuuucaaaaagcgaauucaauacuuauaagcgguccggaauuauggagguggauagaagugaagcuaaagagggccugaagcguggugaaacaaccaaacacgccgucucuaggggcacugcaaaguugcggugguuuguggagcgcaaccugguaaagcccgaggggaaagugaucgaccucggauguggccgagggggauggagcuacuauugcgcuggcuuaaagaaaguuacagaagugaaggguuacaccaaagggggaccgggccaugaggaaccaauaccuauggccacguacggcuggaaucuggucaagcuucacucagggaaagauguguucuuuaugcccccagagaagugugacacccugcuaugcgauauuggagaauccagucccaacccuacaaucgaggaggguagaacucucaggguccugaagaugguggaaccgugguugaaaggcaaucaguucuguauuaagauccugaaccccuauaugccaagcguuguagagacccucgaacagaugcaacggaaacaugggggaaugcuugugcgcaauccucugucuagaaacuccacacacgagauguacugggucucaugcggcacugguaauauagugagcgccguuaacaugaccucgaggauguuacugaaccgauuuacaauggcgcaccggaagcccaccuaugagcgugacguggauuugggggcuggaacuagacaugucgcaguggaaccugagguagccaaucucgacaucauuggccagcgcaucgaaaacauuaaaaaugagcacaagucuacguggcauuacgaugaagacaacccauauaagacaugggcuuaccacggcaguuaugaggugaaacccuccgggagcgccucauccaugguuaauggagucgugaggcugcuaaccaagccuugggaugugaucccaauggucacucagauugcaaugaccgacacaacgcccuucggucaacagcggguuuuuaaagagaagguggacaccagaacuccgcgcgccaaaaggggcacaacccagaucauggaaguaacugcuaaguggcuuuggggguuccugucucgaaacaagaaaccucggauauguacaagagaggaauuuaccaggaaggugcgcagcaaugcggccauuggagcagucuucguggaugagaaccaguggaauagugcuaaagaagccguugaggacgagcguuuuugggaucucgugcaccgggaaagagagcugcauaagcaaggcaaaugcgcaacaugcgucuacaacaugauggguaagagggaaaagaaauugggggaguucggaaaggccaaaggcucccgcgcuaucugguacauguggcugggcgcccgauuccucgaauuugaggcgcuuggguucaugaaugaggaccacugguuuagccgggaaaacucucugucaggaguggagggugaaggcuuacauaagcugggguauaucuugagagauauuaguaaaauaccaggaggcaauauguacgcagacgauacugccgguugggacaccaggaucacggaggaugaccuccagaacgaggcuaagauuaccgauaucauggaacccgagcacgcccugcuagcaacauccauuuucaaacuuacuuaucagaauaagguaguucgcgugcagagaccugcuaagaacgggaccgucauggacgugaucagccggagggaucaacguggaucuggccaggugggcacauacgggcugaacacuuuuaccaauauggaaguccagcucauacgacagauggagucggaaggaaucuuccugccaucagaguuggagacgcccaacuuagccgaacgcguucuggacuggcucgagaaacauggugcugaaagacuuaagcggauggccauuagcggcgacgauugugugguaaaaccgaucgacgauagguuugcaacagcgcugaccgcccuaaaugacauggggaaggugcgcaaagauauuccucaaugggagcccuccaagggauggaacgacuggcagcaggucccauucugcagucaccacuuucaucagcugaucaugaaggauggcagagaaauagugguuccuugucggaaucaagacgagcucguggguagggcucgagucucucagggggccggauggagcuugcgugagacugcaugccugggcaaauccuaugcucagauguggcaacuuauguacuuccacagacgcgaucugcggcucgccgcaaacgccauuuguucagcggugcccguagacuggguuccaacaaguaggaccacuuggucuauccaugcucaccaccaguggaugaccacagaagauauguuaagcguguggaauagagucuggaucgaggaaaaccccuggauggaggacaagacgcauguguccucaugggaagagguuccuuaucugggcaaacgcgaggaccaguggugcgggagcuugauuggacugaccgcccgggcaacuugggccacaaauauacagguggcuaucaaccaagucaggcgacucauugguaaugaaaacuaccuugauuacaugaccucuaugaagagauuuaaaaaugaguccgacccagaaggcgcccugugguga

SEQ ID NO: 13527 - RNA, 9879 nt, Artificial Sequence
  derived and/or modified CDS sequence (opt3) from DENV-1__JN819414__SS-prME
agcgugaccaugcugcucaugcuucugccaacagcauuggcuuuccacuuaacuacgagaggcggggaaccucauaugaucgucuccaagcaggaaagaggaaaaucucugcuauuuaagaccucagccgguguuaacaugugcacccucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgccuacgcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcaugggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguaugaaaaccucaaauacuccgucauugugacaguucacaccggagaucagcaccaaguggguaaugagacuacggaacauggcacaaucgccaccauuacuccccaggcgccuaccucagagauccagcuuacagacuauggggcccugaccuuggacuguaguccaaggacuggacuagauuucaacgaaaugguccugcucacaaugaaggagaaaagcuggcuggugcacaagcagugguuucuugaccugccguugcccuggacgucuggcgcauccaccucacaagagacuuggaaucggcaggaucuccugguaacauucaaaaccgcucaugccaagaagcaggaaguuguggucuuagguagccaagagggggcuaugcacacagcccugacuggcgcaaccgaaauccagacgaguggaaccacaacuauuuuugccggccaccuaaaaugccgucucaagauggacaaacugacccuuaaggggaugucuuacgugauguguacaggauccuucaaauuggagaaggaagucgcugagacucagcaugguaccgugcugguucaggugaaguaugagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguacauaguugugggugccggggaaaaagcucugaaacuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaccagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaucuuggggucaugguucaggcugacagcggaugcgugaucaacuggaaaggccgcgaauugaagugugguucugggauuuucgugacuaacgagguacauaccuggacggaacaauacaaguuucaggccgauucaccgaaaagacugagugcagccaucggaaaggcuugggaggagggcgucugcgguaucaggagcgccacacggcucgaaaauauuauguggaaacagauauccaacgagcugaaucacaucuuacuggaaaacgacaugaaguucaccgugguugugggcgacgcaaaugggauucuugcucagggcaagaagaugauccgcccucaacccauggagcauaaauauucuuggaagucguggggcaaggccaaaauuaucggggcggauauacagaacacuaccuuuaucauugacggaccagauacaccugaaugucccgacggccagagagccuggaauaucugggaggucgaggauuacgguuucgggauuuuuacuaccaacaucugguugaagcucagggacagcuauacacagaugugcgaucaccgucugauguccgcugcaauaaaagacucaaaggccgugcacgcugauaugggauacuggauugaaagugagaaaaaugaaacguggaagcuagcccgggcaucuuucaucgagguuaagaccuguacuuggccaaaaagccauacacugugguccaacggcgugcucgaaucagagaugauuauccccaagauauaugguggcccuaucagccaacacaauuaccgaccaggguacuucacccagacugcgggaccguggcaucugggcaaacuugaguuggacuuugaucugugcgaagggacaaccguagucguggacgagcacugcggaaacagaggccccucuuuaaggacgacuaccgugacagguaagauuauccacgaaugguguugccgcuccuguacccucccuccacugcgguucagaggggaggauggaugcugguauggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacuuaccuggcuuuaauggccaccuuuaaaaugcgcccuauguucgcagugggucuccuguuucggagacuuacgucuagggagguccugcuacucacaaucgggcugagcuugguggccucaguugaacugccaaacaguuuagaggaacucggagacggccuggcuaugggcauuaugaugcuuaagcuguugaccgaguuccaaccccaucagcucuggacuacccugcuaucccugacauuugugaaaacuacccuuucucucgauuaugcguggaagacgacagccaugguccugagcauaguauccuuguucccgcuguguuuaucaaccacuagccagaaaacaaccuggcucccugugcugcuugggaguuuuggaugcaagccacugacuauguucuugaucacagaaaacaagauuuggggucgaaaaucuuggccccucaaugagggcaucauggcaauugggaucguuuccauacugcuaagcucgcugcuuaagaacgacgugccucucgcuggaccccugaucgccggcgguauguugauugccuguuacgucaucucagggucuagugcugauuuacugcucgagaaagcagccgaaguguccugggagcaggaagcggagcacagcggagcuucucauaauauucugguagaagugcaagacgauggcaccaugaagaucaaagacgaggagcgcgaugacacgcuuacuauacuguugaaggccacccuacuggcagucagcggcguuuauccaauguccauuccugccacacucuuugugugguacuucuggcagaaaaagaagcagcggucaggggugcugugggauacccccaguccaccggaagucgagagagcugugcuugacgauggaaucuauaggaucuuacagcguggucugcucggccgcagccaaguugggguaggaguguuccaggacggcgucuuucacacaauguggcaugugacucggggugcaguuuugauguaccaggggaaaagacuggaaccuucuugggccuccgugaagaaagaccucauuucauacggaggcggcuggagguuccaggggaguuggaacaccggagaggagguccaagugauagcgguagaacccgguaagaaucccaaaaacguccagacgacacccggcacuuuuaagaccccugagggggaagugggagcuaucgcccuggauuucaagccaggcacaagcgguucccccauuguuaaucgagaggggaaaaucgugggacuuuauggcaacggcgucgugaccacugggggaaccuacguuucugcaauugcccaggcuaaggccucgcaagaagguccucugccggagaucgaggacgaaguguuuaaaaagcggaauuugacaauaauggaucuacacccaggcagcgggaaaacgcgcagauaucugcccgcaaucgucagggaggcuauuaagcggaagcuccgaacuuuaauccuggccccuaccagagugguagcgucagaaauggccgaggcacuuaaaggaaugccaauucgcuaccagacaaccgcugugaaguccgaacacacuggcagggagaucguugaccugaugugccaugccacauucaccaugcgucucuugagucccguccgggugccuaacuauaauaugauaauuauggaugaggcucacuuuacggacccggcaucuaucgccgccagagguuacaucagcacuaggguggggaugggagaagcugcggcaauuuucaugacagccacacccccaggcuccgucgaggcuuuuccucagucaaacgccguaauccaggaugaagaacgcgacauacccgaacgaucuuggaauagcggcuaugauuggauuaccgacuucccagggaaaacugugugguuuguuccuaguaucaaguccggaaacgauauugcaaauugucugaggaaaaacgguaagcgggugauccaacucagcaggaagacauucgacaccgaguaccagaaaacaaagaacaaugacugggauuacgucgugacuacggacauaucugagaugggcgccaacuuccgcgcugaucguguuauugaccccagacggugccugaaaccagugauccuuaaggaugggccggaaagggucauccuagcgggaccuaugcccgugaccguagccucagcagcucagcgccgaggcagaauuggucggaaucagaacaaagagggggaccaauauguguacaugggccagccacugaauaacgaugaagaccaugcccacuggacagaggcaaagauguuguuagauaauaucaacacucccgagggaauuauaccugcccuguuugaaccagagagggaaaaguccgcugccaucgacggcgaguaucgccucagaggggaagcgaggaaaaccuucguugagcugaugcggcguggagaucuucccgucuggcugaguuacaagguggcaagcgaggguuuucaguauucggaccgccgauggugcuucgauggcgaaagaaauaaccaggugcucgaggaaaauauggacgucgagauuuggacaaaagaaggggagaggaagaaauugcggccucgcuggcuggacgccagaaccuacucugauccgcuagcucugagggaguuuaaggaguucgccgcuggacggcgauccguuagcggcgaccucauccuugagaucgguaaacugccacaacauuuaacuuugagagcacagaacgcccuggauaaucucgugaugcugcacaacucagaacaagggggaaaggcuuaucgccacgccauggaggaacuucccgacacgauugagacccugaugcucuuggcacugauagcgguauuaacaggaggcgugacucuauuuuuccugagugggaagggacucgguaaaaccucuaucggccuucugugugucacagccuccagcgcuuugcuguggauggccucaguggagccucauuggauugcagcuaguaucauucucgaauuuuuccugaugguucuucucauccccgagccagauaggcagcggaccccucaggacaaucagcuggccuacguggucauaggguugcuguuuaugaucuuaacuguagcagccaacgaaaugggacuacuggagacaacgaagaaagaucucggcauugguuacguggcugcggagaaccaccagcaugccaccaugcuugacguugaucugcgucccgcaagcgcuuggacuuuguaugccguggccacaaccgucaucaccccaaugaugagacacacaauugaaaauacuacggcaaacaucucccugaccgcuauagccaaucaagcggcuauucucauggggcuggacaagggcuggccuaucucuaaaauggauauuggagugccgcuuuuagcccugggcugcuacagccaggucaacccccucacauugacugcagccgugcugaugcuaguugcucacuaugcaaucauagggccaggacugcaggccaaggcgaccagggaggcucagaagcgcacagccgcaggcaucaugaaaaauccuaccguggacgguauuguagccaucgaucucgaccccguggucuacgacgcuaaguucgaaaaacaacuugggcagauuaugcuguugauccuguguacuucccagauacuccugaugcggacgacaugggccuuaugcgagucaauuacccuugcaacuggaccacugaccacacucugggaaggcucuccugguaaguuuuggaacacuaccaucgcuguuaguauggccaauaucuuccgaggcucguaucuagcgggggccggacuggcauucagcuugaugaaaucccugggcgggggaagaaggggcacaggugcucagggggagacgcucggagagaaguggaagcgccaacuuaaccagcugucuaaaucagaauuuaauaccuacaagcggagcggcauuauggagguggauagauccgaagccaaagaggguuugaagcguggcgaaacuacaaaacaugcagucaguagggggaccgcuaagcugcggugguucguggagcgcaaccucguaaagcccgagggaaaagugaucgacuuaggcugugggcgaggaggcuggucuuauuacugcgccggucugaagaaaguuacugaagugaagggguacacaaaaggaggcccgggccacgaggaaccaauaccuauggccaccuauggguggaaucuugucaagcugcauagcggaaaagauguguuuuucaugcccccagagaagugugacacgcuacucugcgauauuggugaaucaucccccaacccuaccaucgaggagggcagaacacugagggucuugaagaugguggaaccguggcugaaagggaaucaguuuuguauuaagauccucaaccccuacaugccaaguguuguagagacucuugaacagaugcaacggaaacacggaggcaugcuggugcgcaauccuuuaagcagaaacucuacccaugagauguauugggucuccugcgguacagggaauauagugucagcgguuaacaugacuagcaggaugcuguugaaccgauucaccauggcucaccggaagcccacauacgagcgugacguggaucucggagcaggcaccagacacgucgccguggaaccugagguagcuaaucuggacaucauuggccagcgcaucgaaaacauuaaaaaugagcauaagucgacuuggcacuaugaugaagacaacccauacaagacgugggccuaucaugggucuuacgaggugaaacccaguggauccgcaagcucaaugguuaauggugucgugaggcuacuuacaaagccuugggaugugaucccaauggucacccagauugccaugacugacaccacacccuuuggccaacagcggguuuucaaagagaagguggacacgagaaccccgcgcgcuaaaagggggacuacacagaucauggaaguaaccgcgaaguggcuguggggauuucucucccgaaacaagaaaccucggauauguacuagagaggaguucacaaggaaggugcgcucuaaugccgcaauuggcgcugucuuuguggaugagaaccaguggaauaccgccaaagaagcaguugaggacgagcguuucugggaucuggugcaccgggaaagagaguugcacaagcaagguaaaugcgccacaugcgucuacaacaugauggggaagagggaaaagaaacugggagaguuuggcaaggcuaaaggcagccgcgccaucugguauauguggcucggggcgcgauuccuugaguucgaggcacugggauuuaugaaugaggaccauugguucagucgggaaaacuccuuaagcgguguggagggcgaagggcugcacaaguugggauacauccucagagauauuucuaaaauaccaggcgguaauauguaugccgacgauacugcugggugggacaccaggaucacggaggaugaccugcagaacgaggccaagauuaccgauaucauggaacccgagcaugcacuacuugcuacaucaauuuuuaaacugacuuaccagaauaagguaguucgcgugcagagaccugccaagaacggaaccgucauggacgugaucagucggagggaucaacguggcuccggccagguggggacauauggacucaacacuuucaccaauauggaaguccagcugauacgacagauggagagcgaagguaucuuuuugccaucugaguuagagacgcccaaccuggcugaacgcgcccucgacuggcuugagaaacacggcgcagaaagacugaagcggauggcgauuucgggggacgauuguguugugaaaccgaucgacgauagguucgccacagcucuaaccgcccugaaugacaugggaaagguacgcaaagauauuccucaaugggagcccucaaagggcuggaacgacuggcaacaggugccauuuugcagccaucacuuccaccagcucaucaugaaggaugguagagaaauagucgugccuugucggaaucaagacgaguugguugggagggcacgagugucccagggagcuggcuggagucugcgugagacugccugccuuggcaaaucuuacgcacagauguggcaacugauguauuuucauagacgcgaucuccgguuagccgcgaacgcuauuuguagcgccguccccguggacuggguaccaacauccaggaccacuuggucaauccacgcacaucaccaguggaugaccacagaagauaugcugaguguuuggaauagaguguggaucgaggaaaaccccuggauggaggacaagacgcacgucucuagcugggaagaggugccuuacuuggggaaacgcgaggaccaguggugcggaucccugauuggucucaccgcccgggcuacuugggccacaaauauacagguugcaaucaaccaagugaggcgacuuauuggcaaugaaaacuaccuggauuauaugaccucaaugaagagauucaaaaaugagagcgacccagaaggggcucuaugguga

SEQ ID NO: 13528 - RNA, 9879 nt, Artificial Sequence
  derived and/or modified CDS sequence (opt3) from DENV-1__FJ873810__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagagaagcguagcgucgcucuggccccccaugugggcuugggucucgaaacuagaaccgagacauggauguccucugaaggggcauggaaacagauccagaggguugagacuugggcccugcggcacccuggauucaccgugauugcuuuuuuccuggcacaugccaucggcacaucgauuacccagaagggcaucauauuuauccucuuaaugcuggucacgccaucaauggcuaugcgcugcguggggauuggaaacagagacuucguagagggucuuagcggcgccacuuggguugauguggucuuggaacacgggaguugugugacaaccauggcgaagaauaaacccacucuggacaucgagcuacucaagacagaagugaccaacccugcaguccugaggaaacuuugcauugaggccaagaucuccaauacgaccacagauucucgguguccaacucaaggagaagcuacccugguugaggagcaggacgccaacuuugugugccgccgaacauucguagauagaggcugggguaauggguguggauuguuuggcaaaggcagccuccugacuugcgcaaaguucaagugcgugaccaaauuagaagggaagauaguccaguacgagaaccugaaauauuccgugauuguuacagugcacaccggagaccagcaucaagucgguaaugaaacuacggagcacggcacaaucgcuaccauuacuccccaggccccuaccucagaaauccagcucacagauuacggggcgcuuacccuggacuguaguccaaggacuggauuggacuuuaacgagauggugcuacugacaaugaaggagaaaagcuggcucguacauaagcagugguuccuggaucuuccgcugcccuggacgucuggcgccuccaccucacaagaaacuuggaaucggcaggacuugcucguuacauuuaaaaccgcacacgcuaagaagcaggagguggucgugcuggguagccaagaaggggccaugcacacagcuuuaacuggcgccaccgagauccagacgaguggaaccacaacuauuuucgcaggccaucugaaaugccgucuaaagauggauaaacucacccugaaggggaugucuuaugucauguguacaggauccuucaaacuugaaaaggagguggccgagacucagcacgguaccguuuuggugcagguaaaguacgaaggcacggacgcuccuugcaaaauaccauuuagcacacaagaugagaagggggucacccagaacggacgccugaucacugcgaaucccauugugacagacaaagaaaagccuguuaacaucgagaccgagccacccuucggcgaaucguauauaguggucggugcaggggagaaagcccucaagcugucuugguuuaagagaggcuccucaauuggaaaaauguucgaagcuacugccaggggcgcacggcgaauggccauccuuggggauaccgcuugggacuuuggaaguaucgguggcguguucacaagcguagggaagcuggugcaucagguuuuuggaacggccuacggcgucuuguucuccggugugucuuggaccaugaaaauugggaucggcauucuccugacuugguuaggacugaauagccgcucaacaagucuauccaugaccuguauagcagugggcauggucacacucuaccuggggguuauggugcaggcggauagcggaugcgugaucaacuggaagggcagagagcuuaaaugugguucugggauuuuuguaacuaacgaaguccacaccuggacggagcaauauaaguuccaggcugacucaccgaagagguugagugccgcaaucggaaaagccugggaggaaggcgugugcgguauccggagcgcuacacgccuggagaauauuauguggaagcagauauccaacgaacucaaucauauccuguuagagaacgauaugaaauuuaccguuguggucggcgacgccaaugggauucuggcacagggaaagaaaaugaucagaccucaacccauggaacacaaguacucuuggaaaucguggggcaaggcuaagauuaucggggccgacauacagaacacuaccuucaucauugauggaccagacacaccugagugucccgauggccagagggcguggaauaucugggagguggaagacuaugguuuugggguuuucacuaccaacauuuggcuuaaauugcgugauagcuacacacagaugugcgaccaccggcucauguccgccgcuaucaaggauucaaaagcagugcaugccgacaugggauauuggauagagagugaaaagaaugagacguggaaacuggcucgagccucuuucauugaaguaaagaccuguacuuggccaaagagccacacacuaugguccaacggcguccuggagucagagaugaucauucccaaaaucuacgguggcccuauaagccaacauaauuauagaccaggguacuuuacccagacugcaggaccguggcaccucggcaagcuggaacuugauuucgacuugugcgaggggacaaccgugguggucgaugaacacugcggaaacaggggccccucucugcgcacgacuaccguuacagguaaaaucauucaugagugguguugccgguccuguaccuuaccuccacucagauuuaggggggaggacggaugcugguacggcauggaaauccgccccgugaaggagaaagaagagaaucugguacgaaguauggugagcgcggguucuggcgaagucgauuccuucucacuugggauucugugugugaguaucaugauagaggagguuaugcggagccguuggucgagaaagauguugaugacuggaacacucgccguguuucugcuacugauuaugggccagcucaccuggaacgaccugaucaggcuuugcaucauggucggggcuaaugccuccgaccgcaugggaaugggcacaacuuauuuggcacugauggcuaccuucaagaugcggccuauguuugccguggguuuacucuucagaaggcugacgucucgagaaguucuucugcuaacaauugggcucagccugguggcaucagucgaguugccaaacagucuggaagaguuaggagauggccucgccaugggcaucaugaugcugaaacuucugaccgaauuucaaccccaccaguuguggacuacccuccugucccuaacauucguaaagacuacccugucucuugacuacgcuuggaaaacgacagcgauggugcucagcauuguuucccuguuuccguugugucugucaaccacuagccagaagacaaccugguuaccugugcuccuggggaguuucggaugcaaaccacuuacuauguuucugauaacagagaacaagaucuggggucgcaagucuuggcccuugaaugagggcauuauggccaucgggauugucuccauccuccugagcucgcuacugaaaaacgaugugccucuugcaggaccccucauagcuggcgguaugcugaucgccuguuauguaauuucagggucuagugccgacuuguccuuagaaaaggcugcagaggugagcugggaacaggaggccgaacauucuggagcgagccacaauauccuggucgagguucaagaugacggcaccaugaaaauuaaggaugaggaacgggacgauacgcucacuauccugcuuaaagcuacccuguuggccguguccggcguguacccaaugucaauaccugcaacacuauucgucugguauuucuggcagaagaaaaagcagagaaguggggugcugugggacacccccagcccaccggagguugaaagggccguacucgaugacggaauuuaccguauccugcagcgcggucuuuuaggccggucucaagugggggucggaguguuucaggauggcguuuuccauacaauguggcacgugacuagaggugcuguccugauguaucaggggaagaggcucgagccuuccugggcaucagugaaaaaggacuugaucaguuacggaggcggcuggcgauuucaggggagcuggaacaccggagaggaaguacaagucauugccguggagcccgguaaaaauccaaagaacguucagacgacacccggcacuuucaaaaccccugaaggggaggugggagcgauagcucuggacuuuaagccaggcacauccgguucucccaucgucaaucgggaagggaagauugugggacucuacggcaacggcguugugaccacuucggggaccuaugucagcgccaucgcacaggccaaagcuucacaagagggaccucugccggagauugaagaugagguguucaagaaacgcaaucuuacaaucauggaccugcacccagguuccggcaagacgagaagguacuugcccgccauaguacgggaagcaaucaaacgaaagcuaagaacucugauucucgcuccuacccgcgugguugccagugagauggcggaagccuuaaaggggaugccaaucagguaucagacaaccgcagucaaaucugagcauacuggacgugagauuguggaucugaugugccacgcuacauuuaccaugcggcuucugagccccgugagagucccuaacuacaauaugaucauaauggacgaagcccauuucacggauccggcuuccauugcagccaggggcuauaucucaacucgcguagguaugggggaggccgcugcgaucuuuaugacagcaacccccccaggaucuguggaagccuucccucagagcaacgcuguuauucaggacgaggaacgagauauccccgagagaaguuggaauuccggcuacgacuggauaaccgauuuuccaggcaagacugugugguucgucccuagcauuaaaucugggaacgacaucgccaauugucuccggaagaacggaaaaagggugauucaauugucacgcaagacauucgauaccgaguaucagaagacaaaaaacaaugacugggacuacguugugacuacggauaucuccgaaaugggugcaaacuuucgugccgacagagucauagauccccggaggugccugaagccagugauucucaaagacggcccggagcgcguaauccuggcugggccuaugcccgugaccguugcgagugccgcacagcgaagaggacggaucggcaggaaucagaacaaggaaggugaucaauacgucuauauggggcagccacuuaauaacgacgaggaucacgcucauuggacagaggccaaaaugcuacuggacaauauuaacacucccgaaggcaucauuccugcauuguucgagccagaacgcgagaagagcgccgcuauagauggagaauacagauuaaggggcgaggcccggaagaccuuuguggagcugaugcgucgcggggaccuccccguguggcugucguauaaagucgcgucugaaggauuccaguacuccgaucgaagauggugcuuugacggugagaggaauaaccagguucuugaagagaauauggauguggaaaucuggacaaaggagggcgagcggaaaaagcugcgcccuagauggcucgacgcaaggaccuauagcgacccguuggcccugcgggaauucaaagaguuugcugccgggcgaagaucaguaaguggagaucuaauucuggaaaucggcaagcucccacaacaccuuacucugcgcgcucagaacgcauuagacaauuuggugaugcugcacaacucugagcagggugggaaagccuacaggcaugcuauggaagagcuccccgauacgaucgagacccugaugcuucuggcccucauugcagucuugacaggcggagugacucuguucuuuuuauccggcaaggggcuaggaaagaccagcauaggucugcucuguguuacagcgucaagugcccuucuguggauggcuagcguggaaccucacuggaucgccgcauccauuaucuuggaguucuuucugaugguccuccugauucccgaaccagaccggcagcguaccccucaagauaaucagcuugcuuauguagugaucggccuccuguucaugauauugacuguugccgcaaacgagauggggcuguuagagacaacgaaaaaggaccuaggaaucggcuacguggccgcugaaaaccaucagcacgcgaccaugcuggaugucgaccuccaccccgccucugcauggacucuuuacgcuguggccacaaccgucauuaccccaaugaugagacauacaaucgagaauacuacggccaacauuagccugaccgcaaucgcuaaucaagccgcgauauugaugggucuggauaaaggguggccuauuuccaagauggacaucggcgugccgcuccuggcucuuggaugcuauucacagguuaaccccuuaacacugacugccgcagugcucauguugguagcccacuacgcuauuaucggcccagggcugcaggcaaaagccaccagggaagcgcagaagcgcacagcugccggaauaaugaagaauccuaccguggauggcaucgucgcaauugaccuagaucccguuguguaugacgccaaauuugagaagcaacugggucagaucaugcuccuuauucuguguacuucucagaucuugcugaugcggacgacaugggcucucugcgaaaguauaacccuggccacugggccauuaaccacacuuugggagggaucgccuggcaaauucuggaacacuaccauugcagucagcauggcuaauaucuuccgagguuccuaccuggccggcgcggggcucgccuuuucucuaaugaagucacugggaggcgggagaaggggaacaggcgcacagggugagacguugggggaaaaauggaagcgccaacugaaccagcucagcaaguccgaguucaauaccuauaaacggaguggaaucauggaaguggacagaucugaggcuaaggaaggccuuaaacguggugagacuacaaagcaugccguaagcaggggcaccgcaaaacugcggugguuuguggagcgcaacuugguuaagcccgaagggaaggugauugaucugggauguggccgagggggauggucauacuauugcgcuggccucaaaaaggucacugaggugaaagguuacacaaaggggggaccgggccacgaagagccaaucccuauggccaccuacggcuggaauuuagucaaacugcauuccgggaaggacguguucuuuaugcccccagaaaaaugugauacgcuucugugcgacauaggagagaguagccccaacccuaccauugaggaagguagaacacuaaggguucucaagaugguagagccguggcugcggggcaaucaguucuguaucaagauuuugaaccccuauaugccaucuguggucgaaacucuggagcagaugcaacgcaaacacgggggaaugcucgugagaaauccucuuuccaggaacucaacccacgagauguacuggguuagcugcggcacagguaauaucgugucggccgucaacaugacuucucgaaugcuguuaaaccgguuuaccauggcgcaucguaagcccacauaugaaagagauguggaccugggggcuggaacccgccacguagcaguggagccugaaguugccaauuuggauauaaucggccagaggauugagaacaucaaaaaugaacauaagaguacuuggcacuacgacgaggauaacccauauaaaacgugggcuuaccacggcuccuaugaggucaagcccagcgggucagccuccucuauggugaauggagugguccggcuccugacaaagccuugggacguuauuccaauggugacccagaucgcaaugacugauaccacacccuucggucaacagagaguauuuaaagaaaagguggacacgcgcaccccgagggccaaacgaggcacuacacagauuauggaggucaccgcuaaguggcuauggggguuccuuagccggaacaaaaagccuagaaucuguacuagggaagaguuuacacgcaaggugcguaguaaugcggccauaggagcaguuuucguggacgaaaaccaguggaauuccgcuaaagaggccgucgaggaugaacgguuuugggaccuggugcauagagagagggaacuccacaagcaaggcaaaugcgcaaccugcguauacaacaugauggguaagcgcgagaaaaagcugggggaauucggaaaggccaaaggcagccgagcuauuugguacaugugguugggcgcccgguuccuggaguuugaggcgcucggguucaugaaugaagaucauugguuuucuagagagaacucacuuaguggaguugaaggugagggccugcacaaguuaggguauauccugagggacaucuccaaaauuccaggaggcaauauguacgcagaugacacagccgguugggauacucgcauaaccgaggacgauuugcagaacgaagcuaagaucacggacauuauggagcccgaacaugcccuccuggcaaccagcaucuucaaacuaacauaucagaauaagguggucagagugcagcggccugcuaaaaacgggacugugauggaugucauuucuaggcgugaccaacgaggaucgggccagguuggcaccuacgggcuuaacacauuuacuaauauggaggugcagcugauccgccagauggaaucagagggaauauuccucccaagcgagcuggaaacccccaacuuggccgagagagcuuuagauuggcuggaaaagcacggugccgagcggcucaagaggauggcaaucuccggcgacgacuguguagugaaaccgauugaugaccgcuuugcgacggcccuuacagcucugaaugauauggggaaggucagaaaagacaucccucaaugggaacccaguaagggauggaacgauuggcagcaggugccauucugcucucaccauuuucaccagcuaauuaugaaagacggccgggagaucguugugccuuguaggaaucaagaugagcuggucggucgagcccgugugagccagggggcaggauggucccucagagaaaccgcuugcuugggcaagucauaugcccagauguggcaacugauguacuuccaucgccgggaccuuaggcuggcagccaacgcgauauguagugcuguacccguugauugggugccaacuucuagaacaaccuggagcauucacgcccaccaucaguggaugacuaccgaggacaugcucuccgucuggaaucgcguguggaucgaagagaaccccuggauggaagauaagacacacguuucaagcugggaggaggugccuuauuuaggcaaacgggaagaccaguggugcgggucucugaucggauugacggcaagggccaccugggcuacuaauauucaggucgccauaaaccaagugcgaagacugaucgguaaugagaacuaccucgacuacaugacauccaugaagcgguuuaaaaaugaaagugauccagagggcgcacuuugguga

SEQ ID NO: 13529 - RNA, 9879 nt, Artificial Sequence
  derived and/or modified CDS sequence (opt3) from DENV-1__FJ850103__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaagcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguaucuggccaaagagccacacucuaugguccaacggcguacuggagucagagaugauuauccccaaaauauacgguggcccuaucagccaacauaauuauagaccaggguacuuuacacagaccgcgggaccguggcaccucggcaagcuggaacuugauuucgacuugugcgaggggacuacagucgugguggaugaacacugcggaaacaggggccccucucugcgcaccacgacugucaccgguaaaauuauccaugagugguguugccgguccuguacauuaccuccacucagauuuaggggggaggacggaugcugguacggcauggaaauucgccccguuaaggagaaagaagagaaucuggugcgaaguaugguaagcgccgguucuggcgaaguggauuccuucucacuugggauccugugugucaguauaaugauugaggaggugaugcggagccguuggucgagaaagauguugaugaccggaacucucgcuguuuuucugcuacugaucaugggccagcucacauggaacgaccugaucaggcuuugcauuauggugggggccaaugcauccgaccgcaugggaaugggcaccacauauuuggcucugauggccacuuucaagaugcggccuauguuugcagucgguuuacucuucagaaggcugaccucucgagaagugcuucugcuaacgaucgggcucagccugguugccucaguggaguugccaaacagucuggaagaguuaggagauggccucgcuaugggcauuaugaugcugaaacuucugacagaauuucaaccccaccaguuguggaccacucuccugucccuaaccuucgucaagacaacucugucucuugacuacgcguggaaaaccacggccaugguacucagcauagugucccuguuuccguugugucugucaacaaccagccagaagacuacaugguuaccuguucuccuggggaguuucggaugcaaaccacuuaccauguuucugaucacugagaacaagauuuggggucgcaagucuuggcccuugaaugagggcaucauggcaauugggaucguguccauacuccugagcucgcuacugaaaaacgaugucccucuugcuggaccccucaucgccggcgguaugcugauugccuguuaugugaucucagggucuagugcugacuuguccuuagaaaaggcagccgagguaagcugggaacaggaggcggaacauucuggagcuagccacaauauucugguggagguccaagaugacggcacaaugaaaaucaaggaugaggaacgggacgauacccucacgauacugcuuaaagccacucuguuggcaguuuccggcguguacccaaugucaauuccugccacccuauucgugugguauuucuggcagaagaaaaagcagagaagugggguccugugggacacacccagcccaccggagguggaaagggcuguucucgaugacggaaucuaccguauccugcagcgcggucuuuuaggccggucucaaguaggggugggagucuuucaggauggcguguuccauaccauguggcacguuacaagaggugcagugcugauguaucaggggaagaggcucgagccuuccugggccucagucaaaaaggacuugauuaguuacggaggcggcuggcgauuucaggggagcuggaacacuggagaggaagugcaaguaauagcggucgagcccgguaaaaauccaaagaacgugcagaccacgcccggcacauucaaaacuccugaaggggagguuggagcuaucgcccuggacuuuaagccaggcaccuccgguucucccauugugaaucgggaagggaagaucgucggacucuacggcaacggcgugguuacaaccucggggacuuaugugagcgcaauugcccaggcuaaagccucacaagagggaccucugccggagaucgaagaugaggucuucaagaaacgcaaucuuaccauaauggaccugcacccagguuccggcaagacaagaagguacuugcccgcaaucgugcgggaaaguauuaaacgaaagcuaagaacgcugauccucgcuccuacucgcguaguggccucugagauggcggaagccuuaaaggggaugccaauuagguaucagaccacagcaguuaaaagcgagcauaccggacgugagaucgucgaucugaugugccacgcuacuuuuacaaugcggcuucugucccccgugagagugccuaacuacaauaugauaauuauggacgaagcccauuucaccgauccggcuucaaucgcagccaggggcuauaucucuacgcgcgucgguaugggggaggccgcugcgauuuuuaugacugcaacacccccaggaagcguagaagccuucccucagaguaacgcugugauccaggacgaggaacgagauauacccgagagauccuggaauagcggcuacgacuggauuaccgauuuuccaggcaagaccguuugguucgugccuucuaucaaaucagggaacgacauugccaauugucuccggaagaacggaaaaagggucauccaauugucccgcaagacuuucgauacagaguaucagaagaccaaaaacaaugacugggacuacgugguuacaacugauauaagugaaaugggugcaaacuuucgugccgacagagugauugauccccggaggugccugaagccagucauccucaaagacggcccggagcgcgugauccuggcugggccuaugcccguaacgguggcgagcgccgcacagcgaagaggacggauuggcaggaaucagaacaaggaaggugaucaauacguuuauauggggcagccacuuaauaacgacgaggaucacgcucauuggaccgaggccaaaaugcuacuggacaauaucaacacacccgaaggcauuauaccugcauuguucgagccagaacgcgagaagucggccgcuaucgauggagaauacagauuaaggggcgaggcccggaagacuuuugucgagcugaugcgucgcggggaccuccccguguggcugucuuauaaaguggcguccgaaggauuccaguacagcgaucgaagauggugcuuugacggugagaggaauaaccagguccuugaagagaauauggauguugaaauuuggaccaaggagggcgagcggaaaaagcugcgcccuagauggcucgacgcaaggacauauucagacccguuggcccugcgggaauucaaagaguuugcugccgggcgaagaagugugucuggagaucuaauccuggaaaucggcaagcucccacaacaccuuacccugcgcgcucagaacgcauuagacaauuugguaaugcugcacaacuccgagcagggugggaaagccuacaggcaugcuauggaagagcuccccgauacuauugagacgcugaugcuucuggcccucauagcaguguugaccggcggagucacacuguucuuuuuaagcggcaaggggcuaggaaagacuucaaucggucugcucugugugaccgcgaguagcgcccuucuguggauggcuuccguugaaccucacuggauugccgcaucuaucauuuuggaguucuuucugauggugcuccugauccccgaaccagaccggcagcguacaccucaagauaaucagcuugcuuaugucguaauaggccuccuguucaugaucuugaccguggccgcaaacgagauggggcuguuagagacuacaaaaaaggaccuaggaauuggcuacguugccgcugaaaaccaucagcacgcgacgaugcuggauguggaccuccaccccgccagcgcauggacccuuuacgcugucgccacuacagugaucaccccaaugaugagacauaccauugagaauacaacugccaacaucucccugacggcaauagcuaaucaagccgcgauuuugaugggucuggauaaaggguggccuaucucaaagauggacauuggcgucccgcuccuggcucuuggaugcuauucucaggugaaccccuuaacccugacagccgcaguucucauguugguggcccacuacgcuaucauaggcccagggcugcaggcaaaagccacuagggaagcgcagaagcgcaccgcugccggaaucaugaagaauccuacaguagauggcauuguggcaaucgaccuagaucccgucguuuaugacgccaaauuugagaagcaacugggucagauuaugcuccuuauccuguguaccagucagauauugcugaugcggacuacgugggcucucugcgaaucgauuacacuggccaccgggccauuaacuacccuuugggagggaagcccuggcaaauucuggaacacaacuaucgcaguguccauggcuaauaucuuccgagguucuuaccuggccggcgcggggcucgccuuuucacuaaugaagagccugggaggcgggagaaggggaaccggcgcacagggugagacauugggggaaaaauggaagcgccaacugaaccagcucuccaagagugaguucaauacguauaaacggucuggaauuauggaagucgacagaagcgaggcuaaggaaggccuuaaacguggugagaccacuaagcaugccgugucaaggggcacagcaaaacugcggugguuuguagagcgcaacuuggugaagcccgaagggaagguuaucgaucugggauguggccgagggggaugguccuacuauugcgcuggccucaaaaaggugaccgaggucaaagguuacacuaaggggggaccgggccacgaagagccaauaccuauggccacauacggcuggaauuuagugaaacugcauagugggaaggacgucuucuuuaugcccccagaaaaaugugauacccuucugugcgacauuggagagagcucucccaacccuacgaucgaggaagguagaacccuaagggugcucaagaugguugagccguggcugcggggcaaucaguucuguauuaagaucuugaaccccuauaugccauccguaguggaaacacuggagcagaugcaacgcaaacacgggggaaugcucgucagaaauccucuuucaaggaacagcacucacgagauguacugggugucgugcggcaccgguaauauaguuucugccgugaacaugacaagucgaaugcuguuaaaccgguuuacuauggcgcaucguaagcccaccuaugaaagagaugucgaccugggggcuggaacacgccacguggcaguagagccugaaguggccaauuuggauaucauuggccagaggaucgagaacauuaaaaaugaacauaaguccaccuggcacuacgacgaggauaacccauauaaaacuugggcuuaccacggcagcuaugagguuaagcccucaggguccgccucuagcauggucaauggaguggugaagcuccugacgaaaccuugggacgucaucccaaugguuacacagauugcaaugaccgauacuacccccuucggucaacagcggguguuuaaggaaaaaguagacacaagaacgccgcgcgccaagaggggcaccacucagaucauggaggugacagcuaaauggcuauggggguuccuuagucgaaacaagaagccucggauauguaccagagaagaguuuacuaggaaaguccgcuccaaugcggccauuggagcaguguucguugacgaaaaccaguggaauagcgcuaaggaggccguggaggaugaacguuuuugggaccugguccaucgggagagagaacuccacaaacaaggcaagugcgcaacaugcguguacaacaugauggguaaaagggagaagaagcugggggaauucggaaaagccaagggcucucgcgcuaucugguacaugugguugggcgcccgauuccuggaguuugaggcgcucggguucaugaaugaagaucauugguuuucacgggagaacagucuuuccggaguagaaggugagggccugcacaaauuaggguauauccugagagacauuagcaagauaccaggaggcaauauguacgcagaugacaccgccgguugggauacaaggaucacugaggacgauuugcagaacgaagcuaaaauuaccgacaucauggagcccgaacaugcccuccuggcaacgucuauuuucaagcuaaccuaucagaauaaaguugugcgcguccagagaccugcuaagaacgggacagugauggaugugaucucgcggagggaccaacguggaucaggccaggucggcacuuacgggcuuaacaccuuuacaaauauggagguucagcugauacgacagauggaaagcgagggaaucuuccucccauccgagcuggaaacucccaacuuggccgagcgcgcuuuagauuggcuggaaaagcacggugccgagagacucaaacggauggcaauuaguggcgacgacugugugguaaagccgaucgaugacagguuugcgaccgcccuuacggcucugaaugauauggggaaagugcgcaaggacauuccucaaugggaacccucuaaaggauggaacgauuggcagcaggucccauucugcagccaccauuuucaccagcuaaucaugaaggacggcagagagauagugguuccuugucggaaucaagaugagcugguggguagggcccgagucucccagggggcaggauggucacuccgugaaacagcuugcuugggcaagaguuaugcccagauguggcaacugauguacuuccauagacgcgaccuucggcuggcagccaacgcgauuuguucugcugugcccguagauuggguuccaaccagcaggacuacaugguccauccacgcccaccaucaguggaugaccacugaggacaugcucucaguguggaauagagucuggaucgaagagaaccccuggauggaagauaaaacccacgugagcucuugggaggagguuccuuauuuaggcaagcgcgaagaccaguggugcgggucccugauuggauugacagcacgggccacgugggcuaccaauauacagguggccaucaaccaagucaggcgacugauugguaaugagaacuaccucgacuacaugacuaguaugaaaagauuuaagaaugaaagcgauccagagggcgcacuuugguga

SEQ ID NO: 13530 - RNA, 9879 nt, Artificial Sequence
  derived and/or modified CDS sequence (opt3) from DENV-1__FJ850104__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaauguaaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaggguugaaacuugggcccugcggcacccuggauucaccgugauugcucuguuucucgcacaugccaucggcacaucgauuacccagaagggcaucauauucaucuuacugaugcuugucacgccaucaauggcuaugcgcugcguggggauuggaaacagagauuuuguagaggguuugagcggcgccacuuggguugacgugguccuggagcacgggaguugugugacaaccauggcgaagaauaaacccacucuagauaucgaacuccugaagacagaggugaccaacccugcaguccuuaggaaacugugcauugaagccaagaucuccaauacgaccacagacucucgguguccaacucaaggagaggcuaccuugguugaagagcaggaugccaacuucgugugccgccgaacauuuguagacagaggcugggguaauggguguggacucuucggcaaaggcagccuguuaacuugcgcaaaguuuaagugcgugaccaaacuggaggggaagauaguccaguacgaaaaccucaaauauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaaggacuggacuagauuucaacgaaauggugcugcucacaaugaaggagaaaagcuggcugguacauaagcagugguuucuugaccugccguugcccuggacgucuggcgccuccaccucacaagagacuuggaaucggcaggaucuccugguuacauucaaaaccgcacacgcuaagaagcaggaaguggucguguuagguagccaagagggggccaugcacacagcucugacuggcgccaccgaaauccagacgaguggaaccacaacuauuuuugcaggccaucuaaaaugccgucucaagauggacaaacugacccuuaaggggaugucuuaugucauguguacaggauccuucaaauuggagaaggaaguggccgagacucagcacgguaccguucuggugcagguaaaguacgagggcacggaugcuccuugcaaaauaccauucagcacacaagacgaaaagggggucacccagaacggacgccucaucacugcgaaucccauugugacagauaaagagaagccuguuaacaucgaaaccgagccacccuuuggcgagucguauauaguggucggugcaggggaaaaagcccugaagcuuucuugguucaagaaaggcuccucaauuggaaagauguuugaggcuacugccagaggcgcaaggcggauggccauccugggggacaccgcuugggauuucggaaguaucgguggcguguuuacaagcguagggaaauuggugcaucagguuuucggaacggccuacggcguccucuuuuccggugugucuuggaccaugaagauugggaucggcauucuguuaacuuggcugggacuaaauagccgaucaacaagucucuccaugaccuguauagcagugggcauggucacacuguaccuugggguuauggugcaggcggacagcggaugcgugaucaacuggaaaggccgcgaauugaagugugguucugggauuuucguaacuaacgagguccacaccuggacggaacaauauaaguuucaggcugauucaccgaaaagacugagugccgcaaucggaaaggccugggaggagggcgugugcgguaucaggagcgcuacacggcucgaaaauauuauguggaaacagauauccaacgagcugaaucauaucuuacuggaaaacgacaugaaguucaccguuguggucggcgacgccaaugggauucuugcacagggaaaaaagaugauccgcccucaacccauggagcacaaauacucuuggaagucguggggcaaggcuaaaauuaucggggccgauauacagaacacuaccuuuaucauugacggaccagauacaccugaaugucccgacggccagagagcguggaauaucugggagguggaggauuaugguuucgggauuuuuacuaccaacaucugguugaagcucagggacagcuacacacagaugugcgaucaccgucugauguccgccgcuauaaaagacucaaaggcaguucaugccgauaugggauauuggauugaaagugagaaaaaugaaacguggaagcuagcucgggccucuuucaucgaggugaagaccuguacuuggccaaaaagccacacacugugguccaacggcguacucgaaucagagaugauuauccccaagauauacgguggcccuaucagccaacauaaucaccgaccaggguauuucacccagacugcaggaccguggcaccugggcaaacuugaguuggacuuugaucugugcgaagggacaaccgucgugguggacgagcauugcggaaacagaggccccucuuuaaggacgacuaccgucacagguaagauuauccacgaaugguguugccgcuccuguacccucccuccacugcgguucagaggggaggauggaugcugguacggcauggagauuaggcccguuaaagaaaaggaggaaaaucuugugcgcaguaugguaagcgcggguucuggcgagguggacuccuuuucacuggggaucuugugugucaguauaaugauugaagaggugaugcgaagccgguggucgcguaagaugcucaugacuggaacacuggccguuuuccuacugcucaucaugggccagcugaccuggaacgaccuuaucagauugugcauuauggugggggcuaaugccuccgauaggaugggaaugggcacaacuuaccuggcauuaauggcuaccuuuaaaaugcgcccuauguucgccgucggucuccuguuucggagacuuacgucuagggaggugcugcuacucacaaucgggcugagcuugguugcaucaguggaacugccaaacaguuuagaggaacucggagacggccuggccaugggcauuaugaugcuuaagcuguugaccgaguuccaaccccaucagcucuggacuacccugcuaucccugacauuugucaaaacuacccuuucucucgauuaugcuuggaagacgacagcgaugguacugagcauaguguccuuguucccgcuguguuuaucaaccacuagccagaaaacaaccuggcucccuguucugcuugggaguuuuggaugcaagccacugacuauguucuugaucacagaaaacaagauuuggggucgaaaaucuuggccccucaaugagggcaucauggccauugggaucguguccauacugcuaagcucgcugcuuaagaacgacgucccucucgcaggaccccugaucgcuggcgguauguugauugccuguuacgugaucucagggucuagugccgauuuaucccuggagaaagcugcagaaguaagcugggagcaggaagccgagcacucuggagcgagccauaauauucucguggaaguccaagacgauggcaccaugaagaucaaagacgaggagcgcgaugacacgcugacuauacuucugaaggcuaccuugcuagccguuuccggcguguauccaaugucaauuccugcaacacuguuugugugguacuucuggcagaaaaagaagcagcggagugggguccucugggauacccccagcccaccggaaguggagagagccguucuggacgauggaaucuauaggauccuucagcgugguuuacugggccgcucucaaguaggggugggagucuuccaggacggcguguuucacacaauguggcacguuacucggggugcugugcucauguaccaggggaaaagauuggaaccuuccugggcaucagucaagaaagaccugauuaguuauggaggcggcuggagguuccaggggagcuggaacaccggagaggaggugcaaguaauagccgucgaacccgguaagaauccaaaaaacgugcagacgacacccggcacuuuuaagaccccugagggggaaguuggagcgaucgcucucgauuucaagccaggcacauccgguucucccauugugaaucgagaggggaaaaucgucggacuguacggcaacggcgugguuaccacuucggggaccuacgugagcgccauugcacaggccaaggcuucacaagaaggaccucuuccggagaucgaggacgaagucuuuaaaaagcggaaucugacaauaauggauuugcauccagguuccggcaaaacgcgcagauaucuacccgccaucgugagggaggcaauuaagcggaagcugcgaacucucaucuuagcuccuaccagaguaguggccagugaaauggcggaggcccugaaagggaugccaauucgcuaccagacaaccgcaguuaagucugaacacacuggaagggagaucgucgaccuuaugugccaugcuacauucaccaugcgucugcucagccccgugcgggugccuaacuauaauaugauaauuauggaugaggcccacuuuacggacccggcuuccaucgcagccagaggcuacaucucaacuagggucgguaugggggaagccgcugcgauuuucaugacagcaacccccccaggaucuguagaggccuuuccucagagcaacgcugugauccaggaugaagagcgcgacauacccgaacgaaguuggaauuccggcuaugauuggauuaccgacuucccaggcaaaacuguuugguuugugccuagcaucaagucugggaacgauauugccaauuguuugagaaaaaacggaaagcgggucauccaacugucaaggaagacauucgacaccgaguaccagaaaacaaagaacaaugacugggauuaugugguuacuacggacauauccgagaugggugcaaacuuccgcgccgaucgugugauugaccccagacggugccucaaaccagucauccugaaggauggcccggaaagggugauccuugcugggccuaugcccguaaccguggcgagugccgcacagcgccgaggaagaauuggccggaaucagaacaaagagggugaccaauacguuuacauggggcagccacuaaauaacgaugaagaccaugcucacuggacagaggccaagaugcuguuggauaauaucaacacucccgagggcauuauaccugcauuauuugaaccagagagggaaaagagcgccgcuaucgacggagaguaucgccugagaggcgaagccaggaaaaccuucgucgagcucaugcggcguggggaucugcccguguggcuuucguacaagguggcgucugagggauuucaguauuccgaccgccgauggugcuucgauggugaaagaaauaaccagguccuggaggaaaauauggacguugagauuuggacaaaagaaggcgagaggaagaaacuccggccucgcugguuggacgcaagaaccuacagcgauccgcuggcccuaagggaguuuaaggaauucgcugccgggcggcgaucagugaguggagaccugauccucgagaucggcaaacuuccacaacaccugacuuuaagagcucagaacgcauuggauaaucugguaaugcuccauaacucugaacagggugggaaggccuaucgccacgcuauggaggaacugcccgacacgauugagacccuuaugcugcucgccuugauagcagugcugacaggcggagucacuuuauuuuuccuauccggcaaggggcugggaaaaaccagcaucggucuccuuugugugacagcgucaagugcccuguuguggauggcuagcguugagccucauuggauugccgcauccaucauucuggaauuuuuccucauggugcugcuuauccccgagccagauaggcagcggaccccucaagacaaucagcucgcuuacgucguaauaggccuguuguuuaugauccugacuguggccgcaaacgaaaugggguuacuagagacaacgaagaaagaucugggaauuggcuauguugccgcugagaaccaccagcacgcgaccaugcucgacguggaucuucgucccgccucugcauggacucuguacgcugucgccacaaccgugaucaccccaaugaugagacauacaauugaaaauacuacggccaacaucagcuugaccgcaauagcuaaucaagccgcgauucugaugggucucgacaagggguggccuaucuccaaaauggauauuggcgucccgcugcuugcuuuaggaugcuacucacaggugaacccccugacacucacugccgcaguuuugaugcugguggcccacuaugcuaucauaggcccagggcuacaggcaaaggccaccagggaggcgcagaagcgcacagcugccggaaucaugaaaaauccuaccguagacggcauuguggcaaucgaucuggaccccgucguuuacgacgccaaguucgaaaaacaacucggucagauuaugcuucugaucuuguguacuucucagauacugcucaugcggacgacaugggcucugugcgagaguauuaccuuagccacugggccacuuaccacacugugggaaggaucgccuggcaaguuuuggaacacuaccaucgcagugagcauggcuaauaucuuccgagguuccuaucucgccggcgcggggcuagccuucucucugaugaaaucauugggaggcgggagaaggggaacaggcgcacagggugagacgcugggggagaaguggaagcgccaacucaaccagcuuagcaaauccgaauuuaauaccuacaagcggaguggaauuauggaggucgauagaucugaagcuaaagagggccugaagcguggugaaacuacaaaacaugccgugagcaggggcaccgcaaaguugcggugguucguagagcgcaaccuggugaagcccgaggggaaaguuaucgaccucggauguggccgagggggauggucauauuacugcgcuggcuuaaagaaagugacugaagucaaggguuauacaaaagggggaccgggccacgaggaaccaauaccuauggccaccuacggcuggaaucuggugaagcuucauuccgggaaagaugucuuuuucaugcccccagagaagugugacacgcugcuaugcgauauuggagaaaguagccccaacccuaccaucgaggaggguagaacacucagggugcugaagaugguugaaccgugguugcggggcaaucaguuuuguauuaaaauccugaaccccuacaugccaucuguaguggagacucucgaacagaugcaacgcaagcacgggggaaugcuugucagaaauccucuguccaggaacucaacccacgagauguauugggugagcugcggcacagguaauauaguuucggccgugaacaugacuucucgaauguuacugaaccgguucaccauggcgcaucguaaacccacauacgagagagacgucgauuugggggcuggaacccgccacguggcaguagaaccugaggaagccaaucucgacaucauuggccagaggaucgagaacauuaagaaugaacauaaaaguacuuggcacuaugaugaggacaacccauacaagacgugggcuuaucacggcuccuacgaggugaagcccagcgggucagccuccucuaugguuaauggagucgugcggcugcuaacaaaaccuugggaugugaucccaauggucacccagauugcaaugacugacaccacacccuuuggucaacagagaguuuucaaggaaaaaguggacacgcgcaccccgagggccaagcgaggcacuacacagaucauggagguaaccgcuaaauggcuuuggggguuucugagccggaacaagaagccuagaauauguacuagggaagaguucacacgcaaagugcguaguaaugcggccauuggagcagucuuuguggaugaaaaccaguggaauuccgcuaaggaggccguugaggacgaacgguucugggaucucgugcauagagagagggaacugcacaaacaaggcaagugcgcaaccugcgucuauaacaugauggguaaacgcgagaagaaguugggggaauuuggaaaagccaagggcagccgagcuaucugguacauguggcugggcgcccgguuccucgaguucgaggcgcuuggguuuaugaaugaagaccauugguucucuagagagaacucacugaguggaguggaaggugagggcuuacacaaacugggguacaucuugagggauauuuccaagauaccaggaggcaauauguaugcagacgauacagccgguugggacacucgcaucaccgaggaugaccuccagaacgaagcuaaaauuacggauaucauggagcccgaacaugcccugcuagcaaccagcauuuuuaagcuuacauaccagaauaaaguaguuagagugcagcggccugcuaagaacgggacugucauggacgugaucucuaggcgugaucaacgaggaucgggccaggugggcaccuaugggcugaacacauucacuaauauggagguccagcucauacgccagauggaaucagagggaaucuuucugccaagcgaguuggaaacccccaacuuagccgagagaguucuggacuggcucgaaaagcacggugcugagcggcuuaaaaggauggccauuuccggcgacgauugugugguaaagccgaucgacgaucgcuucgcaacggcgcugacagcccuaaaugacauggggaaagugagaaaggauauuccucaaugggaacccaguaaaggauggaacgacuggcagcaggucccauuuugcucucaccauuuccaccagcugaucaugaaggauggccgggagauagugguuccuuguaggaaucaagacgagcucgugggucgagcucgugucagccagggggccggaugguccuugagagaaaccgcaugccugggcaagucauacgcucagauguggcaacuuauguauuuucaucgccgggaucugaggcucgccgcaaacgccauuuguagugcggugcccguagacuggguuccaacuucuagaacaaccuggagcauccacgcucaccaucaguggaugacuaccgaggauauguuauccguguggaaucgcgucuggaucgaagagaaccccuggauggaagacaaaacacacgugucaagcugggaggagguuccuuaccugggcaagcgggaagaccaguggugcgggucuuugauuggacugacggccagggcaaccugggccacuaauauacagguggcuaucaaccaaguccgaagacucauugguaaugagaacuaucuugauuacaugacauccaugaaacgguucaagaaugaaagugacccagagggcgcccugugguga

SEQ ID NO: 13531 - RNA, 9879 nt, Artificial Sequence
  derived and/or modified CDS sequence (opt3) from DENV-1__JN819405__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacucaccuggcuuuaauggccaccuuuaaaaugcgcccuauguucgcagugggucuccuguuucggagacuuacgucuagggagguccugcuacucacaaucgggcugagcuugauggccucaauggaacugccaaacaguuuagaggaacucggagacggccuggcuaugggcauuaugaugcuuaagcuguugaccgaguuccaaccccaucagcucuggacuacccugcuaucccugacauuugugaaaacuacccuuucucucgauuaugcguggaagacgacagccaugauacugagcaucguuuccuuguucccgcuguguuuaucaaccacuagccagaaaacaaccuggcucccugugcugcuugggaguuuuggaugcaagccacugacuauguucuugauuacagaaaacaagaucuggggucgaaaaucuuggccccucaaugagggcauuauggcaaucgggauagucuccauccugcuaagcucgcugcuuaagaacgacguaccucucgcuggaccccugauugccggcgguauguugaucgccuguuacgugauuucagggucuagugcugauuuaucccuggagaaagcagccgaaguuagcugggagcaggaagcggagcacucuggagcuagccauaauauccucguggaaguccaagacgauggcaccaugaagauaaaagacgaggagcgcgaugacacgcugacuauucuucugaaggccaccuugcuagcaguguccggcguauauccaaugucaaucccugccacacuguuugugugguacuucuggcagaaaaagaagcagcggagugggguccucugggauacccccagcccaccggaaguugagagagcugugcuggacgauggaaucuauaggauucuucagcgugguuuacugggccgcucucaagugggggucggaguguuccaggacggcguuuuucacacaauguggcacguaacucggggugcagugcucauguaccaggggaaaagauuggaaccuuccugggccucagucaagaaagaccugauaaguuauggaggcggcuggagguuccaggggagcuggaacaccggagaggaggugcaaguuaucgcgguggaacccgguaagaauccaaaaaacguccagacgacacccggcacuuuuaagaccccugagggggaagugggagcuauugcccucgauuucaagccaggcacauccgguucucccaucguaaaucgagaggggaaaauugucggacuguacggcaacggcgugguuaccacuucggggaccuacgugagcgcaaucgcccaggcuaaggccucacaagaaggaccucuuccggagauagaggacgaagucuuuaaaaagcggaaucugacaaucauggauuugcauccagguuccggcaaaacgcgcagauaucuacccgcaauugugagggaggcuaucaagcggaagcugcgaacucucauuuuagccccuaccagaguuguggcgagugaaauggccgaggcacugaaagggaugccaauccgcuaccagacaaccgcugucaagucugaaacuacaggaagggagauaguggaccuuaugugccacgccaccuucacgaugcgucugcucagccccguacgggugccuaacuauaauaugauuaucauggaugaggcucauuuuacugacccggcauccaucgccgccagaggcuacauuucaacaaggguugguaugggggaagcugcggcaaucuucaugaccgccacccccccaggaucugucgaggcuuuuccucagagcaacgccgugauacaggaugaagagcgcgacauucccgaacgaaguuggaauuccggcuaugauuggaucacugacuucccaggcaaaacagugugguuugucccuagcauuaagucugggaacgauaucgcaaauuguuugagaaaaaacggaaagcggguaauacaacugucaaggaagaccuucgacacagaguaccagaaaacuaagaacaaugacugggauuaugugguuacgaccgacauuuccgagaugggugccaacuuccgcgcugaucgugugaucgaccccagacggugccucaaaccagucauccugaaggauggcccggaaagggugauucuugcggggccuaugcccguuacaguggccagugcagcucagcgccgaggaagaaucggccggaaucagaacaaagagggugaccaauacgucuacauggggcagccacuaaauaacgaugaagaccacgcccauuggacugaggcaaagaugcuguuggauaauauuaacacccccgagggcauaaucccugccuuauuugaaccagagagggaaaagagcgcugccauugacggagaguaucgccugagaggcgaagcgaggaaaacauucguggagcucaugcggcguggggaucugcccguauggcuuucguacaagguggcaucugagggauuucaguauuccgaccgccgauggugcuucgauggugaaagaaauaaccagguucuggaggaaaauauggacgucgagaucuggaccaaagaaggcgagaggaagaaacuccggccucgcugguuggacgccagaacuuacagcgauccgcuggcucuaagggaguuuaaggaauucgccgcugggcggcgaucagugaguggagaccugauccucgagauuggcaaacuuccacaacaccugacguuaagagcacagaacgccuuggauaaucuggugaugcuccacaacucugaacagggugggaaggcuuaucgccaugccauggaggaacugcccgacaccauagagacacuuaugcugcucgcauugaucgcgguccugacuggcggaguuaccuuauuuuuccuauccggcaaggggcugggaaaaacaagcauuggucuccuuugugugaccgccucaagugcucuguuguggauggccagcguagagccucacuggaucgcagcuuccauuauccuggaauuuuuccucauggugcugcuuauacccgagccagauaggcagcggacuccucaagacaaucagcucgccuacgucgugaucggccuguuguuuaugauucugacaguugcagccaacgaaaugggguuacuagagacgaccaagaaagaucugggaaucggcuauguggcugcggagaaccaucagcacgccacuaugcucgacgucgaucuucgucccgcaucugcuuggacacuguacgccguagccaccaccgugauuacaccaaugaugagacacacuaucgaaaauacgaccgcaaacauaagcuugacagcuauugccaaucaagcggcuauccugaugggucucgacaagggguggccuauuuccaaaauggauaucggcguuccgcugcuugccuuaggaugcuacucacaggugaacccccugacucucaccgcagccgucuugaugcugguggcucauuaugcaauaaucggcccagggcuacaggccaaggcgacaagggaggcucagaagcgcaccgccgcaggaauuaugaaaaauccuacugucgacggcaucguggccauugaucuggaccccguuguguacgacgcuaaguucgaaaaacaacucggucagaucaugcuucugauauuguguacgucucagauucugcucaugcggacaaccugggcccugugcgagaguaucacuuuagcaaccgggccacuuacaacucugugggaaggaucgccuggcaaguuuuggaacaccacaaucgcuguaagcauggccaauauuuuccgagguuccuaucucgcgggcgccgggcuagcauucucucugaugaaaucauugggaggcgggagaaggggaacgggcgcucagggugagacccugggggagaaguggaagcgccaacucaaccagcuuagcaaauccgaauuuaauacuuacaagcggaguggaaucauggagguggauagaucugaagccaaagagggccugaagcguggugaaacaaccaaacacgcagucagcaggggcacugcuaaguugcggugguucguugagcgcaaccuggugaagcccgaggggaaagucauagaccucggauguggccgagggggauggucauauuacugcgccggcuuaaagaauuuuacagaagugaaagguuauaccuccgggggaccgggccaugaggaaccaauuccuauggccacguacggcuggaaccugguaaagcuucacagugggaaagauguguucuuuaugcccccagagaagugugacacccugcuaugcgauaucggagaaagcucucccaauccuacaauugaggaggguagaacucucaggguucugaaaaugguggaaccgugguugaagggcaaccaguucuguaucaagauacugaaucccuacaugccauccgucguggagacccucgaacagaugcaacggaaacaugggggaaugcuuguccgcaacccucugucaagaaauagcacacacgagauguauugggugucgugcggcacugguaacaucguuucugcgguaaacaugaccaguaggauguuacugaaucgauuuacaauggcucaccggaagcccaccuacgagcgugacguggauuugggggcaggaacuagacaugucgccguggaaccugagguugcuaaccucgacauuaucggccagcgcauugaaaauaucaaaaacgagcacaaguccacguggcauuaugaugaagacaauccauacaaaacaugggccuaucacggcagcuacgaggugaagcccucaggguccgcaucuagcauggucaacggagugguaaggcugcuaaccaagccuugggaugugauuccaaugguuacucagaucgccaugaccgacacaacgcccuucggucaacagcgggucuuuaaagagaagguggacaccagaacuccgcgcgcuaaaaggggcacaacccagauaauggaagugacugcgaaguggcuuuggggguuccugagucgaaauaaaaagccucggauuuguacaagagaggaauuuaccaggaagguccgcuccaacgccgcaaucggagcuguuuucguggaugagaaucaguggaacagcgccaaagaagcaguagaggacgagcguuuuugggaucucgugcaccgggaaagagagcugcauaagcaaggcaaaugcgccacaugcgucuauaauaugauggguaagagggaaaaaaaguugggggaguucggaaaggcuaaaggcucucgcgccaucugguacauguggcugggcgcgcgauuccucgaauuugaggcacuuggguucaugaacgaggaccacugguuuucacgggaaaauagucuguccggaguggagggugaaggcuuacauaagcugggguacauuuugagagauauaagcaaaaucccaggaggcaacauguaugccgacgauacugcugguugggacaccaggauuacggaggaugaccuccagaaugaggccaagaucaccgauauuauggaacccgagcacgcacugcuagcuacaucuaucuucaaacuuacuuaccagaacaagguugugcgcguccagagaccugccaaaaacgggaccgugauggacguaauaucgcggagggaucaacguggaucaggccagguuggcacauaugggcugaauacuuuuaccaacauggaagugcagcucauccgacagauggagagcgaaggaauuuuccugccauccgaguuggagacgcccaauuuagcugaacgcguccuggacuggcucgagaagcauggugccgaaagacuuaagcggauggcaaucaguggcgacgauuguguggugaaaccgauugacgauagguuugcgacagcccugaccgcucuaaacgacauggggaagguccgcaaagauaucccucaaugggagcccucuaagggauggaaugacuggcagcagguuccauucugcagccaccacuuucaucagcugauaaugaaagauggcagagaaauugugguaccuugucggaaccaagacgagcucguggguagggcccgagucucccagggggcaggauggucauugcgugagacugcuugccugggcaagaguuacgcccagauguggcaacuuauguauuuccacagacgcgaucugcggcucgcagccaaugcgaucuguucugcugugcccguugacugggugccaacaagcaggaccacuugguccauccaugcccaccaccaguggaugaccacagaagauauguuaucagucuggaacagaguguggauugaggaaaaucccuggauggaggacaagacgcauguaagcucuugggaagagguuccuuaccugggcaaacgcgaggaccaguggugcggguccuugauaggacugaccgcacgggccacuugggcuacaaacauccagguggccauuaaucaagucaggcgacucaucgguaacgaaaauuaucuugauuacaugaccaguaugaagagauuuaaaaacgagagcgacccagaaggcgcacugugguga

SEQ ID NO: 13532 - RNA, 9879 nt, Artificial Sequence
  derived and/or modified CDS sequence (opt3) from DENV-1__GQ199877__SS-prME
agcgugaccaugcugcucaugcuucugcccacugccuuggcuuuccacuuaacuacgaggggcggggagccucauaugaucgucuccaaacaggaaaggggaaaaucucugcuauuuaagaccucagcugguguuaacaugugcacucucauugccauggaccugggcgagcuuugugaagauacuaugaccuacaaaugcccacggauaacagaggcggaaccggacgauguggacuguuggugcaaugcuaccgauacuuggguaaccuaugggaccuguagucaaacgggagagcaccgccgagagaagcguagcguggcccuggcuccccaugucggcuugggucucgaaacuagaaccgagacauggauguccucugaaggggccuggaaacagauccagaggguggagacuugggcccugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuacgguggcccuauaagccaacauaauuauagaccaggguacuuuacccagacugcgggaccguggcaccucggcaagcuggaacuugauuucgacuugugcgaggggacaaccgucgugguggaugaacacugcggaaacaggggccccucucugcgcacgacuaccgucacagguaaaaucauucaugagugguguugccgguccuguaccuuaccuccacucagauuuagaggggaagacggaugcugguacggcauggaaauccgccccguuaaggagaaagaagagaaucuggugcgaaguaugguaagcgccgguucuggcgaaguggauuccuucucacuugggauucugugugucaguaucaugauagaggaggugaugcggagccguuggucgagaaagauguugaugacuggaacacucgcuguuuuucugcuacugauuaugggccagcucaccuggaacgaccugaucaggcuuugcaucauggugggggccaaugcauccgaccgcaugggaaugggcacaacuuauuuggcucugauggccaccuucaagaugcggccuauguuugcagucgguuuacucuucagaaggcugacgucucgagaagugcuucugcuaacaauugggcucagccugguugccucaguggaguugccaaguucccuggaagaguuaggagauggccucgcuaugggcaucaugaugcugaaacuucugaccgaauuucaaccccaccaguuguggacuacccuccugucucuaacauucgucaagacuacccugagccuugacuacgcguggaaaacgacagccaugguacucuccauugugucacuguuuccguugugucugagcaccacaagucagaagacaaccugguuaccuguucuccuggggucuuucggaugcaaaccacuuacuauguuucugauaacagagaacaagaucuggggucgcaaguccuggcccuugaacgagggcauuauggcaaucgggauugugagcauccuccugucgucacuacugaaaaaugaugucccucuugcuggaccccucauagccggcgguaugcugaucgccuguuaugugauuucugggaguuccgcugacuugagcuuagaaaaggcagccgagguaucuugggaacaggaggcggaacauagcggagcuucccacaacauccugguggagguccaagaugacggcaccaugaaaauuaaggaugaggaacgggacgauacgcucacuauccugcuuaaagccacccuguuggcaguuucaggcguguacccaaugaguauaccugccacacuauucgugugguauuucuggcagaagaaaaagcagagaagcgggguccugugggacacccccucuccaccggagguggaaagggcuguucucgaugacggaauuuaccguauccugcagcgcggucuuuuaggccggucccaaguaggggugggagucuuucaggauggcguguuccauacaauguggcacguuacuagaggugcagugcugauguaucaggggaagaggcucgagccuucaugggccagugucaaaaaggacuugaucagcuacggaggcggcuggcgauuucagggguccuggaauaccggagaggaagugcaaguaauugcggucgagcccgguaaaaacccaaagaaugugcagacgacacccggcacuuucaaaaccccugaaggggagguuggagcuauagcccuggacuuuaagccaggcacaucugguucgcccaucgugaaccgggaagggaagauugucggacucuacggcaauggcgugguuaccacuagcgggaccuaugugucagcaaucgcccaggcuaaagccucccaagagggaccucugccggagauugaagaugaggucuucaagaaacgcaaccuuacaaucauggaccugcacccagguaguggcaagacgagaagguacuugcccgcaauagugcgggaagcuaucaaacgaaagcuaagaacucugauucucgccccuacccgcguaguggcgucugagauggccgaagcauuaaaggggaugccaaucagguaucagacaaccgcuguuaaaagcgagcauacuggacgugagauugucgaucugaugugccacgccacauuuaccaugcggcuucugucccccgugagagugccuaauuacaacaugaucauaauggacgaagcucauuucacggauccggcaucaauugccgccaggggcuauaucucuacucgcgucgguaugggggaggcugcggcaaucuuuaugacagccacacccccaggaagcguagaggcuuucccucagaguaaugccgugauucaggacgaggaacgagauauccccgagagauccuggaacagcggcuacgacuggauaaccgauuuuccaggcaagacuguuugguucgugccuucuauuaaaucagggaaugacaucgcaaacugucuccggaagaauggaaaaagggucauucaauugucccgcaagacauucgauaccgaguaucagaagacuaaaaacaacgacugggacuacgugguuacuacggauaucagugaaaugggugccaauuuucgugcugacagagugauagauccccggaggugccugaagccagucauucucaaagacggcccggagcgcgugauccuggcggggccuaugcccguaaccguggccagcgcagcucagcgaagaggacggaucggcaggaaccagaauaaggaaggugaucaauacguuuauauggggcagccacuuaacaaugacgaggaucacgcccauuggacagaggcaaaaaugcuacuggacaacauuaauacucccgaaggcaucauuccugccuuguucgagccagaacgcgagaagucggcugccauagauggagaauacagauuaaggggcgaggcgcggaagaccuuugucgagcugaugcgucgcggggaccuccccguguggcugucuuauaaaguggcauccgaaggauuccaguacagcgaucgaagauggugcuuugacggugagaggaacaaucagguccuugaagagaacauggauguugaaaucuggacaaaggagggcgagcggaaaaagcugcgcccuagauggcucgacgccaggaccuauucagacccguuggcucugcgggaguucaaagaguuugccgcugggcgaagaagugugucuggagaucuaauucuggaaaucggcaagcucccacaacaccuuacucugcgcgcacagaaugccuuagacaacuugguaaugcugcacaauuccgagcagggugggaaggcuuacaggcaugccauggaagaacuccccgauacgaucgagacccugaugcuucuggcacucauugcgguguugacaggcggagucacucuguucuuuuuaagcggcaaggggcuaggaaagaccucaauaggucugcucugugugacagccaguagcgcacuucuguggauggccuccguugaaccucacuggaucgcagcuucuauuaucuuggaguucuuucugauggugcuccugauucccgaaccagaccggcagcguaccccucaagauaaccagcuugccuaugucguaaucggccuccuguucaugauauugacuguggcagccaaugagauggggcuguuagagacaacgaaaaaggaccuaggaaucggcuacguugcugcggaaaaccaucagcacgccaccaugcuggauguggaccuccaccccgcaagcgcuuggacucuuuacgccgucgccacaaccgugauuaccccaaugaugagacauacaaucgagaacacuacggcaaauauuucccugaccgcuaucgccaaccaagcggcuauauugaugggucuggauaaaggguggccuauuucaaagauggacaucggcgucccgcuccuggcccuuggaugcuauucucaggugaaucccuuaacacugacugcagccguucucauguugguggcucacuacgcaauuaucggcccagggcugcaggccaaagcgaccagggaagcucagaagcgcacagccgcaggaauaaugaagaacccuaccguagauggcaucguggccauugaccuagaucccgucguuuaugacgcuaaauuugagaagcaacugggucagaucaugcuccuuauucuguguacaagucagaucuugcugaugcggacgacaugggcccucugcgaaucgauaacccuggcaacugggccauuaaccacacuuugggagggaagcccuggcaaauucuggaauacuaccauugcuguguccauggccaacaucuuccgagguucuuaccuggcgggcgccgggcucgcauuuucacuaaugaaaagccugggaggcgggagaaggggaacaggcgcucagggugagacguugggggaaaaauggaagcgccaacugaaucagcucuccaagagugaguucaacaccuauaaaaagucuggaaucauggaagucgaccggagcgaggccaaagaaggccuuaagagaggugagacuacaaaacaugcagugucacguggcaccgcuaagcugaggugguuuguagagcggaauuuggugaagcccgaagggaaaguuauugaucugggauguggccgcgggggaugguccuacuauugcgccggccucaagaaagugacugaggucaaggguuacacaaaagggggaccgggccacgaagaaccaaucccuauggccaccuacggcuggaacuuagugaagcugcauagugggaaagacgucuucuuuaugcccccagaaaagugugauacgcuucugugcgacauaggagagagcucucccaauccuaccauugaggaaggucgaacacuaagagugcucaagaugguugagccguggcugaggggcaaccaguucuguaucaaaauuuugaaucccuauaugccauccguaguggaaacucuggagcagaugcaacggaagcacgggggaaugcucguccgcaacccucuuucaagaaauagcacccacgagauguacugggugucgugcggcacagguaacaucguuucugcggugaauaugacaaguaggaugcuguuaaaccgauuuaccauggcucaucggaaacccacauaugaacgugaugucgaccugggggcaggaaccagacacguggccguagagccugaaguggcuaacuuggauauaaucggccagcgcauugagaauaucaagaacgaacauaaauccacuuggcacuacgacgaggauaauccauauaagacgugggccuaccacggcagcuaugagguuaagcccucaggguccgcaucuagcauggucaacggaguggugaggcuccugacaaaaccuugggacgucauuccaaugguuacccagaucgccaugacugauaccacacccuucggucaacagcggguguuuaaggaaaaaguagacacgagaaccccgcgcgcuaagaggggcacuacacagauuauggaggugaccgcgaaauggcuauggggguuccuuagucgaaauaagaagccucggaucuguacuagagaagaguuuacaaggaaaguccgcuccaacgccgcaauaggagcuguguucguugacgaaaaucaguggaacagcgccaaggaggcaguggaggaugaacguuuuugggaccugguccaucgggagagagaacuccacaaacaaggcaagugcgcaaccugcguguacaauaugauggguaaaagggagaagaagcugggggaguucggaaaagcuaagggcucucgcgccauuugguacaugugguugggcgcgcgauuccuggaguuugaggcacucggguucaugaacgaagaucauugguuuucacgggagaauagucuuuccggaguagaaggugagggccugcacaaauuaggguauauccugagagacaucagcaagauuccaggaggcaacauguacgccgaugacacagcugguugggauacuaggauaaccgaggacgauuugcagaaugaagccaaaaucacggacauuauggagcccgaacaugcacuccuggcuaccucuaucuucaagcuaacauaucagaacaaaguugugcgcguccagagaccugccaagaaugggacugugauggaugugauuucgcggagggaccaacguggaucaggccaggucggcaccuacgggcuuaacacauuuacuaacauggagguucagcugauccgacagauggaaagcgagggaauauuccucccauccgagcuggaaacccccaauuuggcugagcgcgccuuagauuggcuggaaaagcacggugcagagagacucaaacggauggcgaucaguggcgacgacugugugguaaagccgauugaugacagguuugccacggcucuuacagcccugaacgauauggggaaagugcgcaaggacaucccucaaugggaacccucuaaaggauggaaugauuggcagcaggucccauucugcagccaccauuuucaccagcuaauuaugaaggacggcagagagaucgugguuccuugucggaaccaagaugagcugguggguagggcacgagucucccagggggcuggauggucacuccgugaaaccgccugcuugggcaagaguuaugcacagauguggcaacugauguacuuccauagacgcgaccuucggcuggccgcgaaugcuauauguucugccgugcccguagauuggguuccaacuagcaggacaaccugguccauucacgcacaccaucaguggaugacuaccgaggacaugcucucaguguggaacagagucuggaucgaagagaaucccuggauggaagauaaaacacacgugagcucuugggaggagguuccuuauuuaggcaagcgcgaagaccaguggugcgggucccugaucggauugacggcccgggcuaccugggccacuaacauucagguggcaauaaaucaagucaggcgacugaucgguaacgagaauuaccucgacuacaugacaaguaugaaaagauuuaagaacgaaagcgauccagagggcgcucuuugguga

SEQ ID NO: 13533 - RNA, 9879 nt, Artificial Sequence
  derived and/or modified CDS sequence (opt3) from DENV-1__GU056029__SS-prME
agcgugacaaugcugcucaugcuucugcccacagccuuggcuuuccacuuaacuacgaggggcggggagccucauaugaucgucuccaagcaggaaaggggaaaaucucugcuauuuaagaccucagcugguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagggacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucugguccagggaaagaaaaugaucagaccucaacccauggaacacaaguacucuuggaaaucguggggcaaggcuaagauuaucggggccgacauacagaacacuaccuucaucauugauggaccagacacaccugagugucccgauggccagagggcguggaauaucugggagguggaagacuaugguuuugggguuuucacuaccaacauuuggcuuaaauugcgugauagcuacacacagaugugcgaccaccggcucauguccgccgcuaucaaggauucaaaagcagugcaugccgacaugggauauuggauagagagugaaaagaaugagacguggaaacuggcucgagccucuuucauugaaguaaagaccuguacuuggccaaagagccacacacuaugguccaacggcguccuggagucagagaugaucauucccaaaaucuacgguggcccuauaagccaacauaauuauagaccaggguacuuuacccagacugcaggaccguggcaccucggcaagcuggaacuugauuucgacuugugcgaggggacaaccgugguggucgaugaacacugcggaaacaggggccccucucugcgcacgacuaccguuacagguaaaaucauucaugagugguguugccgguccuguaccuuaccuccacucagauuuagaggggaagacggaugcugguacggcauggaaauccgccccgugaaggagaaagaagagaaucugguacgaaguauggugagcgcggguucuggcgaagucgauuccuucucacuugggauucugugugugaguaucaugauagaggagguuaugcggagccguuggucgagaaagauguugaugacuggaacacucgccguguuucugcuacugauuaugggccagcucaccuggaacgaccugaucaggcuuugcaucauggucggggcuaaugccuccgaccgcaugggaaugggcacaacuuauuuggcacugauggcuaccuucaagaugcggccuauguuugccguggguuuacucuucagaaggcugacgucucgagaaguucuucugcuaacaauugggcucagccugguggcaucagucgaguugccaaacagucuggaagaguuaggagauggccucgccaugggcaucaugaugcugaaacuucugaccgaauuucaaccccaccaguuguggacuacccuccugucccuaacauucguaaagacugcucugucucuugacuacgcguggaaaaccacggccauggugcucagcauuguuucccuguuuccguugugucugucaacaaccagccagaagacuacaugguuaccugugcuccuggggaguuucggaugcaaaccacuuaccauguuucugauaacugagaacaagaucuggggucgcaagucuuggcccuugaaugagggcauuauggcaaucgggauugucuccauccuccugagcucgcuacugaaaaacgaugugccucuugcuggaccccucauagccggcgguaugcugaucgccuguuauguaauuucagggucuagugcugacuuguccuuagaaaaggcagccgaggugagcugggaacaggaggcggaacauucuggagcuagccacaauauccuggucgagguucaagaugacggcacaaugaaaauuaaggaugaggaacgggacgauacccucacgauccugcuuaaagccacucuguuggcaguguccggcguguacccaaugucaauaccugccacccuauucgucugguauuucuggcagaagaaaaagcagagaaguggggugcugugggacacacccagcccaccggagguugaaagggcuguacucgauaacggaauuuaccguauccugcagcgcggucuuuuaggccggucucaagugggggucggaguguuucaggacggcguuuuccauaccauguggcacgugacaagaggugcaguccugauguaucaggggaagaggcucgagccuuccugggccucagugaaaaaggauuugaucaguuacggaggcggcuggcgauuucaggggagcuggaauacuggagaggaaguacaagucauugcgguggagcccgguaaaaacccaaagaauguucagaccacgcccggcacauucaaaacuccugaaggggaggugggagcuauagcccuggacuuuaagccaggcaccuccgguucucccaucgucaaccgggaagggaagauugugggacucuacggcaauggcguugugacaaccucggggacuuaugucagcgcaaucgcccaggcuaaagccucacaagagggaccucugccggagauugaagacgagguguucaagaaacgcaaccuuaccaucauggaucugcacccagguuccggcaagacaagaagguacuugcccgcaauaguacgggaagcuaucaaacgaaagcuaagaacgcugauucucgccccuacucgcgugguugcgagugagauggccgaagcauuaaaggggaugccaaucagguaucagaccacagcugucaaaucugagcauaccggacgugagauuguggaccugaugugccacgccacuuuuacaaugcggcuucugagccccgugagagucccuaauuacaacaugaucauaauggaugaagcucauuucaccgacccggcauccauugccgccaggggcuauaucucaacgcgcguagguaugggggaggcugcggcaaucuuuaugacugccacacccccaggaucuguggaggcuuucccucagagcaaugccguuauucaggaugaggaacgagacauccccgagagaaguuggaacuccggcuacgauuggauaaccgacuuuccaggcaagaccgugugguucgucccuagcauuaaaucugggaaugauaucgcaaacugucuccggaagaacggaaaaagggugauucaauugucacgcaagacuuucgacacagaguaucagaagaccaaaaauaacgauugggacuacguugugacaacugacaucuccgaaaugggugccaauuuucgugcugauagagucauagacccccggaggugccugaagccagugauucucaaagauggcccggagcgcguaauccuggcggggccuaugcccgugacgguugccagugcagcucagcgaagaggacggaucggcaggaaccagaauaaggaaggugaccaauacgucuauauggggcagccacuuaacaaugaugaggaccacgcccauuggaccgaggcaaaaaugcuacuggauaacauuaauacacccgaaggcaucauuccugccuuguucgagccagaacgcgagaaaagcgcugccauagacggagaauacagauuaaggggcgaagcgcggaagacuuuuguggagcugaugcgucgcggggaucuccccguguggcugucguauaaagucgcaucugaaggauuccaguacuccgaccgaagauggugcuuugauggugagaggaacaaucagguucuugaagagaacauggacguggaaaucuggaccaaggagggcgagcggaaaaagcugcgcccuagauggcucgaugccaggacauauagcgacccguuggcucugcgggaguucaaagaguuugccgcugggcgaagaucaguaaguggagaccuaauucuggaaaucggcaagcucccacaacaccuuacccugcgcgcacagaaugccuuagauaacuuggugaugcugcacaauucugagcagggugggaaggcuuacaggcaugccauggaggaacuccccgacacuaucgagacgcugaugcuucuggcacucauugcggucuugaccggcggagugacacuguucuuuuuauccggcaaggggcuaggaaagacuagcauaggucugcucuguguuaccgccucaagugcacuucuguggauggccagcguggaaccucacuggaucgcagcuuccauuaucuuggaguucuuucugaugguccuccugauucccgaaccagaucggcagcguacaccucaagacaaccagcuugccuauguagugaucggccuccuguucaugauauugaccguugcagccaacgagauggggcuguuagagacuaccaaaaaggaucuaggaaucggcuacguggcugcggaaaaucaucagcacgccacgaugcuggacgucgaucuccaccccgcaucugcuuggacccuuuacgccguggccacuacagucauuaccccaaugaugagacauaccaucgagaacacaacugcaaauauuagccugacggcuaucgccaaccaagcggcuauauugaugggucuggacaaaggguggccuauuuccaagauggauaucggcgugccgcuccuggcccuuggaugcuauucacagguuaaucccuuaacccugacagcagccgugcucauguugguagcucacuacgcaauuaucggcccagggcugcaggccaaagcgacuagggaagcucagaagcgcaccgccgcaggaauaaugaagaacccuacaguggacggcaucgucgccauugaucuagaccccguuguguaugaugcuaaauuugagaagcaacugggucagaucaugcuccuuauucuguguaccucucagaucuugcugaugcggacuacgugggcccucugcgaaaguauaacacuggcaaccgggccauuaacuacccuuugggagggaucgccuggcaaauucuggaauacaacuauugcugucagcauggccaacaucuuccgagguuccuaccuggcgggcgccgggcucgcauuuucucuaaugaagucacugggaggcgggagaaggggaaccggcgcucagggugagacauugggggaaaaauggaagcgccaacugaaucagcucagcaaguccgaguucaacacguauaaacggaguggaaucauggaaguggacagaucugaggccaaggaaggccuuaaacguggugagaccacuaagcaugcaguaagcaggggcacagcuaaacugcggugguuuguggagcgcaauuugguuaagcccgaagggaaggugauugaccugggauguggccgagggggauggucauacuauugcgccggccucaaaaaggucaccgaggugaaagguuacacuaaagggggaccgggccacgaggaaccaaucccuauggccacauacggcuggaacuuagucaaacugcauuccgggaaggauguguucuuuaugcccccagaaaaaugugacacccuucugugcgauauaggagagaguagccccaauccuacgauugaggaagguagaacccuaaggguucucaagaugguagagccguggcugcggggcaaccaguucuguaucaagauuuugaaucccuauaugccaucuguggucgaaacacuggagcagaugcaacgcaaacacgggggaaugcucgugagaaacccucuuuccagaaauucaacucacgagauguacuggguuagcugcggcaccgguaacaucgugucggcggucaacaugacaucucgaaugcuguuaaaucgguuuacuauggcucaucguaagcccaccuaugaaagagacguggaucugggggcaggaacacgccacguagccguggagccugaaguugcuaacuuggacauaaucggccagaggauugagaauaucaaaaacgaacauaagaguaccuggcacuacgaugaggacaauccauauaaaacuugggccuaccacggcuccuaugaggucaagcccagcgggucagcauccucuauggugaacggagugguccggcuccugacgaagccuugggauguuauuccaauggugacacagaucgccaugaccgacacuacccccuucggucaacagagaguauuuaaagaaaagguggauacacgcacgccgagggcuaaacgaggcaccacucagauuauggaggucacagcgaaguggcuauggggguuccuuagccggaauaaaaagccuagaaucuguaccagggaagaguuuacucgcaaggugcguaguaacgccgcaauaggagcuguuuucguggacgaaaaucaguggaacuccgccaaagaggcagucgaggacgaacgguuuugggaucuggugcauagagagagggaacuccacaagcaaggcaaaugcgccacaugcguauacaauaugauggguaagcgcgagaaaaagcugggggaguucggaaaggcuaaaggcagccgagccauuugguacaugugguugggcgcgcgguuccuggaguuugaggcacucggguucaugaacgaagaccauugguuuucuagagaaaauucacuuaguggaguugaaggugagggccugcacaaguuaggguauauccugagggauaucuccaaaauuccaggaggcaacauguacgccgacgauaccgcugguugggacacacgcauaacugaggaugacuugcagaaugaagccaagaucaccgauauuauggagcccgaacaugcacuccuggcuacgagcaucuucaaacuaaccuaucagaacaagguggucagagugcagcggccugccaaaaacgggacagugauggacgucauuucuaggcgugaucaacgaggaucgggccagguuggcacuuacgggcuuaauaccuuuacaaacauggaggugcagcugauccgccagauggaaucagagggaauauuccucccaagcgagcuggaaacucccaauuuggcugagagagccuuagacuggcuggaaaagcacggugcagagcggcucaagaggauggcgaucuccggcgaugacuguguagugaaaccgauugacgaucgcuuugccaccgcucuuacggcccugaacgacauggggaaggucagaaaagauaucccucaaugggaacccaguaagggauggaaugacuggcaacaggugccauucugcucucaccauuuucaccagcuaauuaugaaagauggccgggagaucguugugccuuguaggaaccaagacgagcuggucggucgagcacgugugagccagggggcuggauggucccucagagaaacagccugcuugggcaagucauaugcacagauguggcaacugauguacuuccaucgccgggaucuuaggcuggccgcgaaugcuauauguagugccguacccguugacugggugccaaccucuagaacuacauggagcauucacgcacaccaucaguggaugaccacugaggauaugcucuccgucuggaaccgcguguggaucgaagagaaucccuggauggaagacaagacccacguuucaagcugggaggaggugccuuauuuaggcaaacgggaagaucaguggugcgggucucugaucggauugacagccagggcuacgugggccaccaacauucaggucgcaauaaaucaagugcgaagacugaucgguaacgagaauuaccucgacuacaugacuuccaugaagcgguuuaaaaacgaaagugacagcgagggcgcucuuugguga

SEQ ID NO: 13534 - RNA, 9879 nt, Artificial Sequence
  derived and/or modified CDS sequence (opt3) from DENV-1__GU056030__SS-prME
agcgugaccaugcugcucaugcuucugcccaccgcauuggcuuuccacuuaacuacgaggggaggggaaccucauaugaucgucuccaagcaggaaaggggaaaaucucugcuauuuaagaccucagccgguguuaacaugugcacacucauugcaauggaccugggagaacuuugugaagauacuaugaccuacaaaugcccacggauaacagaagcggaaccggacgauguggacuguuggugcaaugcuaccgauacuuggguaacauaugggaccuguagucagacgggagaacaccgccgagaaaagcguagcguggcccuggcaccccaugucggcuugggucucgaaacuagaaccgagacauggauguccucugaaggggccuggaaacagauccagaggguggaaacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugcgcuacgaaggcacggacgcgccuugcaagauaccauuuagcacacaagaugagaaagggguaacccagaacggaagacugaucacugcaaaucccauugucacagacaaggaaaaaccugugaacaucgagaccgagccacccuucggcgaaucguauauaguugugggugccggggagaaggcucucaaacugucuugguuuaagaggggcuccucaauuggaaagauguucgaagccacugcacggggcgcccgacgcauggcuauccuuggggauaccgccugggacuuuggaaguaucgguggcgucuucacaagcguggggaaacugguacaucagguguuuggaacggcauacggcguuuuguucuccggugucucuuggaccaugaagauugggaucggcauucuccugacuugguuaggacugaauagcagaucaacaagucuauccaugaccuguauagcggugggcauggugacacucuaccugggggucaugguucaggcugauagcggaugcgugaucaacuggaaaggcagggagcuuaagugugguucugggauuuuugugacuaacgaaguacacaccuggacggagcaauauaaauuccaggccgacucaccgaagcgguugagugcagccaucggaaaggcuugggaggaaggcgucugcgguauccgcagcgccacaagacuggagaauauuauguggaaacagauauccaacgaacucaaucauauccuguuagagaacgauaugaaguuuaccgugguugugggcgacgcaaaugggauucuggcucagggcaagaagaugaucaggccucaacccauggaacacaaauacucuuggaagucguggggcaaagccaagauuaucggggcggacauacagaacacuaccuucaucauugauggaccagacacaccugagugucccgauggccagcgugccuggaauaucugggaggucgaagacuaugguuuugggauuuucacuaccaacaucuggcuuaaguugcgggauagcuacacacagaugugcgaccaccgacucauguccgcugcaauaaaagauucaaaggccgugcaugcugacaugggauauuggauugagagugagaaaaaugagacguggaagcuggccagagcaucuuucaucgaaguuaaaaccuguacuuggccaaagagccacacacuaugguccaacggcgugcuggagucagagaugauuauccccaagauauacgguggcccuaucagccaacauaauuauaggccaggguacuacacccagacugcgggaccguggcaccucggcaaacuggaacuugauuuugacuugugcgaggggacaaccguagucguggaugaacacugcggaaaccgcggccccucucugcggacgacuaccgugacagguaagauuauccaugagugguguugcagauccuguaccuuaccuccacucagguuccgcggggaggacggaugcugguauggcauggaaauucgacccgucaaagagaaggaagagaaucugguucggaguauggugagcgccgguucuggcgaaguagauaacuuuucccuugggauccugugugugucaauaaugauugaggaggucaugcguaguagauggagcaggaaaauguugaugacuggaacacucgcuguguuccugcuacugaucaugggccagcucaccuggaaugaccugauccgccuuugcauuaugguuggggccaacgcaucggacggaaugggcauggguacaacuuacuuggcucugauggccaccuuuaagaugcggccuauguucgcagugggguuacucuuuagaaggcugacgucccgagaaguccuucugcuaacaaucggacucucucugguggccagcguugaguugccaaacucacuggaagaguuaggcgauggccucgcuauggggauuaugaugcugaaacuucugaccgaguuccaaccccaccaguuguggacuacccuccugagucuaacauuugugaaaacuacccugucccuugacuaugcguggaagacgacagccaugguccucucuauaguaagccuguucccguugugucuguccaccacuucacagaaaacaaccugguuaccugugcuccugggcagcuuugguugcaagccacuuacuauguuccugaucacagagaauaaaauuuggggccgcaagaguuggcccuugaacgaggggaucauggcaauuggaaucguuucuauacuccuguccagccuacugaagaaugaugugccucuugcuggcccccucaucgccggugggaugcugauugccuguuacgucaucucgggaucaucugcugacuugaguuuagauaaagcagccgaaguguccugggagcaggaagcggagcauagcggcgcuucucacaacauuagcguagaagugcaagacgauggcaccaugaagaucaaagacgaggagcgggaugacacgcugacuauacuccugaaggccacccuucuggcagucuccgggguuuauccaaugucaauuccugccacauuguuugugugguacuucuggcagaaaaagaaacagagaaguggagugcuaugggauacccccagcccaccggaagucgagagggcugugcuggacgaugguaucuaucguauccuccagcgcggccugcuugggcggucucaaguuggaguaggcguguuccaggacggugucuuucauacaauguggcacgugacuagaggggcaguuuuaauguaccagggaaagaggcuggaaccuuccugggccugcgugaagaaagaccucauuucauacggcggcggguggcgauuccagggaaguuggaauaccggugaggagguccaagugauagcgguagaacccggcaagaaccccaaaaauguccagacgacacccgggacuuuuaagaccccugagggagaagugggcgcuaucgccuuggauuucaaaccagguacaagcgggucccccauuguuaaccgggagggaaagaucgugggccuguauggcaauggggucgugaccacuucuggaaccuacguuucggcaauugcccaggcuaaggccagccaagaagguccucucccggagaucgaggacgaaguguuuaaaaagcgcaaccugacaauaauggaucuucacccaggcucagggaaaacgagaagguaucugcccgcaaucguccgggaggcuauuaagcgaaaauugagaacucuaauccuggccccuacccgcgugguagcguccgaaauggccgaggcacucaagggaaugccaauuagguaccagacaaccgcugugaagagugaacauacuggccgugagaucguugacuuaaugugucacgccacauucaccaugcggcugcuuucucccgucagagugccuaauuauaacaugauaauuauggaugaggcucauuuuacggacccggcaagcaucgccgccagggguuacaucuccacucgcguggggaugggagaagcugcggcaauuuucaugacagccacaccaccaggcucagucgaggcuuuuccucagucuaaugccguaauccaggaugaagaacgagacauacccgaaagaagcuggaacaguggcuaugauuggauuaccgacuucccagggaaaacugugugguuuguuccuuccaucaagagcggaaaugauauugcaaacugccugcggaaaaacgguaagagggugauccaacucucucgcaaaacauucgacaccgaguaccagaagacaaagaauaacgacugggauuacgucgugacuacggacauaucagagaugggcgccaauuuccgugcugauagaguuauugacccccggaggugcuugaaaccagugauccugaaggaugggccggaacgcgucauccucgcgggaccuaugcccgugaccguagccuccgcagcucagcgaagaggccggauugguaggaaccagaauaaagagggggaccaauauguguacaugggccagccacugaacaaugaugaagaccacgcccauuggacagaggcaaagaugcuucuagauaacaucaauacucccgagggaauuauaccugcccuguuugaaccagagcgcgagaaaagugcugccaucgacggcgaguauagauugagaggggaagcgcggaagaccuucguugaguuaaugcgucgcggagaucugcccgucuggcucagcuacaagguggcaucggaggguuuucaguauucugaccgaagaugguguuucgauggcgaaaggaacaaucaggugcuggaggaaaacauggacgucgagauuuggacaaaagaaggggagcggaagaaacuucgcccuagauggcuggacgccaggaccuacuccgauccgcucgcuuugcgggaguuuaaggaguucgccgcuggacgaagaagcguuucaggcgaccugauccuagagaucgguaaacugccacaacaccucacucuucgcgcacagaaugcccuggauaacuuagugauguugcacaauagugaacaagggggaaaggcuuauaggcaugccauggaggaacugcccgacacgauugagacccucaugcugcuugcacugauagcgguacucacaggaggcgugacuuuguuuuuccugucugggaaaggauuagguaagaccuccaucggccuacugugcgucacagccagcucagcucuccuuuggauggccaguguggagccucacuggauugcagcuagcaucauucuggaauuuuucuugaugguucugcucauccccgagccagaucggcagcguaccccucaggacaaccagcuggccuacguggucauagggcuucucuuuaugauccugacuguagcagccaacgaaaugggauugcuggagacaacgaagaaagauuuaggcauugguuacguggcugcggagaaucaucagcacgccaccaugcuagacguugaucugcaccccgcauccgcuuggacucucuaugccguggccacaaccgucaucaccccaaugaugagacauacaauugaaaacacuacggcaaauaucucucuuaccgcuauagccaaccaagcggcuauucugaugggguuggacaagggcuggccuaucagcaaaauggauauuggagugccgcugcucgcccugggcuguuacucccaggucaauccccuuacauuaacugcagccgugcugaugcucguugcucacuaugcaaucauagggccaggauugcaggccaaggcgaccagggaggcucagaaacgcacagccgcaggcaucaugaagaacccuaccguggacgguauuguagccaucgaucuggaccccguggucuacgacguuaaguucgaaaaacaacuagggcagauuaugcugcucauccuuugcacuucacagauacuguugaugcggacgacaugggcucugugugagucuauuacccucgccacuggaccacugaccacauuaugggaaggcaguccugguaaguuuuggaauacuaccaucgcagugucgauggcuaacaucuuccgaggcagcuaucuugccggggcgggacuggccuucucccucaugaaaucucuaggcgggggaagaaggggcacaggugcacagggggagacgcugggagagaaguggaaacgccaauugaaucagcugucaaagagcgaauuuaacaccuacaagcgguccggcauuauggaggucgauagaagugaagcuaaagagggucucaagcguggcgaaacuacaaaucaugccgugucuagggggaccgcaaaacuucggugguucguagagcgcaaccuggugaagcccgagggaaaaguuaucgacuugggcugcgggcgaggaggcuggagcuauuacugugcuggucugaagaaggugacugaagucaaaggguacacaaagggaggcccgggccacgaggaaccaauaccuauggccaccuauggguggaaucucgugaaauuacauucaggaaaggaugucuuuuucaugcccccagagaaaugcgacacgcugcuuugugauauuggugaauccagucccaacccuaccaucgaggagggcagaacacugagggugcuaaagaugguugaaccguggcuccgggggaaucaguuuugcauuaaaauccugaaccccuacaugccaagcguaguggagacuuuggaacagaugcaacgcaagcacggaggcaugcuggucagaaauccucucucuaggaacuccacccacgagauguauugggugucaugugguacagggaacauaguuagcgccgugaauaugacuucgcgaaugcuucugaaccgguucaccauggcgcaucguaagcccacauacgagagagacgucgauuuaggagcuggcacccgccacgugacuguagaaccugagguggcaaaucuggacaucauuggccagaggaucgaaaacauuaaaaaugagcauaagucuacguggcacuaugaugaagacaacccauacaaaacaugggccuaucacgggaguuacgagguuaagcccuccggaagcgcuucauccauggucaaugguguggugcgguugcucaccaaaccuugggaugucaucccaaugguuacucagauugccaugaccgacacaacgcccuuuggccaacagagaguguucaaggagaagguagacacccgcacuccgagggcaaaacgagggacaacccagaucauggaagugacugccaaguggcuguggggauuucuaucucggaacaaaaagccuagaauaugcacaagggaggaguucacccgcaaaguccguagcaaugcugcgauuggcgccguguuuguugaugagaaccaguggaauagugcaaaggaagcuguggaggacgagcgguucugggaucuuguccauagagaaagggagcugcacaagcaagguaaaugcgccacauguguguacaacaugauggggaagcgcgagaaaaagcucggagaguuuggcaaagcaaagggcucccgagccaucugguauauguggcugggggcucgguucuuggaguucgaggcccugggauuuaugaaugaggaccauugguucagcagagaaaacucucucucagguguagagggcgaagggcuucacaagcugggauacaucuuaagggauauuaguaaaauaccaggcgguaauauguaugcggacgauacugcagggugggacacccgcaucacggaggaugaccugcagaacgaggccaagauuaccgauaucauggaacccgagcaugcuuugcucgccacauccauuuuuaaacugacuuaccagaacaagguugugagaguccagcggccugccaaaaauggaaccgugauggacgugaucagcaggcgugaucaacgaggcucuggccaggucgggacauauggacuaaacacuuucaccaauauggaaguucagcuuauacgccagauggagucggaagguaucuuucugccaucagagcucgagacgcccaaccuggcugaaagaguguuggacugguuagagaagcacggcgccgaacggcugaaaaggauggcuauuagcggggacgauugcguagugaagccgaucgacgaucgcuucgccacagcacucaccgcgcuuaaugacaugggaaaggucagaaaagauauuccucaaugggagcccuccaagggcuggaacgacuggcaacaggugccauuuuguagucaccauuuccaccagcugaucaugaaagauggucgggaaauaguugugccuugcaggaaucaagacgagcuagucgggcgagcccgugugucucagggagcuggcuggagccugagagagacugccugucucggcaaguccuacgcacagauguggcaauugauguauuuucaucgccgggaucugaggcuugcugccaacgcaauuugcucagccguacccguugacugggugccaacaaguagaaccacuuggucuauccacgcgcaccaucaguggaugaccacagaagauaugcugagcgucuggaaucgcguguggaucgaggaaaaccccuggauggaggacaaaacgcacguuuccucaugggaagaggugccuuaccucgggaagcgggaggaccagugguguggcagcuuaauuggucugaccgcuagggccacuugggcaacaaauauacaggucgccaucaaccaagugcgaagauugauuggcaaugaaaacuaccuggauuauaugaccucuaugaagcgguucaaaaaugaguccgacccagaaggggcucucugguga

SEQ ID NO: 13535 - RNA, 9879 nt, Artificial Sequence
  derived and/or modified CDS sequence (opt3) from DENV-1__GU056031__SS-prME
agcgugaccaugcugcuaaugcuucugcccacugccuuggcuuuccacuuaacuacgaggggcggggagccucauaugaucgucuccaagcaggaaaggggaaaaucucugcuauuuaagaccucagccgguguuaacaugugcacacucauugccauggaccugggcgagcuuugugaagauacuaugaccuacaaaugcccacggauaaccgaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuacgguggcccuauaagccaacauaauuauagaccaggguacuuuacccagacugcgggaccguggcaccucggcaagcuggaacuugauuucaacuugugcgaggggacaaccgucgugguggacgaacacugcggaaauaggggccccucucugcgcacgacuaccgucacagguaaaaucauucaugagugguguugccgguccuguaccuuaccuccacucagauuuagaggggaagauggaugcugguacggcauggaaauccgccccguuaaggagaaagaagagaaccuggugcgaaguaugguaagcgccgguucuggcgaaguggacuccuucucacuugggauucugugugucaguaucaugauagaggaggugaugcggagccguuggucgagaaagauguugaugacuggaacacucgcuguuuuucugcuacugauuaugggccagcucaccuggaaugaucugaucaggcuuugcaucauggugggggccaacgcauccgaccgcaugggaaugggcacaacuuauuuggcucugauggccaccuucaagaugcggccuauguuugcagucgguuuacucuucagaaggcugacgucucgagaagugcuucugcuaacaauugggcucagccugguugccucaguggaguugccaaacagucuggaagaguuaggagacggccucgcuaugggcaucaugaugcugaaacuucugaccgaauuucaaccccaccaguuguggacuacccuccugucccuaacauucgucaagacuacccugucucuugauuacgcguggaaaacgacagccaugguacucagcauugugucccuguuuccguugugucugucaaccacuagccagaagacaaccugguuaccuguucuccuggggaguuucggaugcaaaccaucuacuauguuucuuauaacagagaauaagaucuggggucgcaaguccuggccccugaacgagggcauuauggcaaucgggauugugagcaucuugcucucgucacugcucaagaaugacgucccucuggcuggaccccuuauagccggcgguaugcucaucgccuguuaugugauuucugggaguuccgcugaucugagcuuggaaaaggcagccgagguaucuugggaacaggaggcggaacauagcggagcuucccacaacaucuuaguggagguccaagacgauggcaccaugaaaauuaaggacgaggaacgggaugacacgcugacuauccuccugaaagccacccuucuggcaguuucaggcguguacccaaugaguauaccugccacauuguucgugugguauuucuggcagaagaaaaagcagagaagcgggguccuaugggauacccccucuccaccggagguggaaagggcuguucuggacgauggaauuuaccguauccuccagcgcggucugcuuggccggucccaaguaggggugggagucuuucaggacggcguguuccauacaauguggcacguuacuagaggugcaguguuaauguaucaggggaagaggcuggagccuucaugggccagugucaaaaaggaucucaucagcuacggaggcggcuggcgauuucagggguccuggaauaccggagaggaagugcaaguaauugcggucgagcccgguaaaaacccaaagaaugugcagacgacacccggcacuuucaaaaccccugaaggggagguuggagcuauagccuuggacuuuaagccaggcacaucugguucgcccaucgugaaccgggaagggaagauugucggacuguacggcaauggcgugguuaccacuagcgggaccuaugugucagcaaucgcccaggcuaaagccucccaagagggaccucucccggagauugaagacgaggucuucaagaaacgcaaccugacaaucauggaucuucacccagguaguggcaagacgagaagguaccugcccgcaauagugcgggaagcuaucaaacgaaaguugagaacucuaauucuggccccuacccgcguaguggcgucugagauggccgaagcacucaaggggaugccaaucagguaucagacaaccgcuguuaaaagcgagcauacuggacgugagauugucgacuuaaugugccacgccacauuuaccaugcggcugcuuucccccgugagagugccuaauuacaacaugaucauaauggaugaagcucauuucacggacccggcaucaauugccgccaggggcuauaucucuacucgcgucgguaugggggaggcugcggcaaucuuuaugacagccacacccccaggaagcguagaggcuuucccucagaguaaugccgugauucaggaugaggaacgagacauccccgagagauccuggaacagcggcuacgauuggauaaccgacuuuccaggcaagacuguuugguucgugccuucuauuaaaucagggaaugauaucgcaaacugucugcggaagaacggaaaaagggucauucaacucucccgcaagacauucgacaccgaguaucagaagacuaaaaauaacgauugggacuacgugguuacuacggacaucagugaaaugggugccaauuuucgugcugauagagugauagacccccggaggugcuugaagccagucauucugaaagauggcccggagcgcgugauccucgcggggccuaugcccguaaccguggccagcgcagcucagcgaagaggacggaucggcaggaaccagaauaaggaaggugaccaauacguuuauauggggcagccacugaacaaugaugaggaccacgcccauuggacagaggcaaaaaugcuucuagauaacauuaauacucccgaaggcaucauuccugcccuguucgagccagaacgcgagaagucggcugccauagacggagaauacagauugaggggcgaggcgcggaagaccuuugucgaguuaaugcgucgcggggaucugcccguguggcucucuuauaaaguggcauccgaaggauuccaguacagcgaccgaagauggugcuuugauggugagaggaacaaucagguccuggaagagaacauggacguugaaaucuggacaaaggagggcgagcggaagaaacuucgcccuagauggcuggaugccaggaccuauucagacccgcucgcuuugcgggaguucaaagaguuugccgcugggcgaagaagugugucuggagaccugauucuagaaaucggcaaacugccacaacaccucacucuucgcgcacagaaugcccuggauaacuuaguaauguugcacaauuccgagcagggugggaaggcuuacaggcaugccauggaagaacugcccgacacgaucgagacccucaugcugcuugcacugauugcggugcucacaggcggagucacuuuguucuuucugagcggcaagggguuaggaaagaccucaauaggucuacugugugugacagccaguagcgcucuccuuuggauggccuccguugaaccucacuggaucgcagcuucuauuauccuggaguucuuuuugauggugcugcucauucccgaaccagaucggcagcguaccccucaagacaaccagcuggccuaugucguaaucggccuucucuucaugauacugacuguggcagccaacgagaugggguugcuggagacaacgaaaaaggauuuaggaaucggcuacguugcugcggaaaaucaucagcacgccaccaugcuagacguggaucugcaccccgcaagcgcuuggacucucuacgccgucgccacaaccgugauuaccccaaugaugagacauacaaucgagaacacuacggcaaauauuucccuuaccgcuaucgccaaccaagcggcuauacugauggguuuggacaaaggguggccuauuucaaagauggauaucggcgucccgcugcucgcccugggaugcuauucucaggugaauccccuuacauuaacugcagccguucugaugcucguggcucacuacgcaauuaucggcccaggguugcaggccaaagcgaccagggaagcucagaagcgcacagccgcaggaauaaugaagaacccuaccguagacggcaucguggccauugaucuggaccccgucguuuaugaugcuaaauuugagaagcaacuaggucagaucaugcugcucauucuuuguacaagucagauccuguugaugcggacgacaugggcccugugcgaaucgauaacccucgcaacugggccacugaccacauuaugggagggaagcccuggcaaauucuggaauacuaccauugcuguguccauggccaacaucuuccgagguucuuaccuugcgggcgccgggcuggcauuuucacucaugaaaagccuaggaggcgggagaaggggaacaggcgcucagggugagacgcugggggaaaaauggaagcgccaauugaaucagcuguccaagagugaguucaacaccuauaaacggucuggaaucauggaagucgacagaagcgaggccaaggaaggccucaaacguggugagacuacaaagcaugcagugucaaggggcaccgcuaaacuucggugguuuguagagcgcaaucuggugaagcccgaagggaagguuauugacuugggauguggccgagggggaugguccuacuauugcgccggccugaaaaaggugacugaggucaaagguuacacaaaagggggaccgggccacgaagaaccaaucccuauggccaccuacggcuggaaccucgugaaauuacauagugggaaggaugucuucuuuaugcccccagaaaaaugugacacgcugcuuugcgauauaggagagagcucucccaauccuaccauugaggaagguagaacacugagggugcuaaagaugguugagccguggcuccggggcaaccaguucuguaucaagauucugaaucccuauaugccauccguaguggaaacuuuggagcagaugcaacgcaaacacgggggaaugcuggucagaaacccucucucaaggaauagcacccacgagauguacugggugucgugcggcacagguaacaucguuucugcggugaacaugacaagucgaaugcuucugaaucgguuuaccauggcucaucguaagcccacauaugaaagagacgucgauuuaggggcaggaacccgccacguggccguagagccugaaguggcuaaccuggacauaaucggccagaggauugagaauaucaaaaacgaacauaaguccacuuggcacuacgaugaggacaauccauauaaaacgugggccuaccacggcagcuaugagguuaagcccucaggguccgcaucuagcauggucaacggaguggugcgguugcucacaaagccuugggaugucauuccaaugguuacccagaucgccaugacugacaccacacccuucggucaacagagaguguuuaaagaaaagguagauacgcgcaccccgagggcuaaacgaggcacuacacagauuauggaggugaccgcgaaguggcuguggggguuccuaagucggaauaaaaagccuagaaucuguacuagggaagaguuuacacgcaagguccguuccaacgccgcaauaggagcuguguucguugacgaaaaucaguggaacagcgccaaagaggcaguggaggacgaacgguuuugggaucuuguccauagagagagggaacugcacaagcaaggcaaaugcgcaaccugcguguacaauaugauggguaagcgcgagaaaaagcucggggaguucggaaaggcuaaaggcucucgagccauuugguacauguggcugggcgcgcgguucuuggaguuugaggcacugggguucaugaacgaagaccauugguuuucaagagagaauagucucuccggaguagaaggugagggccuucacaagcugggguauaucuuaagggauaucagcaaaauuccaggaggcaacauguacgccgacgauacagcugguugggacacucgcauaaccgaggaugaccugcagaaugaagccaagaucacggauauuauggagcccgaacaugcauugcucgcuaccucuaucuucaaacugacauaucagaacaagguugugagaguccagcggccugccaaaaacgggacugugauggacgugauuucgaggcgugaucaacgaggaucaggccaggucggcaccuacgggcuaaauacauuuacuaacauggagguucagcuuauccgccagauggaaagcgagggaauauuccugccauccgagcucgaaacccccaaucuggcugagagagccuuggacugguuagaaaagcacggugcagagcggcugaagaggauggcgaucaguggcgaugacugugugguaaaaccgauugacgaucgcuuugccacggcucucacagcccuuaacgacauggggaaggugagaaaagauaucccucaaugggaacccucuaagggauggaaugacuggcagcaggucccauucugcagccaccauuuucaccagcugauuaugaaagauggccgggagaucgugguuccuuguaggaaccaagacgagcuagugggucgagcacgugucucccagggggcuggauggucacugagagaaaccgccugccucggcaagaguuaugcacagauguggcaauugauguacuuccaucgccgggaucugaggcuugccgcgaaugcuauauguucugccgugcccguagacuggguuccaacuagcagaacaaccugguccauucacgcacaccaucaguggaugacuaccgaggauaugcugucaguguggaaccgcgucuggaucgaagagaaucccuggauggaagacaagacacacgugagcucuugggaggagguuccuuaucucggcaaacgggaagaucaguggugcggguccuuaaucggacugacggccagggcuaccugggccacuaacauucagguggcaauaaaucaaguccgaagauugaucgguaacgagaauuacagugacuacaugacaagcaugaagcgguuuaaaaacgaaucggacccagagggcgcucugugguga

SEQ ID NO: 13536 - RNA, 9879 nt, Artificial Sequence
  derived and/or modified CDS sequence (opt3) from DENV-1__GU056032__SS-prME
agcguggccaugcugcucaugcuucugcccaccgcuuuggcauuccacuuaacaacuagaggcggggagccucauaugaucgucuccaagcaggaaaggggaaaaucucugcuauuuaagacgucagccgguguuaacaugugcacccucauugcgauggaccugggcgagcuuugugaagauacaaugacuuacaaaugcccacggauaaccgaggcugaaccggacgauguggacuguuggugcaaugccacagauaccuggguaacuuaugggacauguagucaaaccggagagcaccgccgagacaagcguagcguggcacuggccccccaugucggcuugggucucgagacgagaacugaaaccuggauguccucugagggggcuuggaaacagauccagaggguggaaacaugggcacugcggcacccuggauucacuguuauugcccuguuucucgcucaugccaucggcaccucgauuacacagaagggcaucauauucaucuuacugaugcuugugaccccaucaauggcgaugcgcugcgucgggauuggaaacagagauuuuguggaggguuugagcggcgcaacguggguagacguugugcuggagcacgggaguugugucacuacaauggccaagaauaaacccacccuagauaucgaacuccugaagacugaggugacaaacccugcugugcuuaggaaacugugcauugaagccaagaucuccaauaccacgaccgacucucgguguccaacacaaggagaggcaacuuuggucgaagagcaggaugcuaacuucguuugccgccgaaccuuuguggacagaggcugggguaauggguguggacucuucggcaaaggcagccuguuaacaugcgccaaguuuaagugcguaacuaaacuggaggggaagauagugcaguacgaaaaccucaaauauuccgucauugugaccguucacacaggagaucagcaucaaguggguaaugagaccacugaacacggcacgaucgcgacaauuaccccccaggccccuacuucagagauccagcuuaccgacuacggggcacugacauuggacuguaguccaaggaccggacuagauuucaacgaaaugguccugcucacuaugaaggagaaaagcuggcuggugcauaagcagugguuucuugaccugccguugcccuggacaucuggcgcuuccacgucacaagagaccuggaaucggcaggaucuccugguaacuuucaaaacagcccacgcuaagaagcaggaaguuguggucuuagguagccaagagggggccaugcacaccgcacugacaggcgccacugaaauccagaccaguggaacgaccacaauuuuugcuggccaucuaaaaugccgucucaagauggacaaacugacucuuaaggggaccucuuaugugauguguacaggauccuucaaauuggagaaggaagucgcggagacucagcacgguaccgugcugguucaggugaaguacgagggcacggaugcaccuugcaaaauaccauucagcacacaagacgaaaaggggguaacccagaacggacgccucaucacugccaaucccauugucacagauaaagagaagccugugaacaucgaaaccgagccacccuuuggcgagucguauauaguugugggugcuggggaaaaagcccugaagcuuucuugguucaagaaaggcuccucaauuggaaagauguuugaggcaacugccagaggcgcuaggcggauggccauccugggggacaccgcaugggauuucggaaguaucgguggcgucuuuacaagcguggggaaauugguacaucagguguucggaacggcguacggcguucucuuuuccggugucucuuggaccaugaagauugggaucggcauucuguuaacuuggcugggacuaaauagccgaucaacaagucucuccaugaccuguauagcugugggcauggugacacuguaccuuggggucaugguucaggccgacagcggaugcgugaucaacuggaaaggccgcgaauugaagugugguucugggauuuucgugacuaacgagguacacaccuggacggaacaauauaaguuucaggcagauucaccgaaaagacugagugccgcuaucggaaaggccugggaggagggcgucugcgguaucaggagcgcaacacggcucgaaaauauuauguggaaacagauauccaacgagcugaaucauaucuuacuggaaaacgacaugaaguucaccgugguugugggcgacgcuaaugggauucuugcccagggaaaaaagaugauccgcccucaacccauggagcacaaauacucuuggaagucguggggcaaggcgaaaauuaucggggccgauauacagaacacuaccuuuaucauugacggaccagauacaccugaaugucccgacgaucagagagcuuggaauaucugggaggucgaggacuauggcuucgguauuuuuacuaccaacaucugguugaagcucagggauagcuacacacagaugugcgaccaccgucugauguccgcagccauaaaagauucaaaggcugugcaugccgacaugggguauuggauugaaagugagaaaaaugaaacguggaagcuagcacgggcgucuuucaucgagguuaagaccuguacuuggccaaaaagccacacacugugguccaacggagugcucgaaucagagaugauuauccccaagauauacggcgguccuaucagccaacauaauuaucgaccaggcuacuucacccagacugccgggccguggcaccugggaaaacuugaguuggauuuugaccugugcgaaggcacaaccguagucguggaugagcacugcgggaacagaggacccucuuuaaggacgacuaccgugacaggcaagauuauccaugaaugguguugccgcuccuguacccucccuccacugcgguucagaggugaggacgggugcugguacggaauggagauuaggcccgucaaagaaaaggaggaaaaucuuguucgcaguauggugagcgcuggcucuggugagguagacuccuuuucacugggcaucuugugugugaguauaaugauugaagaggucaugcgaagccgguggucgcguaagaugcucaugacugggacacuggccguguuccuacugcucaucaugggacagcugaccuggaacgaucuuaucagauugugcauuaugguuggcgcaaaugcuuccgacaggauggggaugggaacaacuuaucuggccuuaauggcaaccuuuaaaaugcgcccuauguucgccgugggccuccuguuucggagacuuacgucuagggagguccugcuacucacaaucggucugagcuugguggcuucaguugaacugccaaacaguuuagaggaacucggggauggacuggcgaugggcauuaugaugcuuaagcuguugaccgaguuccaaccccaccagcucuggacuacccugcuaucccugacauuuauaaaaacuacccuuucucucgacuacgccuggaagacgacagcaauggugcugagcaucgucuccuuguucccgcuguguuuaucaaccacuagccagaaaacaaccuggcucccuguacugcuuggcaguuuugggugcaagccacugacuauguucuugauuacagaaaacaagaucuggggacgaaaaucuuggccccucaaugaggguauuauggcugugggcaucguuuccaugcugcuaagcucgcugcuuaagaacgaugugccucucgccgggccccugauagccggaggcauguugaucgcuuguuaugucauuucagguucuagugcagacuuaucccuggagaaagccgcggaagugagcugggagcaggaagcugagcauucugggaccagccacaauauccucguagaagugcaagaugacggaacgaugaagauuaaagaugaggagcgcgacgauacucugaccauccuucugaaggccacauugcuagcagucuccggcguuuacccaaugucaauaccugccacccuguuugugugguauuucuggcagaaaaagaagcagcggaguggcgugcucugggacacacccagcccaccggaagucgagagagcugugcuggaugacgggauuuacaggauccuucagcguggauuacugggucgcucucaaguuggcguagggguguuccaggacggagucuuucauacuauguggcacgugacccggggcgcaguucucauguaucaggguaaaagauuggaaccuuccugggccucagugaagaaagaucugaucaguuacgggggaggcuggagguuccagggcagcuggaacacgggggaggagguccaagugauugcgguagaacccggaaagaauccaaaaaacguccagacaacucccgguaccuuuaagacaccugagggcgaagugggggcuauagcccucgacuucaagccaggaaccuccggcucucccaucguuaaucgagaggguaaaauuguggggcuguacggaaacggcgucgugacuaccucgggcacauauguuagcgcaaucgcccaggcuaaggccucacaagaagggccucuuccggagauugaggaugaaguguuuaaaaagcggaaucugacgaucauggacuugcacccaggauccgguaaaacucgcagauaccuacccgcaauagucagggaggcuaucaagcggaagcugcgaacccucauuuuagccccuacaagagugguagcgagugaaauggccgaggcacugaaaggcaugccaauccgcuaucagaccacugcugugaagucugaacauacagggagggagauuguugaucuuaugugccacgccaccuucacgaugcgucugcucagccccguccgggugccuaacuacaauaugaucauaauggacgaggcucauuuuacugauccggcauccauugccgccagaggauauaucucaacaagggugggcaugggugaagcugcggcaaucuucaugaccgccacccccccagggucugucgaggcuuuuccucagagcaacgccguaauucaggacgaagagcgcgauauccccgaacgaaguuggaauuccggauacgacuggauaacugauuucccaggcaaaacagugugguuuguuccuagcauuaagucuggcaacgacaucgcaaauuguuugagaaaaaacgggaagcgggugauucaacugucaaggaagaccuucgacacagaguaucagaaaacuaagaacaaugauugggacuacgucgugacgaccgauaucuccgagaugggagccaacuuccgcgcugaccguguuauagaucccagacggugccucaaaccagugauucugaaggacgguccggaaagggucauccuugcgggcccuaugcccgugacaguagccagugcagcucagcgccgagggagaaucggacggaaucagaacaaagagggcgaucaauacguguauaugggucagccacuaaauaacgacgaagaucacgcccauuggacugaggcaaagaugcuguuggacaauauuaacacccccgaggggaucauuccugccuuauuugaaccagagagggaaaagagcgcugccauagauggcgaguaccgccugagaggagaagcgaggaaaacauucguugagcucaugcggcguggcgaccugcccgucuggcuuucguauaagguggcaucugagggguuucaguacuccgaucgccgauggugcuucgacggagaaagaaauaaccaggugcuggaggaaaauauggacgucgagaucuggaccaaagaaggugagaggaagaaacuccggccucgcugguuggaugccagaacuuauagcgacccgcuggcucuaagggaguuuaaggaauucgccgcuggccggcgaucaguuaguggggaucugauucucgagaucggaaaacuuccacaacaccugacguuaagagcacagaacgccuuggacaaucuggugaugcuccacaacucugaacagggcgguaaggcuuaccgccaugccauggaggaacugcccgauaccaucgagacacuuaugcugcucgcauugauugcgguacugacugggggcgugaccuuauuuuuccuauccggaaagggccuggggaaaacaagcauaggacuccuuugugucaccgccucaagugcucuguuguggauggccagcguggagccucacuggaucgcagcuuccauuauccuggaauuuuuccucaugguucugcuuauucccgagccagacaggcagcggacuccucaagauaaucagcucgccuauguggucaucggucuguuguuuaugauacugacaguagcagccaacgaaaugggcuuacuagagacgaccaagaaagaccuggggaucggacauguggcugcggagaaccaccagcacgccacuaugcucgauguugaccuucgucccgcaucugcuuggacacuguacgccguggccaccaccgucauuacaccaaugaugagacauacuaucgaaaauacgaccgcaaacauuagcuugacagcuaucgccaaucaagcggcuauacugaugggccucgauaaggguuggccuauuuccaaaauggacaucggggugccgcugcuugccuuaggcugcuacucacaggucaacccccugacucucaccgcagccguguugaugcugguugcucacuaugcaauuaucggaccaggccuacaggccaaggcgacaagggaggcucagaagcgcaccgccgcagggauaaugaaaaauccuacuguggauggaaucguagccauugaccuggaccccguggucuacgaugcuaaguucgaaaaacaacucggccagaucaugcuucugauuuuguguacgucucagauccugcucaugcggacaaccugggcccugugcgagaguauaacuuuagcaaccgguccacuuacaacucugugggaagggucgccuggaaaguuuuggaacaccacaauugcuguuagcauggccaauaucuuccgaggcuccuaucucgcgggugccggccuagcauucucucugaugaaaucauuggggggaggcagaagggggacgggagcucagggcgagacccugggugagaaguggaagcgccaacucaaccagcuuagcaaauccgaauuuaauacuuacaagcggagugggaucauggagguggacagaucugaagccaaagagggacugaagcguggcgaaacaaccaaacaugcagucagcagggguacugcuaaguugcggugguucguggagcgcaaccugguaaagcccgagggcaaagugauugaucucggguguggacgaggcggguggucauauuacugcgccggauuaaagaaaguuacagaagugaagggcuauaccaaaggugggccgggacacgaggaaccaaucccuauggccacguacggcuggaaucuggucaagcuucauuccggcaaagacguguuuuucaugcccccagagaagugugauacccugcuaugcgacauaggggaaaguagccccaacccuacaauugaggagggaagaacucucaggguccugaagaugguggaaccgugguugcgggguaaucaguuuuguaucaaaauucugaaccccuacaugccaucuguuguagagacccucgaacagaugcaacgcaagcacggcgggaugcuugugagaaauccucuguccaggaacucaacacacgagauguauugggucagcugcggaacuggcaauaucgugucggcgguuaacaugaccucucgaauguuacugaaccgguucacaauggcucaucguaaacccaccuacgagagagauguggacuugggugcagggacucgccacgucgccguggaaccugagguagcuaaucucgauauaaucggacagaggauugaaaacaucaagaaugagcauaaaaguacguggcacuaugacgaagauaacccauacaagacaugggccuaucacggcuccuacgaggugaagcccagcggcucagcauccucuaugguuaauggggucgugcggcugcuaaccaaaccuugggacgugauuccaauggucacucagaucgccaugaccgacacaacgcccuuuggacaacagagaguuuucaaggagaaaguggauacccgcacuccgagggcuaagcgagguacaacccagauuauggaaguaacugcgaaauggcuuuggggcuuucugagccggaacaagaagccuagaaucuguacaagggaggaauucacccgcaaagugcguaguaaugccgcaauaggggcugucuuuguggacgagaaccaguggaauuccgccaaggaagcaguugaggaugagcgguucugggaccucgugcauagagaaagggagcugcacaaacaaggaaagugcgccacaugcgucuauaacaugaugggcaaacgcgaaaagaaguugggugaguuugggaaagcuaagggaagccgagccauuugguacauguggcugggcgcgcgguuccucgaauucgaggcacuuggcuuuaugaaugaggaucauugguucucuagagaaaacucacugagugggguggagggagaagguuuacacaaacugggcuacaucuugagggacaucuccaagauuccagggggaaauauguaugccgaugacacugcuggcugggauacccgcauaacggaggacgaucuccagaacgaggccaaaaucaccgacauuauggaacccgagcaugcacugcuagcuacaagcaucuuuaagcuuacuuaccagaauaaaguaguuagagugcagcggccugccaagaacgguaccgucauggaugugauuucuaggcgugaccaacgagggucgggacaggugggcacauauggccugaacacuuucaccaauauggaaguccagcucauccgccagauggagucagaagggauauuucugccaagcgaguuggagacgcccaacuuagcugaaagaguucuggacuggcucgagaagcacggagccgaacggcuuaaaaggauggcaaucuccggugaugacugugugguaaagccgauugaugaccgcuucgcgacagcccugaccgcucuaaaugauaugggcaaaaucagaaaggacauuccucaaugggagcccaguaaaggguggaacgauuggcagcaggugccauuuugcucucaccauuuccaccagcugaucaugaaggacggacgggaaauagucgugccuuguaggaaucaagaugagcucguuggccgagcccgugugagccagggugcagggugguccuugagagagacugcuugccugggaaagucauacgcccagauguggcaacuuauguauuuucaucgccgggaccugaggcucgcagccaacgcgauuuguagugcuguccccguggauuggguaccaacaucuagaaccacuuggagcauccacgcccaccaucaguggaugaccacagaagacauguuauccguuuggaaucgcguguggaucgaggaaaaccccuggauggaggacaaaacgcacgucucaagcugggaagaggugccuuaccugggcaagcgggaggaucaguggugcggcucuuugauugggcugaccgcaagggccacuugggcuacaaauauacagguugccaucaaccaagugcgaagacucauuggaaaugaaaacuaucuugacuacaugaccuccaugaaacgguucaagaaugagagugauacugaaggugcacugugguga

SEQ ID NO: 13537 - RNA, 9879 nt, Artificial Sequence
  derived and/or modified CDS sequence (opt3) from DENV-1__GU056033__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaggguugaaacuugggcccugcggcacccuggauucaccgugauugcucuguuucucgcacaugccaucggcacaucgauuacccagaagggcaucauauucaucuuacugaugcuugucacgccaucaauggcuaugcgcugcguggggauuggaaacagagauuuuguagaggguuugagcggcgccacuuggguugacgugguccuggagcacgggaguugugugacaaccauggcgaagaauaaacccacucuagauaucgaacuccugaagacagaggugaccaacccugcaguccuuaggaaacugugcauugaagccaagaucuccaauacgaccacagacucucgguguccaacucaaggagaggcuaccuugguugaagagcaggaugccaacuucgugugccgccgaacauuuguagacagaggcugggguaauggguguggacucuucggcaaaggcagccuguuaacuugcgcaaaguuuaagugcgugaccaaacuggaggggaagauaguccaguacgaaaaccucaaauauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaaggacuggacuagauuucaacgaaauggugcugcucacaaugaaggagaaaagcuggcugguacauaagcagugguuucuugaccugccguugcccuggacgucuggcgccuccaccucacaagagacuuggaaucggcaggaucuccugguuacauucaaaaccgcacacgcuaagaagcaggaaguggucguguuagguagccaagagggggccaugcacacagcucugacuggcgccaccgaaauccagacgaguggaaccacaacuauuuuugcaggccaucuaaaaugccgucucaagauggacaaacugacccuuaaggggaugucuuaugucauguguacaggauccuucaaauuggagaaggaaguggccgagacucagcacgguaccguucuggugcagguaaaguacgagggcacggaugcuccuugcaaaauaccauucagcacacaagacgaaaagggggucacccagaacggacgccucaucacugcgaaucccauugugacagauaaagagaagccuguuaacaucgaaaccgagccacccuuuggcgagucguauauaguggucggugcaggggaaaaagcccugaagcuuucuugguucaagaaaggcuccucaauuggaaagauguuugaggcuacugccagaggcgcaaggcggauggccauccugggggacaccgcuugggauuucggaaguaucgguggcguguuuacaagcguagggaaauuggugcaucagguuuucggaacggccuacggcguccucuuuuccggugugucuuggaccaugaagauugggaucggcauucuguuaacuuggcugggacuaaauagccgaucaacaagucucuccaugaccuguauagcagugggcauggucacacuguaccuugggguuauggugcaggcggacagcggaugcgugaucaacuggaaaggccgcgaauugaagugugguucugggauuuucguaacuaacgagguccacaccuggacggaacaauauaaguuucaggcugauucaccgaaaagacugagugccgcaaucggaaaggccugggaggagggcgugugcgguaucaggagcgcuacacggcucgaaaauauuauguggaaacagauauccaacgagcugaaucauaucuuacuggaaaacgacaugaaguucaccguuguggucggcgacgugaaugggauucuugcccagggaaaaaagaugauccgcccucaacccauggagcacaaauacucuuggaagucguggggcaaggcaaaaauuaucggggcugauauacagaacacuaccuuuaucauugacggaccagauacaccugaaugucccgacgaucagagagccuggaauaucugggagguugaggacuauggcuucgguauuuuuacuaccaacaucugguugaagcucagggauagcuacacacagaugugcgaccaccgucugauguccgcggccauaaaagauucaaaggcugugcaugcagacaugggguauuggauugaaagugagaaaaaugaaacguggaagcuagccaaggcuucuuucaucgagguaaaaaccuguauuuggccaaagagccacacucugugguccaacggaguccucgaaucagagaugaucauacccaaaaucuacggcgguccuauuagccaacauaauuaucggccaggcuacuucacacagaccgccgggccguggcaccugggaaagcuugaguuggauuuugaccugugcgaaggcacuacagugguggucgaugagcacugcgggaaccgaggacccucuuuaagaaccacgacuguuaccggcaaaaucauucaugaaugguguugcagguccuguacacucccuccacugcgcuuccggggugaggacgggugcugguacggaauggagaucagacccgugaaggaaaaggaggaaaaucuuguaaggaguauggugagcgcaggcucuggugaggucgacuccuuuucacugggcauauugugugugaguauuaugaucgaagagguuaugcgcagccgauggucgcggaaaaugcucaugaccgggacucuggcgguguuccuacugcucaucaugggacagcugacauggaacgaucuuauucguuugugcaucauggucggcgccaaugcuuccgacagaauggggaugggaaccacauaucuggccuuaauggcaacuuuuaagaugaggccuauguucgcugugggccuccuguuucgccggcuuaccucuagagagguucugcuacucacgauuggucugagcuugguggccucagucgaacugccaaacaguuuagaggaacucggggauggacuggcaaugggcauaaugaugcuuaaacuguugacagaguuccaaccccaccagcucuggaccacucugcuaucccugaccuuuaucaagacaacucuuucucucgacuacgccuggaaaaccacggcuauggcgcugagcauuguauccuuguucccgcuguguuuaucaacaaccagccagaagacuacauggcucccugugcugcuuggcaguuuugggugcaagccacugaccauguucuugaucacugaaaacaaaauuuggggaaggaagucuuggccccucaaugaggguaucauggccauaggcaucguuuccauucugcuaagcucgcugcuuaaaaacgaugugccucucgcagggccccugaucgcuggaggcauguugauugccuguuaugucaucucagguucuagugccgacuuaucccuggagaaggcugcagaagugagcugggagcaggaagccgagcauucugggacaagccacaauauacucguagaagugcaagaugacggaaccaugaaaauuaaggaugaggagcgagacgauacgcugacuauccuucugaaagcgaccuugcuagcugucuccggcguuuacccaaugucaaucccugccacacuguuugugugguauuucuggcagaagaagaaacagcgcaguggcgugcucugggacacccccagcccaccggaagucgagcgggcagugcuggaugacgggauuuacagaauaucucagaggggacuuuuaggucguucccaaguuggcguagggguguuccaggacggagucuuucauacaauguggcacgugacucgcggcgccguucugauguaucaggguaagcggcucgaaccuucaugggcuagugugaaaaaggauuugaucagcuacgggggaggcuggagauuccagggcuccuggaacaccggggaggagguccaagugauugcaguagaacccggaaaaaauccaaagaacguccagacgacacccgguacuuuuaagaccccugagggcgaagugggggccaucgcgcuggacuucaaaccaggaacaucuggcucgcccauuguuaauagggaggguaagaucguggggcucuacggaaacggcgucgugaccacuagcggcaccuauguuucagcuauagcccaggcaaaagccucccaagaagggccucugccggagaucgaggaugaaguguuuaagaaacgaaaucuuacaauuauggaccugcacccaggaagugguaagacgcggcgcuacuugcccgcuaucgucagagaggccauuaagaggaaacuacggacucugauccucgcaccuacccgagugguagcuucugaaauggccgaggcguuaaagggcaugccaauaagauaucagacaaccgccgugaaaagcgaacauacugggcgcgagauuguugaucugaugugccacgcaacauucaccaugaggcuucugucccccguccgugugccuaacuacaauaugaucaucauggacgaggcucauuuuacggauccggccucaauugcugcacggggauauaucucuacuagagugggcaugggugaagccgccgcuauauucaugacagcgacccccccagggagcgucgaggcauuuccucagaguaacgccguaauucaggacgaagagagggauauccccgaacgcuccuggaauagcggauacgacuggauuaccgauuucccaggcaagacugugugguuuguuccuucuaucaaaucaggcaacgacauagcuaauugucuccgaaagaacgggaagagagugauucaauugucccggaaaacauucgacaccgaguaucagaagacaaaaaacaaugauugggacuacgucgugacuacggauaucagugagaugggagccaacuucagggcagaccgcguuaucgauccccguagaugccugaagccagugauucucaaagacgguccggaacgggucauccuggccggcccuaugcccgugaccguagcuagcgcggcccagaggcgcgggcgaauuggaagaaaucagaacaaggagggcgaucaauacguguauaugggucagccacuuaauaacgacgaagaucacgcacauuggacagaggcuaagaugcuacuggacaauauaaacacucccgaggggaucauuccugccuuguuugaaccagagcgggaaaaaucggcagccaucgauggcgaguacagguuacgcggagaagcuagaaagaccuucguugagcugaugaggcggggcgaccuccccgucuggcugucuuauaaaguggccuccgagggguuucaguacagcgaucgucgcuggugcuucgacggagaacgaaauaaccaggugcuugaggaaaauauggacgucgagaucuggacaaaggaaggugagagaaaaaagcugaggccucgguggcucgaugcgcgcaccuauucagacccguuggcacugagagaguuuaaagaauucgccgcuggcaggcggaguguuucuggggaucuaauucuggagauaggaaagcucccacaacaccuuacucugcgagcccagaacgcuuuagacaauuuggugaugcugcacaacuccgaacagggcgguaaggcauacagacaugccauggaggaacuccccgauacgaucgagacccugaugcuucuggcucucauugccguauugacagggggcgugacucuguuuuucuuaagcggaaaaggccuagggaagaccucaaucggacugcucugugucacagcaaguagcgcgcuucuguggauggccuccguggagccucacuggauugcugccucuaucauauuggaauuuuuccugaugguucuccugauccccgagccagaccgccagaggaccccucaagauaaucagcuugcauauguggucauuggucuccuguuuaugaucuugacuguagcugccaacgaaaugggccuguuagagacaacgaaaaaggaccuagggauuggacauguggcagccgagagccaccagcacgcuaccaugcuggauguugaccuccggcccgcguccgccuggacucuuuacgcaguggcuacaaccgucaucaccccaaugaugcgucauacaauagaaaacacuacggccaauauuucacugaccgccaucgcaaaccaagcugccauuuugaugggccuggauaaagguuggccuaucucuaagauggacauaggggugccgcuccuggcgcuuggcugcuacagucaggucaaucccuuaacacugacugcugccgugcucauguugguugcacacuaugccaucauuggaccaggccugcaggcuaaggcaaccagagaggcccagaaaaggacagcggcugggaucaugaagaacccuaccguggauggaauuguagccaucgaccuagaccccguggucuacgaugcaaaauucgaaaagcaacugggccagauaaugcuccuuauucuguguacuucgcagaucuugcugaugcgcacgacaugggcccucugcgagagcaucacccuggcuacugguccauuaaccacacuuugggaaggguccccuggaaaauuuuggaauacuaccauugccguuucuauggcaaacaucuuccggggcucauaucuggcuggugccggccucgcguucagccuaaugaagucccuggggggaggccgaagagggacaggagcccagggcgagacguugggugagaaguggaaaaggcaacugaaucagcucaguaagaccgaauuuaacacuuacaaacgcucugggauaauggagguggaccggagcgaagcaaaggagggacuuaaaagaggcgaaacaaccaagcaugcugucucacgugguacugccaagcugaggugguucguggagcggaauuugguaaaacccgagggcaaggugauugaucugggguguggacgcggcgggugguccuauuacugcgcaggacucaaaaagguuacagaagugaaaggcuauaccaaggguggguuaggacacgaggaaccgaucccaauggcuacguacggcuggaaccuggucaaacuucauaguggcaaggacguguuuuucaugccucccgagaagugugauacccugcuaugcgacauuggggaaagcucuccaaaucccacaaucgaggagggacgaacucucagaguccugaaaaugguggaaccuugguugagggguaaccaguuuuguauaaagauccugaauccguacaugcccuccguuguagagacccucgaacagaugcaacggaaacacggcgggaugcuugugcgcaacccacugucaagaaauagcacacacgagauguauugggucucgugcggaacuggcaacauugugucugccguuaauaugaccaguaggauguuacugaaccgauucacaauggcccaucggaagccuaccuacgagcgugauguggacuugggugcggggacuagacacgucgcuguggaacccgagguagcaaaccucgauaucauuggacagcgcaucgaaaauauuaaaaacgagcauaaguccacguggcacuaugacgaagauaauccuuacaagacaugggccuaucacggcagcuacgaggugaaaccaucaggcuccgcuucuagcaugguuaacggggucgugaagcugcuaaccaaacccugggacgugaucccuauggucacucagauagccaugaccgacacaacgccauuuggacaacagaggguuuucaaggagaaaguggauacccggacucccagagcaaagcgcgguacaacccagauuauggaaguaacugccaaguggcuuuggggcuuucugaguaggaauaaaaagccgcgaaucuguacacgggaggaauucaccagaaaagugagguccaacgcugcgaucggggccgucuuuguggacgagaaucaguggaacagcgcaaaggaagcuguugaggaugagcgcuucuggaaucucgugcaucgugaacgggagcugcacaaacaaggaaagugcgccacaugcgucuauaacaugaugggcaagagagaaaaaaaguugggugaguuugggaaagcaaagggaucuagggccauuugguacauguggcugggcgcucgcuuccucgaauucgaggcccuuggcuuuaugaaugaggaccauugguucucacgagaaaacagucuguccgggguggagggagaagguuuacacaaacugggcuacauauugcgggauaucagcaagauuccugggggaaauauguaugcggacgauacugcaggcugggacaccagaaucacggaggaugaccuccagaacgaggccaaaauuaccgauaucauggaaccagagcaugcucugcuagccacaucuauauuuaagcuuacuuaccagaauaagguaguuagggugcagcgccccgcaaaaaacgguaccgucauggacgugaucucgagacgggaucaaagggggucaggacaggugggcacauauggccugaacacuuucaccaauauggaaguccagcucauucgucagauggagagcgaagggaucuuucugccuuccgaguuggagacgccaaacuuagcugaacgaguucuggacuggcucgagaagcacggagccgaacgccuuaaaagaauggcuauuaguggugacgauugugugguaaagcccaucgacgaucgguucgccacagcacugaccgcgcuaaaugacaugggcaaagugaggaaggauauaccgcaaugggagccuucuaagggguggaacgacuggcagcagguccccuuuugcagccaccauuuccaccagcugauuaugaaagauggacgcgaaaucgugguuccauguagaaaucaagacgagcucgugggccgggccagggucucccagggugcuggguggucauugcgagagacugccugccugggaaagaguuacgcacagauguggcaacuuauguauuuucaucguagagaucugcgccucgcugccaacgcaaucuguucugccgugccuguagacuggguucccacaagccggaccacuugguccauucacgcgcaccaucaguggaugaccacagaagauauguuaucaguguggaauagggucuggauagaggaaaacccauggauggaggacaaaacgcacgugagcucuugggaagagguucccuaccugggcaagagagaggaccaguggugcggcuccuugaucgggcugaccgcucgcgccacuugggcaacaaauauucagguggccaucaaccaaguccggaggcucauuggaaaugaaaacuaucuugauuacaugaccaguaugaaacgauucaagaaugagagcgacccugaaggugcucugugguga

SEQ ID NO: 13538 - RNA, 9879 nt, Artificial Sequence
  derived and/or modified CDS sequence (opt3) from DENV-1__GU131833__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggacaucuuaugugauguguacuggauccuucaaauuggagaaggaagucgcugagacccagcacgguacggugcugguucaggugaaguacgagggcacagaugcgccuugcaaaauaccauuccucacccaagacgaaaaggggguaacucagaacggacgccugaucacagcaaaucccauugucaccgauaaagagaagccugugaacaucgaaacugagccacccuuuggcgagagcuauauaguugugggugccggggaaaaagcucuuaagcugucgugguucaagaaaggcucuuccauuggaaagauguuugaggccaccgcaagaggcgccaggcggauggcuaucuugggggacacagccugggauuucggaucaaucgguggcgucuuuacgaguguggggaaacucguacaucagguguucggaaccgcauacggcguucuguuuagcggugucuccuggacuaugaagauugggaucggcauuuuacugacauggcuaggacucaauucucgaagcaccucacugaguaugacauguauagcggugggcauggugacucuuuacuugggggucaugguucaggcugacuccggaugcgugaucaacuggaaaggccgcgaacugaagugugguagcgggauuuucgugaccaacgagguacacacguggacagaacaauauaaguuucaggccgauucuccgaaaagacucucagcagccaucggaaaggcuugggaggagggcgucugcgguaucaggagugccacccggcuggaaaauauuauguggaaacagauaagcaacgaguuaaaucauauccugcuugaaaacgacaugaaguucacugugguugugggcgacgcaaaugggauuuuggcucagggaaaaaagaugauccgcccucaacccauggagcacaaauacuccuggaagucuuggggcaaggccaaaauuaucggggcggauauacagaacaccacauuuaucauugacggaccagauacuccugaaugucccgacgaucagagagccuggaauaucugggaggucgaggacuauggcuucgguauuuuuaccacaaacaucuggcucaagcugagggauucguacacgcagaugugcgaccaccgucuaaugagcgcugcaauaaaagauuccaaggccgugcaugcugacaugggguauuggauugaaucagagaaaaaugaaaccuggaagcuggcccgggcaaguuucaucgagguuaagacuuguacauggccaaaaucucacacccucuggagcaacggagugcuggaauccgagaugauuauccccaagauauacggcgguccuaucucacaacauaauuaucgaccaggcuacuucacucagacagcggggccguggcaccuuggaaaauuggagcuggauuuugacuuaugcgaaggcaccacgguagucguggaugagcacugcgggaacagaggacccagccucaggacuaccacagugaccggcaagauuauccaugaaugguguugccgcucuuguacucugccuccacuucgguucagaggugaggacgggugcugguacggaauggagauuaggcccgucaaagaaaaggaggaaaaucugguucgcuccauggugagugccggcagcggugagguagacucuuuuuccuugggcauccucugugugucaauaaugauugaagaggucaugcgaagucgguggagccguaagaugcugaugacagggacccuagcuguguuccugcuccugaucaugggacagcuuacauggaacgauuugaucagacugugcauuaugguuggcgccaaugcaucggacaggauggggaugggaacuaccuauuuagcucucauggccacguuuaaaaugcgcccuauguucgcagugggccugcuuuuucggagacugacauccagggagguccuacuccugaccaucgguuugucucugguggccagcguugaauuaccaaacucacucgaggaacugggggauggacuugcuaugggcauuaugaugcugaaguugcucacugaguuccaaccccaccagcuguggaccacacuacugagucuuacuuuuauaaaaaccacgcucucccuggacuacgcguggaagacaaccgccauggcauugucuaucgugagccuguucccguuaugucucuccacuacaucacagaaaaccacuuggcugccuguccuucugggcagcuuugggugcaagccauugacaauguuccucauuaccgaaaacaagaucuggggacgaaaaaguuggccccugaaugaggguauuauggcuaucggcauaguaucuauccuacuguccagccuucucaagaacgaugugccucuggccgggcccuugauugccggaggcauguuaaucgcuuguuauguuauuucggguucaucugcagaccugagucucgagaaagccgcggaaguguccugggagcaggaagcugagcauagcgggacgucucacaauauccuggucgaagugcaagaugacggaacuaugaagauaaaagaugaggagaaggacgauacccuuacaauucuguugaaagccacccuacuggcaguaagcggcguguacccaauguccaucccugccacacucuuugucugguauuucuggcagaagaagaaacagcgcucaggcguucugugggacacucccaguccaccggaaguggagcgggcugugcuugaugacgggaucuacagaauuuuacagaggggacugcucggucguagccaagucggcguggggguuuuccagaacggaguauuucauaccauguggcacgugacgcgcggcgcagucuugauguaucaggguaagcggcuggaaccuucuugggccuccgugaaaaaggaccucauaucauacgggggaggcuggagauuccagggcaguuggaauacaggggaggagguucaagugaucgcggucgaacccggaaaaaacccaaagaaugugcagacuacccccgguacauuuaagaccccugagggcgaaguaggggcuauugcccuggauuucaaaccaggaacuagcggcucccccaucgucaacagggaggguaagauuguggggcuuuacggaaauggcguugugaccacaucuggcacguaugucucggcaaucgcccaggcuaaagccagccaagaagggccucugccggagauagaggacgaaguguuuaagaaacgaaacuugacuaucauggaucuacacccaggaucagguaagacccggcgcuaccugcccgcaauuguuagagaggcuaucaagaggaaacuccggacauuaauucuggccccuacccgaguggucgcguccgaaauggccgaggcacuuaagggcaugccaaucagauaucagacuacagcugugaaaagugaacauaccgggcgcgagauaguagaccugaugugccacgccacguucacuaugaggcucuugucucccgugcguguuccuaauuacaacaugauuaucauggaugaggcucauuuuacagacccggcaagcaucgccgcccggggauauauuuccaccagagucggcaugggugaagcugcggcaaucuucaugaccgccacucccccagggucaguggaggcuuuuccucagucuaaugccgugauacaggaugaagagagggacauucccgaacgcagcuggaacaguggauacgauuggaucacagacuucccaggcaagaccgucugguuuguaccuuccauuaaaagcggcaaugauaucgcaaacugucugcgaaagaacgggaagagagugauacaacucucucggaaaacauucgacacugaguaucagaagacgaaaaauaacgacugggauuacguugugaccacagacauuucagagaugggagccaauuucagggcugaucgcgucaucgacccccguagaugccugaagccagugauccuuaaagaugguccggaacggguuauucuagcgggcccuaugcccgugacugucgccuccgcagcucagaggcgcgggcgaaucggaagaaaccagaauaaggagggcgaccaauacguguauaugggucagccacugaacaaugaugaagaccacgcccauuggaccgaggcaaagauguuguuagauaacauuaauacacccgaggggauaaucccugcccuguuugaaccagagcgggaaaaaagugcugccauugacggcgaguacaggcuccgcggagaagcgagaaagaccuucguagagcugaugaggcggggcgaucuucccguguggcugagcuauaaaguugcaucggagggguuucaguacucugaccgucgcuggugcuucgauggagaacgaaacaaucagguccucgaggaaaacauggacguggagaucuggacuaaggaaggugagagaaaaaaguugaggccucgguggcuggacgcccgcacguauuccgauccgcuagcucugagagaguuuaaagaauucgccgcuggcaggcggagcgugucaggggaccucauccuugagauuggaaagcugccacaacacuuaaccuugcgagcacagaaugcccuggauaaccucgucaugcugcacaauagugaacagggcgguaaggcuuacagacaugccauggaggaacuucccgacacaauagagacucugaugcucuuggcacugaucgcgguuuuaaccgggggcgugacacuauuuuuccugucuggaaaaggccucgggaagaccuccauuggacuucuguguguaacugccagcucagcuuugcuguggauggccaguguggagccucacuggaucgcagcuagcauuauccucgaauuuuuccugaugguccuucucauacccgagccagaucgccagaggacaccucaagacaaccagcuggccuaugugguuaucgguuugcuguuuaugauuuuaacgguggcagccaacgaaaugggccuacuggagaccacuaaaaaggaucucgggaucggacaugucgcugcggagaaucaccagcacgccacaaugcuugacguagaucugcggcccgcauccgcuuggaccuuguacgccguggccaccacaguuauuacuccaaugaugcgucauacgaucgaaaacaccacagcaaauauaucucugacugcuauugccaaccaagcggcuauccucaugggccuggacaaagguuggccuauuagcaagauggauaucggggugccgcuuuuagcccugggcugcuacucccaggucaauccccucaccuugacagcagccgugcugaugcuagucgcucacuaugcaauaaucggaccaggccugcaggccaaggcgaccagagaggcucagaaaaggacugccgcagggauuaugaagaacccuacgguggacggaaucguugccauugaucucgaccccgugguauacgacgcuaaauucgaaaagcaacuuggccagaucaugcuguugauacuguguacaucacagauucuccugaugcgcaccacuugggccuuaugcgagucuaucacccuugcaacagguccacugacuacccucugggaagggaguccuggaaaauuuuggaauacaacgaucgcugugucgauggccaacauuuuccggggcagcuaucuagcgggugccggccuggcauucuccuugaugaagucucuggggggaggccgaagagggaccggagcucagggcgagacucucggugagaaguggaaaaggcaacuuaaucagcugucaaagagcgaauuuaacacauacaaacgcuccgggaucauggaggucgaucggagugaagccaaggagggauugaaaagaggcgaaaccacuaagcaugcaguuucucgugguacagcuaagcugaggugguucguggagcggaaucucgucaaacccgagggcaaggugauagacuuaggguguggacgcggcggguggagcuauuacugcgccggacugaaaaagguaaccgaagugaaaggcuauacgaagggugggccgggacacgaggaaccaauuccuauggccaccuacggcuggaaccuuguuaaacugcauucaggcaaggauguguuuuucaugcccccagagaagugugacacacuacucugcgauaucggggaauccagucccaauccuacuauugaggagggacgaacccugagagucuugaaaaugguggaaccguggcugagggguaaccaguuuuguaucaagauacucaaucccuacaugccaagcgucguggagacacuugaacagaugcaacggaaacacggcgggaugcugguucgcaacccuuuaucuagaaauuccacucacgagauguauuggguaucaugcggaaccggcaacaucgugagcgcggucaacaugacaucgaggaugcuguugaaucgauucaccauggcucaucggaagcccacuuacgagcgugacguggaucucggugcagggacgagacacguugccguggaaccugaggucgcuaaccuggacauuaucggacagcgcauugaaaauaucaaaaacgagcauaagucuacauggcacuaugaugaagacaauccauacaagaccugggccuaucacggcaguuacgaggugaaacccuccggcagcgcaucauccaugguaaacggggugguuaggcuacuuacuaagccuugggaugucauuccaauggugacccagaucgccaugacagacacgacccccuuuggacaacagcggguguucaaagagaaggucgacacuagaacaccgcgcgcuaaaagggguaccacucagauaauggaaguuacagcgcgauggcuguggggcuuucucucucggaauaagaagccuagaauuuguaccagggaggaauucacacgcaaagugcguagcaacgccgcaaucggggcuguauuuguggaugagaaucaguggaacagugccaaggaagcagucgaggacgagcgguucugggaucuggugcauagagaaagggaguugcacaaacaaggaaagugcgccacuugcguuuauaauaugaugggcaaacgcgaaaagaagcugggugaguuugggaaagcuaagggaucccgagccaucugguacauguggcucggcgcgcgguuccuugaauucgaggcacugggcuuuauuaacgaggaccauugguucagcagagaaaauucuuuaucagggguggagggagaaggucugcacaaauugggcuacauacucagggauaucaguaagauuccagggggaaacauguaugccgacgauaccgcuggcugggacacgcgcaucaccgaggaugaccugcagaaugaggccaaaauuacagauaucauggaacccgagcaugcacuacuugcuacuuccauauuuaagcugaccuaccagaacaaagucgugagaguacagcggccugccaagaacgguacaguuauggacgugaucagcaggcgugaucaacgagggucuggacaggucggcacuuauggccucaauaccuucacgaacauggaagugcagcugauucgccagauggagucggaagggaucuuuuugccaucagaguuagagacacccaaucuggcugaaagagugcucgacuggcuugagaagcacggagccgaacggcugaaaaggauggcaauuagcggugacgauugugucguuaagccgaucgacgaucgcuucgcgaccgcccuaacugcucugaacgacaugggcaaagugagaaaggauauaccucaaugggagcccuccaaaggguggaaugacuggcagcagguaccauuuugcagucaccauuuccaccagcucauuaugaaggauggacgggaaaucguggucccuuguaggaaccaagacgaguuggugggccgagcccguguuucucagggugcaggguggagccugagagagacagcuugccuuggaaaguccuacgcccagauguggcaacugauguauuuucaucgccgggaucucagguuagcagccaaugcgaucuguucagcugugcccgucgacugggugccaaccaguagaacuaccuggucuauucacgcccaccaucaguggaugacaacggaagauaugcugagcguauggaaccgcguuuggauagaggaaaaucccuggauggaggacaaaacccacguguccucaugggaagaggucccuuacuugggcaagcgggaggaccaguggugcggcagccugaucgggcucacugcaagggccacaugggcuaccaacauucagguggccaucaaucaaguucgaagacuuauuggaaacgaaaauuaucuggauuacauggcaucuaugaaacgguucaagaacgaguccgacccagaaggugcucuaugguga

SEQ ID NO: 13539 - RNA, 9879 nt, Artificial Sequence
  derived and/or modified CDS sequence (opt3) from DENV-1__GU131834__SS-prME
agcgugaccaugcugcucaugcuucugccaacagcauuggcuuuccacuuaacuacgagaggaggggaaccucauaugaucgucuccaagcaggaaagaggaaaaucucugcuauuuaagaccucagccgguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggagaagacucugaaacuuucuugguucaagaaaggcuccucaauuggaaagauguuugaggcuaccgccagaggcgcaaggcggauggccauccugggggacacagcuugggauuucggaaguaucgguggcgucuuuacgagcguggggaaauugguacaucagguguucggaaccgccuacggcguucucuuuuccggugucucuuggacuaugaagauugggaucggcauucuguuaacauggcugggacuaaauagccgaucaaccagucucuccaugacauguauagcagugggcauggugacucuguaccuuggggucaugguucaggcggacagcggaugcgugaucaacuggaaaggccgcgaauugaagugugguucugggauuuucgugaccaacgagguacacacguggacagaacaauauaaguuucaggcugauucaccgaaaagacugagugccgcaaucggaaaggccugggaggagggcgucugcgguaucaggagcgcuacccggcucgaaaauauuauguggaaacagauauccaacgagcugaaucauaucuuacuggaaaacgacaugaaguucacugugguugugggcgacgccaaugggauucuugcacagggcaaaaagaugauccgcccucaacccauggagcacaaauacucuuggaagucguggggcaaggcuaaaauuaucggggccgauauacagaacaccacauuuaucauugacggaccagauacuccugaaugucccgacggccagagagcguggaauaucugggaggucgaggauuaugguuucgggauuuuuaccacaaacaucugguugaagcucagggacagcuacacgcagaugugcgaucaccgucugauguccgccgcuauaaaagacucaaaggcagugcaugccgauaugggauauuggauugaaagugagaaaaaugaaaccuggaagcuagcucgggccucuuucaucgagguuaagacuuguacauggccaaaaagccacacccugugguccaacggcgugcucgaaucagagaugauuauccccaagauauacgguggcccuaucagccaacauaauuaucgaccaggguacuucacucagacagcaggaccguggcaccugggcaaacuugaguuggacuuugaucugugcgaagggaccacgguagucguggacgagcacugcggaaacagaggccccucuuuaaggacuaccacagugaccgguaagauuauccaugaaugguguugccgcuccuguacucucccuccacugcgguucagaggggaggauggaugcugguacggcauggagauuaggcccgucaaagaaaaggaggaaaaucuuguucgcaguauggugagcgcggguucuggcgagguagacuccuuuucacuggggaucuugugugugaguauaaugauugaagaggucaugcgaagccgguggucgcguaagaugcucaugacaggaacccuggccguguuccuacugcucaucaugggccagcugacauggaacgaccuuaucagauugugcauuaugguuggggcuaaugccuccgauaggaugggaaugggcacuaccuaucuggcauuaauggcuacguuuaaaaugcgcccuauguucgccgugggucuccuguuucggagacuuacaucuagggagguccugcuacucaccaucgggcugagcuugguggcaucaguugaacugccaaacaguuuagaggaacucggagacggccuggccaugggcauuaugaugcuuaagcuguugacugaguuccaaccccaccagcucuggaccacacugcuaucccugacuuuugugaaaaccacgcuuucucucgauuacgcuuggaagacaaccgcgaugguccugagcauaguauccuuguucccgcuguguuuaucaacuacaagccagaaaaccacuuggcucccugugcugcuugggaguuuuggaugcaagccacugacaauguucuuuaucaccgaaaacaagauuuggggucgaaaaucuuggcccuugaaugagggcaucauggccauugggaucguuuccauacuccugagcucgcuacugaagaacgacgugccucuugcaggaccccucaucgcuggcgguaugcugauugccuguuaugucaucucagggucuagugccgauuuguccuuagagaaagcugcagaagugagcugggagcaggaagccgagcauucuggagcgagccacaauauucugguagaagugcaagacgauggcacgaugaagaucaaagacgaggagcgcgaugacacucucaccauacugcuuaaggcuacacuguuggccgucuccggcguuuacccaaugucaauuccugcaacccuauucgugugguauuucuggcagaaaaagaagcagcggaguggggugcugugggauacacccagcccaccggaagucgagagagccgugcucgacgauggaaucuacaggauccugcagcguggucuuuuaggccgcucucaaguugggguaggaguguuucaggacggcgucuuccauacuauguggcacgugacccggggugcuguucugauguaucaggggaaaagacucgaaccuuccugggcaucagugaagaaagacuugauuaguuacggaggcggcuggagguuucaggggagcuggaacacgggagaggagguccaagugauagccguagaacccgguaagaaucccaaaaauguccagacaacucccggcaccuucaagacaccugagggggaagugggagcgaucgcucuggauuuuaagccaggcaccuccgguucucccauuguuaaucgagaggggaaaaucgugggacucuacggcaacggcgucgugacuaccucggggacauauguuagcgccauugcacaggccaaggcuucacaagaaggaccucugccggagaucgaggacgaaguguucaaaaagcggaaucuuacgauaauggaucugcacccagguuccggcaaaacucgcagauacuugcccgccaucgucagggaggcaauuaagcggaagcuacgaacccugauccucgcuccuacaagagugguagccagugaaauggcggaggccuuaaaagggaugccaauucgcuaucagaccacugcagugaagucugaacauacaggaagggagaucguugaccugaugugccacgcuaccuuuacgaugcgucuucugagccccguccgggugccuaacuacaauaugauaauuauggaugaggcccauuucacugacccggcuuccaucgcagccagaggcuauaucucaacaaggguggguaugggggaagccgcugcgauuuuuaugaccgcaacucccccaggaucugucgaggccuucccucagagcaacgcuguaauccaggaugaagaacgcgacauacccgaacgaaguuggaacuccggcuacgauuggauuaccgacuuuccaggcaaaacagugugguucguuccuagcaucaagucugggaacgauauugccaauugucucaggaaaaauggaaagcgggugauccaauugucaaggaagaccuucgacacagaguaucagaaaacuaagaacaaugacugggauuacgucgugacgaccgacauauccgagaugggugcaaacuuucgcgccgaucguguuauugaccccagacggugccugaaaccagugauccucaaggauggcccggaaagggucauccuggcugggccuaugcccgugacaguagcgagugccgcacagcgccgaggaagaauuggccggaaucagaacaaagagggugaccaauacguguauauggggcagccacuuaauaacgaugaagaccacgcucauuggacugaggccaagaugcuacuggauaauaucaacacccccgagggcauuauaccugcauuguucgaaccagagagggaaaagagcgccgcuaucgacggagaguaccgcuuaagaggcgaagccaggaaaacauuuguugagcugaugcggcguggggaucuccccgucuggcugucguauaagguggcgucugagggauuccaguacuccgaccgccgauggugcuuugauggugaaagaaauaaccaggugcuugaggaaaauauggacgucgagauuuggaccaaagaaggcgagaggaagaaacugcggccucgcuggcucgacgcaagaacuuauagcgauccguuggcccugagggaguucaaggaauuugcugccgggcggcgaucaguuaguggagaccuaauccuggagaucggcaaacucccacaacaccuuacgcugagagcucagaacgcauuagauaauuuggugaugcugcacaacucugaacagggugggaaggccuaccgccaugcuauggaggaacuccccgacaccauugagacacugaugcuucuggcccucauagcaguauugacuggcggagugacccuguucuuuuuauccggcaaggggcuaggaaaaacaagcaucggucugcucugugucaccgcgucaagugcccuucuguggauggcuagcguggagccucacuggauugccgcauccaucauuuuggaguucuuucugaugguucuccugauccccgagccagauaggcagcggacuccucaagacaaucagcuugcuuauguggucauaggccuccuguucaugaucuugacaguagccgcaaacgaaauggggcuguuagagacgaccaagaaagaucuaggaauuggcuacguggccgcugagaaccaucagcacgcgacuaugcuggacguugaucuccgucccgccucugcauggacacuuuacgcuguggccaccaccgucaucacaccaaugaugagacacacuauugaaaauacgaccgccaacaucagccugacagcaauagcuaaucaagccgcgauuuugaugggucuggacaagggguggccuaucuccaaaauggauauuggcgugccgcuccuggcucuuggaugcuauucacaggucaaccccuuaacucugaccgccgcagugcucauguugguugcccauuacgcuaucauaggcccagggcugcaggcaaaggccacaagggaggcgcagaagcgcaccgcugccggaaucaugaaaaauccuacuguggacggcauuguagcaaucgaucuagaccccguggucuaugacgccaaguuugaaaaacaacugggucagauuaugcuccuuauccuguguacgucucagauauugcugaugcggacaaccugggcucucugcgagaguauuacucuggccaccgggccauuaacaacucuuugggaaggaucgccuggcaaguucuggaacaccacaaucgcaguuagcauggcuaauaucuuccgagguuccuaccuggccggcgcggggcucgccuuuucucuaaugaaaucacugggaggcgggagaaggggaacgggcgcacagggugagaccuugggggagaaguggaagcgccaacugaaccagcucagcaaauccgaguucaauacuuauaagcggaguggaauuauggagguggauagaucugaagcuaaagagggccuuaagcguggugaaacaaccaaacacgccgucagcaggggcacugcaaagcugcggugguuuguggagcgcaacuugguaaagcccgaggggaaagugaucgaccugggauguggccgagggggauggucauacuauugcgcuggccucaagaaaguuacagaagugaaggguuacaccaaagggggaccgggccaugaggaaccaauaccuauggccacguacggcuggaauuuagucaagcugcacuccgggaaagauguguucuuuaugcccccagagaagugugacacccuucugugcgauauuggagaaaguagccccaacccuacaaucgaggaggguagaacucuaaggguccucaagaugguggaaccguggcugcggggcaaucaguucuguauuaaaaucuugaaccccuauaugccaucuguuguagagacccuggaacagaugcaacgcaagcaugggggaaugcucgugagaaauccucuuuccaggaacucaacacacgagauguacugggucagcugcggcacugguaauauagugucggccguuaacaugaccucucgaaugcuguuaaaccgguuuacaauggcgcaccguaaacccaccuaugagagagacguggaucugggggcuggaacucgccaugucgcaguggaaccugagguagccaauuuggacaucauuggccagaggaucgaaaacauuaagaaugagcacaaaaguacguggcauuacgaugaagacaacccauauaagacaugggcuuaccacggcuccuaugaggugaagcccagcgggucagccuccucuaugguuaauggagucgugcggcuccugaccaaaccuugggaugugaucccaauggucacucagauugcaaugaccgacacaacgcccuucggucaacagagaguuuuuaaggagaaaguggacacccgcacuccgagggccaagcgaggcacaacccagaucauggaaguaacugcuaaauggcuauggggguuccuuagccggaacaagaagccuagaauauguacaagggaggaauuuacccgcaaagugcguaguaaugcggccauuggagcagucuucguggaugagaaccaguggaacuccgcuaaggaagccguugaggacgagcgguuuugggaucuggugcacagagaaagggagcuccauaaacaaggcaagugcgcaacaugcgucuacaacaugauggguaaacgcgaaaagaagcugggggaguucggaaaagccaagggcagccgagcuaucugguacaugugguugggcgcccgguuccuggaauuugaggcgcucggguucaugaaugaggaccacugguuuucuagagaaaacucacuuaguggaguggagggugaaggccugcauaaauuaggguauauccugagggauauuuccaagauaccaggaggcaauauguacgcagacgauacugccgguugggacacccgcaucacggaggaugacuugcagaacgaggcuaaaauuaccgauaucauggaacccgagcacgcccuccuggcaacaagcauuuucaagcuaacuuaucagaauaaaguaguuagagugcagcggccugcuaagaacgggaccgucauggacgugaucucuaggcgugaucaacgaggaucgggccaggugggcacauacgggcuuaacacuuuuaccaauauggaaguccagcugauacgccagauggagucagaaggaaucuuccucccaagcgagcuggagacgcccaacuuggccgaaagaguuuuagacuggcuggagaagcauggugcugaacggcucaaaaggauggccauuuccggcgacgauugugugguaaagccgaucgacgaucgcuuugcaacagcgcuuaccgcccugaaugacauggggaaagugagaaaggauauuccucaaugggagcccaguaaaggauggaacgacuggcagcaggucccauucugcucucaccacuuucaucagcuaaucaugaaggauggccgggaaauagugguuccuuguaggaaucaagacgagcuggugggucgagcucgugucagccagggggccggauggucccucagagagacugcaugcuugggcaagucauaugcucagauguggcaacugauguacuuccaccgccgggaucuuaggcuggccgcaaacgccauuuguagugcggugcccguagacuggguuccaacaucuagaaccacuuggagcauccaugcucaccaccaguggaugaccacagaagauaugcucuccguguggaaucgcgucuggaucgaggaaaaccccuggauggaggacaaaacgcaugugucaagcugggaagagguuccuuauuuaggcaagcgggaggaccaguggugcgggucucugauuggauugaccgccagggcaacuugggccacaaauauacagguggcuaucaaccaaguccgaagacugauugguaaugaaaacuaccucgauuacaugaccuccaugaaacgguuuaagaaugagagugacccagaaggcgcccuuugguga

SEQ ID NO: 13540 - RNA, 9879 nt, Artificial Sequence
  derived and/or modified CDS sequence (opt3) from DENV-1__GU131835__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuuggguucugcggcacccuggauucaccgugauugcuuuuuuccuggcacaugccaucggcacaucgauuacccagaagggcaucauauuuauccucuuaaugcuggucacgccaucaauggcuaugcgcugcguggggauuggaaacagagauuucguagagggucuuagcggcgccacuuggguugacguggucuuggagcacgggaguugugugacaaccauggcgaagaauaaacccacucuggauaucgaacuacucaagacagaggugaccaacccugcaguccugaggaaacuuugcauugaagccaagaucuccaauacgaccacagacucucgguguccaacucaaggagaggcuacccuggccgaagagcaggaugcaaacuuuguuugccgccgaacauucguggacagaggcugggguaauggguguggauuguuuggcaaaggcagccuccugacuugcgcuaaguucaagugcguaaccaaauuagaggggaagauagugcaguacgaaaaccugaaauauuccgucauugugacaguucacaccggagaucagcaucaaguggguaaugagacuacggaacacggcacaaucgccaccauuacuccccaggcgccuaccucagagauccagcucacagacuacggggcccuuacccuggacuguaguccaaggacuggauuggauuuuaacgaaaugguccuacugacaaugaaggagaaaagcuggcucgugcauaagcagugguuccuggaccuuccgcugcccuggacgucuggcgcauccaccucacaagagacuuggaaucggcaggauuugcucguaacauuuaaaaccgcucacgccaagaagcaggaaguugugguccuggguagccaagagggggcuaugcacacagccuuaacuggcgcaaccgaaauccagacgaguggaaccacaacuauuuucgccggccaucugaaaugccgucuaaagauggacaaacucacccugaaggggacaucuuaugugauguguacuggauccuucaaacuugagaaggaagucgcugagacccagcacgguacgguguugguucaggugaaguacgagggcacagaugcgccuugcaaaauaccauuuagcacccaagacgaaaaggggguaacucagaacggacgccugaucacagcaaaucccauugucaccgauaaagagaagccugugaacaucgaaacugagccacccuucggcgagucguauauaguugugggugccggggaaaaagcucucaagcugucuugguuuaagaaaggcuccucaauuggaaagauguucgaggccaccgcaagaggcgccaggcggauggcuauccuuggggacacagccugggauuuuggaaguaucgguggcgucuucacgagcguggggaaacugguacaucagguguuuggaaccgcauacggcguuuuguucuccggugucucuuggacuaugaagauugggaucggcauucuccugacaugguuaggacugaauagccgaucaaccagucuauccaugacauguauagcggugggcauggugacucucuaccugggggucaugguucaggcugacagcggaugcgugaucaacuggaaaggccgcgaacuuaagugugguucugggauuuuugugaccaacgagguacacacguggacagaacaauauaaguuccaggccgauucaccgaaaagauugagugcagccaucggaaaggcuugggaggagggcgucugcgguaucaggagcgccacccggcuggaaaauauuauguggaaacagauauccaacgagcucaaucauauccuguuagaaaacgacaugaaguuuacugugguugugggcgacgcaaaugggauucuggcucagggaaaaaagaugauccgcccucaacccauggagcacaaauacucuuggaagucguggggcaaggccaaaauuaucggggcggauauacagaacaccacauucaucauugacggaccagauacuccugaaugucccgacgaucagagagccuggaauaucugggaggucgaggacuauggcuuugguauuuucaccacaaacaucuggcuuaaguugagggauagcuacacgcagaugugcgaccaccgucucauguccgcugcaauaaaagauucaaaggccgugcaugcugacaugggguauuggauugaaagugagaaaaaugaaaccuggaagcuggcccgggcaucuuucaucgagguuaagacuuguacauggccaaaaagccacacccuaugguccaacggagugcuggaaucagagaugauuauccccaagauauacggcgguccuaucagccaacauaauuaucgaccaggcuacuuuacucagacagcggggccguggcaccucggaaaacuggagcuugauuucgacuugugcgaaggcaccacgguagucguggaugagcacugcgggaacagaggacccucucugaggacuaccacagugaccggcaagauuauccaugaaugguguugccgcuccuguacuuuaccuccacuccgguuuagaggugaggacgggugcugguacggaauggagauuaggcccgucaaagaaaaggaggaaaaucugguucgcaguauggugagcgccggcucuggugagguagacuccuucucacuuggcauccugugugugaguauaaugauugaagaggucaugcgaagccgguggucgcguaagauguugaugacagggacccucgcuguguuucugcuacugaucaugggacagcucacauggaacgaucugaucagacuuugcauuaugguuggcgccaaugcauccgacaggauggggaugggaacuaccuauuuggcucugauggccacguucaaaaugcgcccuauguuugcagugggcuuacucuuccggagacugacaucuagggagguccuucugcuaaccaucggucucagccugguggccucaguugaauugccaaacagucuggaggaauuaggggauggacucgcuaugggcauuaugaugcugaagcuucugacugaguuucaaccccaccaguuguggaccacacuccugucccuaacuuucauaaaaaccacgcugucucuugacuacgcguggaagacaaccgccauggugcucagcaucgucucccuguuuccguugugucugucaacuacaagccagaaaaccacuugguuaccuguacuccugggcaguuucgggugcaagccacuuacaauguuucugauuaccgaaaacaagaucuggggacgaaaaucuuggcccuugaaugaggguauuauggcaaucggcauaguguccauccuccugagcucgcuacugaagaacgauguuccucuugcugggccccucauugccggaggcaugcugaucgccuguuaugugauuucagguucuagugcugacuuguccuuagagaaagcagccgaagucagcugggagcaggaagcggagcauucugggacgagccacaauauccugguggaaguacaagaugacggaacuaugaagauaaaagaugaggagcgcgacgauacccucacaauucugcuuaaggcuacccuguuggccguguccggcgucuacccaaugucaaucccugcaacacuauucguuugguauuucuggcagaaaaagaagcagcggaguggcgugcugugggacacucccagcccaccggaaguggagagagccguccucgaugacgggaucuacaggauucugcagcguggacuuuuaggucgcucucaagugggcguugggguauuucaggacggaguguuccauaccauguggcacgucacgcggggcgcugugcugauguaucaggguaaaagacucgaaccuuccugggcaucaguuaagaaagauuugauaaguuacgggggaggcuggagguuucagggcagcuggaacacaggggaggaggugcaagucaucgccguggaacccggaaagaauccaaaaaacguacagacuacccccgguacauucaagaccccugagggcgaagucggggcgauugcucuggacuuuaagccaggaacuuccggcucucccaucgugaaucgagaggguaaaauuguugggcucuacggaaacggcguggucaccacaucgggcacguaugugagcgccaucgcacaggccaaggcuucacaagaagggccucugccggagauagaggaugaaguuuucaaaaagcggaaucuuacuaucauggaccugcacccaggauccgguaaaacccgcagauacuugcccgccauugugagggaggcaaugaagcggaagcuacgaacacugauccucgcuccuaccagagucguggccagugaaauggcggaggccuuaaaaggcaugccaauucgcuaucagacuacagcaguaaagucugaacauaccgggagggagaucguggaucugaugugccacgcuacguuuacuaugcgucuucugagccccguucgggucccuaacuacaauaugauaauuauggacgaggcccauuucacagauccggcuuccaucgcagccagaggauauaucucaaccagggugggcaugggugaagccgcugcgauuuuuaugaccgcaacucccccagggucuguggaggccuucccucagagcaacgcugucauccaggacgaagagcgcgauauacccgaacgaaguuggaauuccggauacgaguggauuacagacuuuccaggcaaaaccguaugguucgugccuagcaucaagucuggcaacgauauugccaauugucucagaaaaaacgggaagcggguuauccaauugucaaggaagacauucgacacugaguaucagaaaacgaagaacaaugacugggauuacguggucaccacagacauauccgaaaugggagcaaacuuucgcgccgaucgugugauugaccccagacggugccugaaaccaguuauccucaaggaugguccggagagggugauccuggcuggcccuaugcccgucacuguggcgagugccgcacagcgccgagggagaauuggacggaaucagaacaaagaaggcgaccaauacguauauaugggucagccacuuaauaacgaugaggaccacgcucauuggaccgaggccaagaugcuacuggauaauaucaacacacccgaagggauuauaccugcauuguucgagccagaaagggagaagagcgccgcuaucgacggcgaauaccgcuuaagaggagaggccaggaaaaccuuuguggagcugaugcggcguggcgaucuccccguuuggcugucguauaaggucgcgucugaaggguuccaguacuccgaccgccgauggugcuuugauggagagagaaauaaccaggugcuugaagagaauauggacguggaaauuuggacuaaagagggugagaggaagaaacugcggccucgcuggcucgacgcaagaacguauagcgauccguuggcccugagggaauucaaggaguuugcugccggccggcgaucagucaguggggaccuaauccuggaaaucggaaaacucccacaacaccuuacccugagagcucagaacgcauuagauaauuugguuaugcugcacaacucugagcagggcgguaaggccuaccgccaugcuauggaagagcuccccgacacaauugagacucugaugcuucuggcccucauagcaguguugaccgggggcguaaugcuguucuuuuuauccggaaagggccuagggaaaacaagcaucggacugcucugugugaccgcgucaagugcccuucuguggauggcuagcgucgaaccucacuggauugccgcauccaucguguuggaguucuuucugaugguucuccugauucccgaaccagauaggcagcggacuccucaagacaaucagcuugcuuauguggucaucggucuccuguucaugauauugacaguagccgcaaacgagaugggccuguuagagacgaccaagaaagaucuagggaucggacaugccgcugcggaaaaccaccagcacgccacuaugcuggacguggaucuccgucccgcaucugcuuggacacuuuacgccguugccaccaccgugauuacaccaaugaugagacauacuaucgagaauacgaccgcaaacauuagccugacagcuaucgccaaucaagcggcuauauugaugggccuggacaaggguuggccuauuuccaaaauggauaucggggucccgcuccuggcccuuggcugcuacucacaggugaaccccuuaacucugaccgcagccguccucauguugguggcucacuaugcaauuaucggaccaggccugcaggccaaggcgacaagggaagcucagaagcgcaccgccgcagggauaaugaaaaauccuacuguugacggaaucguggccauugaucuagaccccguaguguacgacgcuaaguuugagaaacaacugggccagaucaugcuccuuauucuguguacgucucagaucuugcugaugcggacaaccugggcccucugcgaaaguauaacucuggcaaccgguccauuaacaacucuuugggaggggucgccuggaaaguucuggaacaccacaauugcugucagcauggccaauaucuuccgaggcuccuaucuggcgggugccggccucgcauuuucucuaaugaaaucacuggggggaggcagaagggggacgggagcucagggcgagaccuugggugaaaaguggaagcgccaacugaaccagcucagcaaacccgaguucaauacuuacaagcgguccgggaucauggaaguugauagaagugaggccaaagaaggacuuaagcguggcgagacaaccaaacaugcagugucuagggguacugcuaagcugcggugguuugucgagcgcaacuuggugaagccggaaggcaaaguaauugaccugggguguggacgaggcggguggagcuauuacugcgccggacucaagaaagugacagagguuaagggcuauaccaaaggugggccaggacacgaagagccuauccccauggccacguacggcuggaauuuagugaagcugcauucaggcaaagaugucuucuuuaugccacccgaaaagugugacacccuucugugcgauauaggggaguccaguccuaacccgacaauugaggaaggaagaacucuaagggugcucaagauggucgagcccuggcugcgggguaaucaguucuguaucaaaauuuugaacccauacaugccuaccgugguugaaacacuggagcagaugcaacgcaagcacggcgggaugcucguaagaaauccccuuagcaggaacucuacucacgagauguauuggguguccugcggaaccggcaauaucgucucagcggugaacaugacaagccgaaugcuguuaaaccgguuuaccauggcucaucguaaaccuacuuacgaaagagacguugaucugggugcagggacgcgccacguggccgucgagccagaaguggcuaauuuggacauaaucggacagaggauugagaacaucaagaaugaacauaaaucgacauggcacuaugaugaggacaaccccuacaagaccugggccuaucacggcucuuacgagguaaagccuaguggcuccgcaagcucaauggugaaugggguuguccggcuccugacuaaaccaugggaugugauucccauggugacccagaucgccaugacagacacgaccccguucggacaacagagagucuuuaaggaaaaaguugacacucgcacaccuagggcuaagcgagguaccacucagauuauggaggugacagcgaaauggcuauggggcuuccuuucccggaacaagaagccaagaaucuguaccagggaagaguuuacacgcaaaguacguucuaaugccgcaauaggggcuguguucgucgaugaaaaccaguggaauagcgccaaggaggcaguggaggacgaacgguuuugggaucugguucauagagagagggaacuccacaaacaaggaaagugcgccacuugcguguauaacaugaugggcaaacgcgagaagaagcugggugaauucgggaaagcuaagggaagucgagccauuugguacaugugguugggcgcgcgguuccuggaguuugaggcacucggcuucaugaaugaagaccauugguuuuccagagagaacagccuuucuggggucgaaggagagggucugcacaaauuaggcuacauccugagggauaucucacgcauucccgggggaaauauguaugccgacgauaccgcuggcugggacacgagaauaaccgaggaugacuugcagaacgaagccaagaucacagauauuauggagccugaacaugcacuccuggcuacuaguaucuucaaacuaaccuaccagaauaaggugguacggguucagaggccagccaaaaacgguacagugauggacgucauuucccgucgagaucaacgcgggagcggacaggugggcacuuauggccuuaacaccuuuacgaauauggaggugcagcugaucagacagauggaaucugaggggauauuccuccccucggagcuggaaacaccgaacuuggcugagcgggucuuagacuggcuggaaaagcacggagccgagaggcucaagcgcauggcaaucucaggugacgauuguguugugaaaccuauugacgauagauuugcgaccagccuuacugcccugaaugacaugggcaagguacggaaagauaucccccaaugggaaccauccaagggguggaacgacuggcagcaggugccuuucugcagucaccauuuucaccagcuaauuaugaaagauggaagggagaucgucgugcccugucgaaaucaagacgagcugguuggccgugcuagagugucucagggugccggguggagccuccgcgaaacagcaugcuugggaaaguccuacgcucagauguggcaacugauguauuuccaucggagggaucuuagacuggccgcaaacgccauauguucagcggucccaguggacuggguacccaccagucgcacuaccuggucuauucacgcucaccaucaguggaugacaacggaggauaugcucagcguuuggaaucggguguggaucgaagagaacccuuggauggaagacaagacccacgucuccucaugggaggaggugccauacuuaggcaaaagggaagaccaguggugcggcagccugaucggguugacugcccgagcaacaugggccaccaauauucagguugcuauaaaccaagugagacggcugaucggaaaugagaacuaucucgauuacaugacuucuaugaagagguuuaaaaaugaauccgaccuugagggugcccugugguga

SEQ ID NO: 13541 - RNA, 9879 nt, Artificial Sequence
  derived and/or modified CDS sequence (opt3) from DENV-1__GU131836__SS-prME
agcgugaccaugcugcucaugcuucugcccacagcauuggcuuuccacuuaacuacgagaggaggggaaccucauaugaucgucuccaagcaggaaagaggaaaaucucuguuauuuaagaccucagccgguguuaacaugugcacacucauugccauggaccugggagaacuuugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuggcaccccaugucggcuugggucucgagacuagaaccgaaacauggauguccucugagggggccuggaaacagauccagagaguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacuuuggauaucgaacuccugaagacagaggugaccaacccugccgugcuuaggaaacugugcauugaagcuaagaucuccaauacgaccacagacucucgguguccaacucaaggagaggccaccuuggucgaagaacaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggacaucuuaugugauguguacuggauccuucaaauuggagaaggaagucgcugagacccagcacgguacggugcugguucaggugaaguacgagggcacagaugcgccuugcaaaauaccauucagcacccaagacgaaaaggggguaacucagaacggacgccucaucacagcaaaucccauugucaccgauaaagagaagccugugaacaucgaaacugagccacccuuuggcgagucguauauaguugugggugccggggaaaaagcucugaaacuuucuugguucaagaaaggcuccucaauuggaaagauguuugaggccaccgcaagaggcgccaggcggauggcuauccugggggacacagccugggauuucggaaguaucgguggcgucuuuacgagcguggggaaauugguacaucagguguucggaaccgcauacggcguucucuuuuccggugucucuuggacuaugaagauugggaucggcauucuguuaacauggcugggacuaaauagccgaucaaccagucucuccaugacauguauagcggugggcauggugacucuguaccuuggggucaugguucaggcugacagcggaugcgugaucaacuggaaaggccgcgaauugaagugugguucugggauuuucgugaccaacgagguacacacguggacagaacaauauaaguuucaggccgauucaccgaaaagacugagugcagccaucggaaaggcuugggaggagggcgucugcgguaucaggagcgccacccggcucgaaaauauuauguggaaacagauauccaacgagcugaaucauaucuuacuggaaaacgacaugaaguucacugugguugugggcgacgcaaaugggauucuuguccagggcaagaagaugauccgcccucaacccauggagcacaaauacucuuggaagucguggggcaaggcuaaaauuaucggggccgauauacagaacaccacauuuaucauugacggaccagauacuccugaaugucccgacgaucagagagcguggaauaucugggagguggaggacuauggcuucgguauuuuuaccacaaacaucugguugaagcucagggauagcuacacgcagaugugcgaccaccgucugauguccgccgcuauaaaagauucaaaggcaguucaugccgacaugggguauuggauugaaagugagaaaaaugaaaccuggaagcuaucucgggcuagcuucaucgaggugaagacuuguacauggccaaaaucccacacccuguggucaaacggaguacucgaaagcgagaugauuauccccaagauauacggcgguccuaucucucaacauaauuaucgaccaggcuacuucacucagacagccgggccguggcaccugggaaaacuugaguuggauuuugaccugugcgaaggcaccacggucgugguggaugagcacugcgggaacagaggacccuccuuaaggacuaccacagucaccggcaagauuauccaugaaugguguugccgcaguuguacucucccuccacugcgguucagaggugaggacgggugcugguacggaauggagauuaggcccguuaaagaaaaggaggaaaaucuugugcgcagcaugguaucugcaggcuccggugagguggacucauuuagucugggcaucuugugugucagcauaaugauugaagaggugaugcgaucgcgguggucccguaagaugcucaugacagggacccuggcgguuuuccuacugcucaucaugggacagcugacauggaacgaucuuaucagauugugcauuauggugggcgccaaugcuucugacaggauggggaugggaacuaccuaucuggccuuaauggcaacguuuaaaaugcgcccuauguucgcugucggccuccuguuucggagacuuacaagcagggaggugcugcuacucaccaucggucugucauugguugccaguguggaacugccaaacuccuuagaggaacucggggauggacuggcaaugggcauuaugaugcuuaagcuguugacugaguuccaaccccaccagcucuggaccacacugcuaucucugacuuuuauaaaaaccacgcuuagccucgacuacgccuggaagacaaccgcuauggcgcuguccaucgucucauuguucccgcuguguuuaagcacuacaagucagaaaaccacuuggcucccuguacugcuuggcucuuuugggugcaagccacugacaauguucuugauuaccgaaaacaagaucuggggacgaaaauccuggccccucaaugaggguauuauggccaucggcauagugagcauccugcuaucgucacugcuuaagaacgauguuccucucgcagggccccugauugcuggaggcauguugaucgccuguuaugugauuucugguaguuccgccgacuuaagccuggagaaagcugcagaagucucuugggagcaggaagccgagcauagcgggacgucccacaauauccucguggaaguacaagaugacggaacuaugaagauaaaagaugaggagaaggacgauacccugacaauucuucugaaagcgaccuugcuagcugugucaggcgucuacccaaugaguaucccugccacacuguuuguuugguauuucuggcagaagaagaaacagcgcagcggcgugcucugggacacucccucuccaccggaaguggagcgggcaguccuggaugacgggaucuacaggauucuucagaggggauuacugggucguucccaagugggcguugggguauuccaggacggaguguuucauaccauguggcacgucacgcgcggcgccgugcucauguaucaggguaagcgguuggaaccuucaugggcuaguguuaaaaaggaucugauaagcuacgggggaggcuggagauuccagggcuccuggaacacaggggaggaggugcaagucaucgcaguggaacccggcaagaauccaaagaacguacagacuacccccgguacauuuaagaccccugagggcgaagucggggccauugcgcucgacuucaaaccaggaacuucuggcucgcccaucgugaauagggaggguaagauuguugggcuguacggaaacggcguggucaccacaagcggcacguaugugucagcuaucgcccaggcaaaagccucccaagaagggccucuuccggagauagaggaugaaguuuuuaagaaacgaaaucugacuaucauggacuugcacccaggaagugguaagacccggcgcuaccuacccgcuauugugagagaggccaucaagaggaaacugcggacacucauuuuagcaccuacccgagucguggcuucugaaauggccgaggcgcugaagggcaugccaaucagauaucagacuacagccguaaaaagcgaacauaccgggcgcgagauaguggaucuuaugugccacgcaacguucacuaugaggcugcucucccccguucgugucccuaacuacaauaugauuaucauggacgaggcucauuuuacagauccggccucaaucgcugcacggggauauauuucuaccagagugggcaugggugaagccgccgcuaucuucaugaccgcgacucccccagggagcguggaggcauuuccucagaguaacgccgucauacaggacgaagagagggauauucccgaacgcuccuggaauagcggauacgacuggaucacagauuucccaggcaagaccguaugguuugugccuucuauuaaaucaggcaacgacaucgcuaauuguuugcgaaagaacgggaagagaguuauacaacugucccggaaaacauucgacacugaguaucagaagacgaaaaacaaugauugggacuacguggucaccacagauauuagugagaugggagccaacuucagggcagaccgcgugaucgauccccguagaugccucaagccaguuauccugaaagacgguccggaacgggugauucuugccggcccuaugcccgucacuguggcuagcgcggcccagaggcgcgggcgaaucggaagaaaucagaacaaggagggcgaucaauacguauauaugggucagccacuaaauaacgacgaagaucacgcacauuggaccgaggcuaagaugcuguuggacaauauuaacacacccgaggggauaaucccugccuuauuugaaccagagcgggaaaaaucggcagccauugauggcgaguacaggcugcgcggagaagcuagaaagaccuucguggagcucaugaggcggggcgaccugcccguuuggcuuucuuauaaagucgccuccgagggguuucaguacagcgaucgucgcuggugcuucgacggagaacgaaauaaccaggugcuggaggaaaauauggacguggagaucuggacuaaggaaggugagaggaagaagcucaggccucggugguuggaugcgcgcacguauucagacccgcuggcacuaagagaguuuaaagaguucgccgcuggcaggcggagugucucuggggaucugauccucgagauuggaaaacuuccacaacaccugaccuuacgagcccagaacgcuuuggacaaucugguuaugcuccacaacuccgaacagggcgguaaggcauacagacaugccauggaggaacugcccgauacaauagagacucuuaugcugcucgcuuugaucgccgugcugaccgggggcguaacauuauuuuuccuaagcggaaaaggccuggggaagaccucaauuggacuccuuugugugauggcaaguagcgcgcuguuguggauggccuccgucgagccucacuggaucgcugccucuauuauccuggaauuuuuccucauggugcugcuuauacccgagccagaccgccagaggacuccucaagauaaucagcucgcauauguugugaucggucuguuguuuaugauucugacagucgcugccaacgaaaugggcuuacuagagacgaccaaaaaggaccuggggaucggacauguagcagccgagaaccaccagcacgcuacuaugcucgauguggaccuucggcccgcgagcgccuggacacuguacgcaguugcuaccaccgugauuacaccaaugaugcgucauacuaucgaaaauacgaccgccaacauauccuugacagccauugcaaaucaagcugccauccugaugggccucgauaaagguuggccuauuucaaagauggacaucggggucccgcugcuugcguuaggcugcuacucucaggugaacccccugacucucaccgcugccgucuugaugcugguggcacacuaugccauaaucggaccaggccuacaggcuaaggcaacaagagaggcccagaaaaggaccgcggcugggauuaugaagaauccuacuguugauggaaucguggccauugaccuggaccccguaguguacgaugcaaaauucgaaaagcaacucggccagaucaugcuucugauauuguguacgagucagauucugcucaugcgcacaaccugggcccugugcgagucgaucacuuuagcuaccgguccacuuacaacucugugggaagggagcccuggaaaauuuuggaacaccacaaucgccgucuccauggcaaauauuuuccggggcucuuaucucgcuggugccggccuagcguucucacugaugaaaagccuagggggaggccgaagagggacgggagcccagggcgagacccugggugagaaguggaaaaggcaacucaaccagcuuuccaagagugaauuuaauacuuacaaacgcucugggaucauggagguugaccggagcgaagcaaaggagggacugaaaagaggcgaaacaaccaagcaugcugugucacgugguacugccaaguugaggugguucgucgagcggaaccuggugaaacccgagggcaagguaauagaucucggguguggacgcggcgggugguccuauuacugcgcaggacugaaaaaggugacagaaguuaaaggcuauaccaagggugggccgggacacgaggaaccaauuccuauggcuacguacggcuggaaucuagugaaacuucauaguggcaaggacgucuuuuucaugcccccagagaagugugauacccugcuaugcgacaucggggaaagcucucccaacccuacaauugaggagggacgaacucucagagugcugaaaauggucgaaccgugguugagggguaaucaguuuuguaucaagauacugaaccccuacaugccauccgugguugagacccucgaacagaugcaacggaaacacggcgggaugcuuguacgcaauccucugucaagaaacagcacacacgagauguauugggugucgugcggaacuggcaauaucgucucugccgugaacaugaccaguaggauguuacugaaccgauucacaauggcccaucggaagcccaccuacgagcgugauguugacuugggugcggggacuagacacguggcugucgaaccugaggugccaaaucucgauauuaucggacagcgcauugaaaacaucaaaaaugagcauaaguccacguggcacuaugacgaagauaaccccuacaagacaugggcauaucacggcagcuacgagguaaaaccuucaggcuccgccucuagcauggugaaugggguugucaggcugcuaaccaagccaugggacgugauucccauggugacucagaucgcuaugaccgacacaacgccguuuggacaacagcgggucuucaaagagaagguugauaccagaacuccucgcgccaaaagggguacaacccagauaauggaagugacugcaaaguggcuuuggggcuuucugagucgaaacaagaaaccacggauuuguacaagagaggaguucaccaggaagguacgcuccaaugccgcuaucggggcgguguuugucgacgagaaccaguggaauagcgccaaagaagcaguggaggaugagcguuucugggaccucguucaucgggaaagagagcugcacaagcaaggaaaaugcgcuacaugcguguauaacaugaugggcaagagggaaaagaaauugggugaguuugggaaggccaaaggaucucgcgcaaucugguacauguggcugggcgcccgauuccucgaguucgaggcucuuggcuuuaugaaugaggaucauugguucucacgggaaaacagucuguccggggucgagggagaagguuuacacaagcugggcuacauuuugagagacauaagcaaaauccccgggggaaauauguaugccgaugacacugcgggcugggauaccaggauuacggaggacgaucuccagaacgaggcaaagaucaccgacauuauggaaccuggucaugcccugcuagcuacaucuaucuuuaaacuuacuuaccagaauaaggugguacgcguucagagaccagccaagaacgggaccgugauggaugucauaucgcggagggaccaacguggaucaggccaggugggcacauaugggcugaacacuuucaccaauauggaggugcagcucauccgacagauggaaagcgagggaauuuuucugcccuccgaauuggagacgccgaacuuagcagagcgcguccuggacuggcucgaaaaacacggugcugagagacuuaagcggauggccaucaguggcgaugacuguguugugaaaccuauugaugacagguucgcuacagcccugaccgcacuaaaugauauggggaagguacgcaaagacaucccccaaugggaaccaucuaagggauggaacgauuggcaacaggugccuuuuugcagccaccauuuccaccagcugauaaugaaggacggcagagagauugucgugcccugucggaaucaagaugaacucguugguagggcgcgagugucccagggggccggauggucauugcgugagacugcuugccugggcaaaaguuacgcccagauguggcaacuuauguauuuucauagacgcgaccugcggcucgcagcuaacgccaucuguucugcagucccaguggauuggguacccacaagcaggaccacuugguccauccacgcccaccaucaguggaugaccacagaggacauguuaucaguuuggaauagaguguggauugaagagaacccuuggauggaagacaagacgcacgucagcucuugggaggaagugccauaccugggcaaacgcgaggaucaguggugcggguccuugauaggacugaccgcgcgggcuacuugggccacaaauauccagguugcaauuaaccaagugaggcgacucaucgguaaugagaacuaucuugacuacaugaccaguaugaagagauucaaaaaugaaagcgauccggagggcgcccugugguga

SEQ ID NO: 13542 - RNA, 9879 nt, Artificial Sequence
  derived and/or modified CDS sequence (opt3) from DENV-1__GU131837__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucagcagguguuaacaugugcacacucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuauugcacuguuucucgcccaugcuaucggcacaucgauuacccagaagggcaucauauucaucuuacugaugcuugugacgccaucaauggccaugcgcugcgucgggauuggaaacagagauuuuguggaggguuugagcggcgcgacuuggguagacguugugcuggagcacgggaguugugucacaaccauggcaaagaauaaacccacucuagauaucgaacuccugaagacagaggugaccaacccugccgugcuuaggaaacugugcauugaagcuaagaucuccaauacgaccacagacucucgguguccaacucaaggagaggccaccuuggucgaagagcaggaugcaaacuucguuugccgccgaacauuuguggacagaggcugggguaauggguguggacucuucggcaaaggcagccuguuaacuugcgcuaaguuuaagugcguaaccaaacuggaggggaagauagugcaguacgaaaaccucaaauauuccgucauugugacaguucacaccggagaucagcaucaaguggguaaugagacuacggaacacggcacaaucgccaccauuacuccccaggcgccuaccucagagauccagcuuacagacuacggggcccugaccuuggacuguaguccaaggacuggacuagauuucaacgaaaugguccugcucacaaugaaggagaaaagcuggcuggugcauaagcagugguuucuugaccugccguugcccuggacgucuggcgcauccaccucacaagagacuuggaaucggcaggaucuccugguaacauucaaaaccgcucacgccaagaagcaggaaguuguggucuuagguagccaagagggggcuaugcacacagcccugacuggcgcaaccgaaauccagacgaguggaaccacaacuauuuuugccggccaucuaaaaugccgucucaagauggacaaacugacccuuaaggggaugucuuaugugauguguacaggauccuucaaauuggagaaggaagucgcugagacucagcacgguaccgugcugguucaggugaaguacgagggcacggaugcgccuugcaaaauaccauucagcacacaagacgaaaaggggguaacccagaacggacgccucaucacugcaaaucccauugucacagauaaagagaagccugugaacaucgaaaccgagccacccuuuggcgagucguauauaguugugggugccggggaaaaagcucugaagcuuucuugguucaagaaaggcuccucaauuggaaagauguuugaggccacugcaagaggcgccaggcggauggcuauccugggggacaccgccugggauuucggaaguaucgguggcgucuuuacaagcguggggaaauugguacaucagguguucggaacggcauacggcguucucuuuuccggugucucuuggaccaugaagauugggaucggcauucuguuaacuuggcugggacuaaauagccgaucaacaagucucuccaugaccuguauagcggugggcauggugacacuguaccuuggggucaugguucaggcugacagcggaugcgugaucaacuggaaaggccgcgaauugaagugugguucugggauuuucgugacuaacgagguacacaccuggacggaacaauauaaguuucaggccgauucaccgaaaagacugagugcagccaucggaaaggcuugggaggagggcgucugcgguaucaggagcgccacacggcucgaaaauauuauguggaaacagauauccaacgagcugaaucauaucuuacuggaaaacgacaugaaguucaccgugguugugggcgacgcaaaugggauucuugcucagggaaaaaagaugauccgcccucaacccauggagcacaaauacucuuggaagucguggggcaaggccaaaauuaucggggcggauauacagaacacuaccuuuaucauugacggaccagauacaccugaaugucccgacggccagagagccuggaauaucugggaggucgaggauuaugguuucgggauuuuuacuaccaacaucugguugaagcucagggacagcuacacacagaugugcgaucaccgucugauguccgcugcaauaaaagacucaaaggccgugcaugcugauaugggauauuggauugaaagugagaaaaaugaaacguggaagcuagcccgggcaucuuucaucgagguuaagaccuguacuuggccaaaaagccacacacugugguccaacggcgugcucgaaucagagaugauuauccccaagauauacgguggcccuaucagccaacauaauuaucgaccaggguacuucacccagacugcgggaccguggcaccugggcaaacuugaguuggacuuugaucugugcgaagggacaaccguagucguggacgagcacugcggaaacagaggccccucuuuaaggacgacuaccgugacagguaagauuauccaugaaugguguugccgcuccuguacccucccuccacugcgguucagaggggaggauggaugcugguacggcauggagauuaggcccgucaaagaaaaggaggaaaaucuuguucgcaguauggugagcgccgguucuggcgagguagacuccuuuucacuggggaucuugugugugaguauaaugauugaagaggucaugcgaagccgguggucgcguaagaugcucaugacuggaacacuggcuguguuccuacugcucaucaugggccagcugaccuggaacgaccuuaucagauugugcauuaugguuggggccaaugcauccgauaggaugggaaugggcacaacuuaucuggcuuuaauggccaccuuuaaaaugcgcccuauguucgcagugggucuccuguuucggagacuuacgucuagggagguccugcuacucacaaucgggcugagcuugguggccucaguugaacugccaaacaguuuagaggaacucggagacggccuggcuaugggcauuaugaugcuuaagcuguugaccgaguuccaaccccaccagcucuggacuacccugcuaucccugacauuugugaaaacuacccuuucucucgauuacgcguggaagacgacagccaugguccugagcauaguauccuuguucccgcuguguuuaucaaccacuagccagaaaacaaccuggcucccugugcugcuugggaguuuuggaugcaagccacugacuauguucuugaucacagaaaacaagauuuggggucgaaaaucuuggccccucaaugagggcaucauggcaauugggaucguuuccauacugcuaagcucgcugcuuaagaacgacgugccucucgcuggaccccugaucgccggcgguauguugauugccuguuaugucaucucagggucuagugcugauuuaucccuggagaaagcagccgaagugagcugggagcaggaagcggagcauucuggagcuagccacaauauucucguagaagugcaagacgauggcaccaugaagaucaaagacgaggagcgcgaugacacgcugacuauacuucugaaggccaccuugcuagcagucuccggcguuuacccaaugucaauuccugccacacuguuugugugguauuucuggcagaaaaagaagcagcggaguggggugcucugggauacccccagcccaccggaagucgagagagcugugcuggacgauggaaucuacaggauccuucagcgugguuuacugggccgcucucaaguugggguaggaguguuccaggacggcgucuuucauacaauguggcacgugacucggggugcaguucucauguaucaggggaaaagauuggaaccuuccugggccucagugaagaaagaccugauuaguuacggaggcggcuggagguuccaggggagcuggaacaccggagaggagguccaagugauagcgguagaacccgguaagaauccaaaaaacguccagacgacacccggcacuuuuaagaccccugagggggaagugggagcuaucgcccucgauuucaagccaggcacauccgguucucccauuguuaaucgagaggggaaaaucgugggacuguacggcaacggcgucgugaccacuucggggaccuauguuagcgcaauugcccaggcuaaggccucacaagaaggaccucuuccggagaucgaggacgaaguguuuaaaaagcggaaucugacaauaauggauuugcacccagguuccggcaaaacgcgcagauaccuacccgcaaucgucagggaggcuauuaagcggaagcugcgaacucucaucuuagccccuaccagagugguagcgagugaaauggccgaggcacugaaagggaugccaauucgcuaucagacaaccgcugugaagucugaacauacuggaagggagaucguugaccuuaugugccacgccacauucaccaugcgucugcucagccccguccgggugccuaacuacaauaugauaauuauggaugaggcucauuuuacggacccggcauccaucgccgccagaggcuauaucucaacuaggguggguaugggggaagcugcggcaauuuucaugacagccacccccccaggaucugucgaggcuuuuccucagagcaacgccguaauccaggaugaagagcgcgacauacccgaacgaaguuggaauuccggcuacgauuggauuaccgacuucccaggcaaaacugugugguuuguuccuagcaucaagucugggaacgauauugcaaauuguuugagaaaaaacggaaagcgggugauccaacugucaaggaagacauucgacaccgaguaucagaaaacaaagaacaaugacugggauuacgucgugacuacggacauauccgagaugggugccaacuuccgcgcugaucguguuauugaccccagacggugccucaaaccagugauccugaaggauggcccggaaagggucauccuugcggggccuaugcccgugaccguagccagugcagcucagcgccgaggaagaauuggccggaaucagaacaaagagggugaccaauacguguauauggggcagccacuaaauaacgaugaagaccacgcccauuggacagaggcaaagaugcuguuggauaauaucaacacucccgagggcauuauaccugccuuauuugaaccagagagggaaaagagcgcugccaucgacggagaguaccgccugagaggcgaagcgaggaaaaccuucguugagcucaugcggcguggggaucugcccgucuggcuuucguauaagguggcaucugagggauuucaguacuccgaccgccgauggugcuucgauggugaaagaaauaaccaggugcuggaggaaaauauggacgucgagauuuggacaaaagaaggcgagaggaagaaacuccggccucgcugguuggacgccagaaccuauagcgauccgcuggcucuaagggaguuuaaggaauucgccgcugggcggcgaucaguuaguggagaccugauccucgagaucggcaaacuuccacaacaccugacuuuaagagcacagaacgccuuggauaaucuggugaugcuccacaacucugaacagggugggaaggcuuaccgccaugccauggaggaacugcccgacacgauugagacccuuaugcugcucgcauugauagcgguacugacaggcggagugacuuuauuuuuccuauccggcaaggggcugggaaaaaccagcaucggucuccuuugugucacagccucaagugcucuguuguggauggccagcguggagccucacuggauugcagcuuccaucauucuggaauuuuuccucaugguucugcuuauccccgagccagauaggcagcggaccccucaagacaaucagcucgccuauguggucauaggccuguuguuuaugauccugacuguagcagccaacgaaaugggguuacuagagacaacgaagaaagaucugggaauuggcuacguggcugcggagaaccaucagcacgccaccaugcucgacguugaucuucgucccgcaucugcuuggacucuguacgccguggccacaaccgucaucaccccaaugaugagacacacaauugaaaauacuacggcaaacaucagcuugaccgcuauagccaaucaagcggcuauucugaugggucucgacaagggguggccuaucuccaaaauggauauuggcgugccgcugcuugccuuaggaugcuauucacaggucaacccccugacacucacugcagccguguugaugcugguugcucauuacgcaaucauaggcccagggcuacaggccaaggcgaccagggaggcucagaagcgcacagccgcaggaaucaugaaaaauccuaccguggacggcauuguagccaucgaucuggaccccguggucuaugacgcuaaguucgaaaaacaacucggucagauuaugcuucugaucuuguguacuucucagauacugcucaugcggacgacaugggcccugugcgagaguauuaccuuagcaacugggccacuuaccacacugugggaaggaucgccuggcaaguuuuggaacacuaccaucgcuguuagcauggccaauaucuuccgagguuccuaccucgcgggcgccgggcuagcauucucucugaugaaaucauugggaggcgggagaaggggaacaggcgcucagggugagacgcugggggagaaguggaagcgccaacucaaccagcuuagcaaauccgaauuuaauaccuauaagcggaguggaauuauggagguggauagaucugaagccaaagagggccugaagcguggugaaacuacaaaacacgcagucagcaggggcaccgcuaaguugcggugguucguggagcgcaaccugguaaagcccgaggggaaagugaucgaccucggauguggccgagggggauggucauacuauugcgccggcuuaaagaaaguuacugaagugaaggguuacacaaaagggggaccgggccaugaggaaccaauaccuauggccaccuacggcuggaaucuggucaagcuucacuccgggaaagauguguuuuucaugcccccagagaagugugacacgcugcuaugcgauauuggagaaaguagccccaacccuaccaucgaggaggguagaacacucaggguccugaagaugguggaaccgugguugcggggcaaucaguuuuguauuaaaauccugaaccccuauaugccaucuguuguagagacucucgaacagaugcaacgcaagcaugggggaaugcuugugagaaauccucuguccaggaacucaacccacgagauguacugggucagcugcggcacagguaauauagugucggcgguuaacaugacuucucgaauguuacugaaccgguucaccauggcucaccguaaacccacauaugagagagacguggauuugggggcaggaacccgccaugucgccguggaaccugaggaagcuaaucucgacaucauuggccagaggaucgagaacauuaagaaugaacacaaaaguacuuggcauuacgaugaggacaacccauauaagacgugggccuaccacggcuccuaugagguaaagcccagcgggucagcauccucuauggugaauggaguuguccggcugcuaacaaaaccuugggaugugaucccaauggugacccagauugccaugacugacaccacacccuuuggucaacagagagucuucaaggaaaaaguugacacgcgcaccccgagggcuaagcgaggcacuacacagaucauggaggugaccgcgaaauggcuuuggggguuucugagccggaacaagaagccuagaauauguacuagggaagaguucacacgcaaaguacguaguaaugccgcaauuggagcuguguuugucgaugaaaaccaguggaauuccgccaaggaggcaguggaggacgaacgguucugggaucucguucacagagagagggaacugcauaaacaaggcaagugcgccaccugcguguacaacaugauggguaaacgcgagaagaaguugggggaauuuggaaaagcuaagggcagccgagccaucugguacauguggcugggcgcgcgguuccucgaguucgaggcacuuggguuuaugaaugaagaccacugguucucuagagagaacucacugaguggagucgaaggugagggcuuacauaaacugggguauaucuugagggauauuuccaagauaccaggaggcaauauguacgccgacgauacagcugguugggacacucgcaucaccgaggaugaccuccagaacgaagccaaaauuacggauaucauggagcccgaacacgcacugcuagcuaccagcauuuuuaagcuuacauaucagaauaaagugguaagaguucagcggccugccaagaacgggacugugauggacgucaucucuaggcgugaucaacgaggaucgggccaggugggcaccuacgggcugaacacauucacuaauauggaggugcagcucauacgccagauggaaucagagggaaucuuucugccaagcgaguuggaaacccccaacuuagcugagagaguccuggacuggcucgaaaagcaugguacggagcggcuuaaaaggauggccauuuccggcgacgauuguguugugaagccgaucgacgaucgcuucgcaacagcgcugaccgcccuaaaugacauggggaaaguaagaaaggauauuccucaaugggaacccaguaaaggauggaacgacuggcagcaggugccauuuugcucucaccacuuccaucagcugaucaugaaggauggccgggagauagucgugccuuguaggaaucaagacgagcucguuggucgagcucgugugagccagggggccggaugguccuugagagaaacugcaugccugggcaagucauaugcucagauguggcaacuuauguacuuucaccgccgggaucugaggcucgccgcaaacgccauuuguagugcgguccccguggacuggguaccaacaucuagaaccacuuggagcauccaugcucaccaccaguggaugaccacagaggauauguuauccguuuggaaucgcguguggaucgaagagaaccccuggauggaagacaaaacgcaugucucaagcugggaggaggugccuuaucugggcaagcgggaagaccaguggugcgggucuuugauuggacugaccgccagggcaacuugggccacaaauauacagguugcuaucaaccaagugcgaagacucauugguaaugagaacuaccuugauuacaugaccuccaugaaacgguucaagaaugaaagugacccagagggcgcccugugguga

SEQ ID NO: 13543 - RNA, 9879 nt, Artificial Sequence
  derived and/or modified CDS sequence (opt3) from DENV-1__JN819415__SS-prME
agcgugaccaugcugcucaugcuucugcccaccgccuuggcuuuccacuuaacuacgagaggaggggaaccucauaugaucgucuccaagcaggaaaggggaaaaucucuguuguuuaagaccucagccgguguuaacaugugcacacucauugccauggaccugggagaacuuugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggcuugggucucgagacuagaaccgaaacauggauguccucugagggggccuggaaacagauccagaggguggaaacuugggcucugcggcacccuggauucaccguuacagcacuguuucucgcccaugcuauuggcaccucgaucacgcagaagggcauuaucuucauauuacugaugcuugugacuccaucaauggccaugcgcugcgucgggaucggaaacagagauuuuguggaggguuugagcggcgcgacauggguagacguugugcuggagcacgggaguugugucaccacuauggcaaagaauaaacccacacuagauauugaacuccugaagaccgaggugacgaacccugccgugcuuaggaaacugugcaucgaagcuaagauuuccaauaccacaacugacucucgguguccaacccaaggagaggccacauuggucgaagaacaggaugcaaacuucguuugccgccgaacuuuuguggacagaggcugggguaauggguguggacucuucggcaaaggcagccuguuaaccugcgcuaaguuuaagugcguaacaaaacuggaggggaagaucgugcaguacgaaaaccucaaauauuccgucauagugaccguucacacuggagaucagcaucaaguggguaaugagacgacagaacacggcaccauugccacuaucacaccccaggcgccuacaucagagauucagcuuaccgacuacggggcccugacuuuggacuguaguccaaggacaggacuagauuucaacgaaaugguccugcucacgaugaaggagaaaagcuggcuggugcauaagcagugguuucuugaccugccguugcccuggaccucuggcgcauccacuucacaagagacauggaaucggcaggaucuccugguaaccuucaaaacagcucacgccaagaagcaggaaguuguggucuuagguagccaagagggggcuaugcacacugcccugaccggcgcaacggaaauccagaccaguggaacaacuaccaucuuugccggccaucuaaaaugccgucucaagauggacaaacugacacuuaaggggacuucuuaugugauguguaccggauccuucaaauuggagaaggaagucgcugagacgcagcacgguacagugcugguucaggugaaguacgagggcaccgaugcgccuugcaaaauuccauucagcacucaagacgaaaaggggguaacacagaacggacgccucauaaccgcaaaucccaucgucacugauaaagagaagccugugaacauugaaaccgagccacccuuuggcgagucguauaucguugugggugccggggaaaaagcucugaaacuuucuugguucaagaaaggcuccucaauaggaaagauguuugaggccacagcaagaggcgccaggcggauggcuauucugggggacacggccugggauuucggaaguaucgguggcgucuuuaccagcguggggaaauugguacaucagguguucggaacugcauacggcguucucuuuuccggugucucuuggacaaugaagaucgggauuggcauccuguuaaccuggcugggacuaaauagccgaucaacaagucucuccaugacuuguauugcggugggcauggugacccuguaccuuggggucaugguucaggcugacagcggaugcgugauaaacuggaaaggccgcgaauugaagugugguucugggaucuucgugacgaacgagguacacacauggaccgaacaauauaaguuucaggccgauucaccgaaaagacugagugcagccauuggaaaggcuugggaggagggcgucugcgguaucaggagcgccacucggcucgaaaauaucauguggaaacagauuuccaacgagcugaaucauauauuacuggaaaacgacaugaaguucaccgugguugugggcgacgcaaaugggauccuugcucagggcaagaagaugauucgcccucaacccauggagcacaaauacucuuggaagucguggggcaaggccaaaaucauuggggcggauauccagaacacaacuuuuauaaucgacggaccagauaccccugaaugucccgacgaucagagagccuggaauauuugggaggucgaggacuauggcuucgguaucuuuacaacgaacauuugguugaagcucagggauagcuacacccagaugugcgaccaccgucugauguccgcugcaaucaaagauucaaaggccgugcaugcugacaugggguauuggauagaaagugagaaaaaugaaacuuggaagcuagcccgggcaucuuucauugagguuaagacauguaccuggccaaaaagccacacucugugguccaacggagugcucgaaucagagaugaucauucccaagaucuacggcgguccuauaagccaacauaauuaucgaccaggcuacuucacacagaccgcggggccguggcaccugggaaaacuugaguuggauuuuaaccugugcgaaggcacgacuguagucguggacgagcacugcgggaauagaggacccucuuuaaggaccacaaccgugacuggcaagaucauucaugaaugguguugccgcuccuguacacucccuccacugcgguucagaggugaggaugggugcugguacggaauggagaucaggcccgucaaagaaaaggaggaaaaccuuguucgcaguauggugagcgccggcucuggugagguagacuccuuuucacugggcauuuugugugugaguaucaugauagaagaggucaugcgaagccgguggucgcguaagaugcucaugaccgggacacuggcuguguuccuacugcucauuaugggacagcugacuuggaaugaccuuaucagauugugcaucaugguuggcgccaacgcauccgauaggauggggaugggaaccacguaucuggcuuuaauggccacauuuaaaaugcgcccuauguucgcagugggccuccuguuucggagacuuaccucuagggagguccugcuacucacuauuggucugagcuugguggccucaguugaacugccaaacaguuuagaggaacucggggacggacuggcuaugggcaucaugaugcuuaagcuguugaccgaguuccaaccccaccagcucuggacaacucugcuaucccugaccuuuauuaaaacgacacuuucucucgauuacgcguggaagaccacugccauggcacugagcauaguguccuuguucccgcuguguuuaucaacaaccagccagaaaacuacauggcucccuguccugcuuggcaguuuugggugcaagccacugaccauguucuugaucacggaaaauaagauuuggggacgaaaaucuuggccccucaacgaggguaucauggcuauuggcaucguauccauacugcuaagcucgcugcuuaagaaugacgugccucucgccgggccccugaucgccggaggcauguugauugcuuguuauguuaucucagguucuagugcagauuuaucccuggagaaagccgcggaagugagcugggagcaggaagcugagcauucugggacuagccacaacauucucgucgaagugcaagacgauggaaccaugaagaucaaagacgaggagaaggaugacacacugaccauacuucugaaagccacauugcuagcaguauccggcguguacccaaugucaauuccugccacucuguuugucugguauuucuggcagaagaagaaacagcgcaguggcguucucugggauacccccagcccaccggaaguggagcgggcugugcuggacgaugggaucuacagaauccuucagaggggauuacugggucguucucaagucggcguggggguuuuccaggacggaguauuucauacgauguggcacgugacacgcggcgcaguccucauguaucaggguaagcgguuggaaccuuccugggccucagugaaaaaggaccugauuaguuacgggggaggcuggagauuccagggcagcuggaauacuggggaggagguucaagugauagcggucgaacccggcaagaacccaaagaaugugcagaccacacccgguaccuuuaagacuccugagggcgaaguaggggcuaucgcccucgauuucaaaccaggaaccuccggcucucccauugucaacagggaggguaagaucguggggcuguacggaaauggcguugugacaacgucgggcacuuaugucagcgcaauugcccaggcuaaagccucacaagaagggccucuuccggagaucgaggacgaaguguuuaagaaacgaaaccugaccauaauggauuugcacccaggauccgguaagacacggcgcuaccuacccgcaaucguuagagaggcuauuaagaggaaacugcggacccucaucuuagccccuacucgaguggucgcgagugaaauggccgaggcacugaagggcaugccaauuagauaucagacaaccgcugugaaaucugaacauacggggcgcgagaucguagaccuuaugugccacgccacuuucacaaugaggcugcucagccccgugcguguuccuaauuacaacaugauaauuauggaugaggcucauuuuaccgacccggcauccaucgccgcccggggauauaucucaaccagagucggcaugggugaagcugcggcaauuuucaugacugccacacccccagggucuguggaggcuuuuccucagagcaaugccgugauccaggaugaagagagggacauacccgaacgcaguuggaacuccggauacgauuggauuaccgacuucccaggcaagacagucugguuuguaccuagcaucaaaucuggcaaugauauugcaaacuguuugcgaaagaacgggaagagagugauccaacugucacggaaaacuuucgacacggaguaucagaagaccaaaaauaacgacugggauuacguugugacaacugacauauccgagaugggagccaauuucagggcugaucgcgucauugacccccguagaugccucaagccagugauccugaaagaugguccggaacggguuauccuugcgggcccuaugcccgugaccgucgccagugcagcucagaggcgcgggcgaauuggaagaaaccagaauaaggagggcgaccaauacguguauaugggucagccacuaaacaaugaugaagaccacgcccauuggacagaggcaaagaugcuguuggauaacaucaauacccccgaggggauuauaccugccuuauuugaaccagagcgggaaaagagcgcugccaucgacggcgaguacaggcugcgcggagaggcgagaaagacuuucguagagcucaugaggcggggcgaucugcccguguggcuuucguauaaaguugcaucugagggguuucaguacuccgaccgucgcuggugcuucgauggagaacgaaacaaucagguccuggaggaaaacauggacguggagauuuggacgaaggaaggugagaggaagaagcucaggccucggugguuggacgcccgcaccuauagcgauccgcuggcucuaagagaguuuaaagaguucgccgcuggcaggcggucagugaguggggaccugauccucgagaucggaaaacuuccacaacaccugacauuacgagcacagaaugccuuggauaaccuggucaugcuccacaauucugaacagggcgguaaggcuuacagacaugccauggaggaacugcccgacacuauugagacccuuaugcugcucgcauugauagcgguucugacagggggcgugaccuuauuuuuccuauccggaaaaggccuggggaagacuagcaucggacuccuuuguguaacagccucaagugcucuguuguggauggccagcguggagccucacuggauugcagcuuccaucauucuggaauuuuuccucaugguccugcuuauccccgagccagaucgccagaggacgccucaagacaaccagcucgccuaugugguuauaggucuguuguuuaugauccugaccguggcagccaacgaaaugggcuuacuagagacuacaaaacgggaucuggggauuggacaugucgcugcggagaaucaccagcacgccaccaugcucgacguagaucuucgucccgcaucugcuuggacccuguacgccguggccacaacuguuaucacgccaaugaugagacauaccauugaaaacacaacugcaaauaucagcuugaccgcuauagccaaccaagcggcuauucugaugggccucgacaaggguuggccuaucuccaaaauggauauuggggugccgcugcuugccuuaggcugcuacucacaggucaauccccugacacucaccgcagccguguugaugcuggucgcucacuaugcaaucauaggaccaggccuacaggccaaggcgacuagggaggcucagaagcgcacggccgcagggaucaugaaaaacccuacaguggacggaauuguugccaucgaucuggaccccgugguauacgacgcuaaguucgaaaaacaacucggccagauuaugcuucugaucuuguguaccucucagauacugcucaugcggacuaccugggcccugugcgagaguauuacauuagcaacugguccacuuaccacacugugggaagggucgccuggaaaguuuuggaauacgaccaucgcugugagcauggccaacaucuuccgaggcuccuaucucgcgggugccggccuagcauucucucugaugaaaucacuagggggaggcagaagggggacuggagcucagggcgagacacugggugagaaguggaagcgccaacucaaucagcuuagcaaauccgaauuuaacaccuacaagcggagugggauuauggaggucgauagaucugaagccaaagagggacugaagcguggcgaaacuacaaaacaugcaguuagcagggguaccgcuaaguugcggugguucguggagcgcaaucuggucaagcccgagggcaaagugaucgaccucggguguggacgaggcggguggucauauuacugcgccggauuaaagaaaguaacggaagugaagggcuauaccaaaggugggccgggacacgaggaaccaauaccuauggccacauacggcuggaaccugguuaaacuucauuccggcaaagauguguuuuucaugcccccagagaagugugacacucugcuaugcgauauuggggaaaguagccccaauccuaccaucgaggagggaagaacacucaggguccugaagaugguggaaccgugguugcgggguaaccaguuuuguauuaaaauccugaaucccuacaugccaucugucguggagacucucgaacagaugcaacgcaagcacggcgggaugcuuguuagaaacccucuguccagaaauucaacccacgagauguauuggguaagcugcggaacaggcaacauagugucggcggucaacaugaccucucgaauguuacugaaucgguucacuauggcucaucguaaacccacguacgagagagacguggauuugggugcagggacacgccacguugccguggaaccugaggucgcuaaccucgacaucauuggacagaggaucgaaaauauuaagaacgagcauaaaaguaccuggcacuaugaugaagacaauccauacaagacuugggccuaucacggcuccuacgaggugaagcccagcggcucagcauccucuaugguaaacggggugguucggcugcuaaccaaaccuugggaugucaucccaauggugacacagauugccaugacggacaccacucccuuuggacaacagagaguguucaaggagaaagucgacacacgcaccccgagggcuaagcgagguacuacacagaucauggaaguuaccgcgaaauggcuuuggggcuuucugagccggaauaagaagccuagaauauguacaagggaggaguucacucgcaaagugcguaguaacgccgcaauuggggcuguauuuguggaugagaaucaguggaacuccgccaaggaagcagucgaggacgagcgguucugggaucucgugcauagagaaagggagcugcacaaacaaggaaagugcgcaaccugcguuuauaauaugaugggcaaacgcgaaaagaaguugggugaguuugggaaagcuaagggaagccgagccaucugguacauguggcugggcgcgcgguuccucgaguucgaggcacuuggcuuuaugaacgaggaccauugguucucuagagaaaauucacugagugggguggagggagaagguuuacacaaacugggcuacaucuugagggauauuuccaagauaccagggggaaacauguaugccgacgauacggcuggcugggacacccgcaucacagaggaugaccuccagaaugaggccaaaauuacugauaucauggaacccgagcaugcacugcuagcuaccagcauuuuuaaacuuacauaccagaacaaagucgugagaguacagcggccugccaagaacgguacuguuauggacgugaucucuaggcgugaucaacgagggucgggacaggucggcaccuauggccugaauacguucacaaacauggaagugcagcucauacgccagauggagucagaagggaucuuucugccaagcgaguuggagacccccaauuuagcugaaagagugcuggacuggcucgagaagcacggagccgaacggcuuaaaaggauggcaauuuccggugacgauugugucguuaagccgaucgacgaucgcuucgcgacugcccugacagcucuaaacgacaugggcaaagugagaaaggauauuccucaaugggagcccaguaaaggguggaaugacuggcagcagguaccauuuugcucucaccauuuccaccagcugaucaugaaggauggacgggaaauaguggucccuuguaggaaccaagacgagcucgugggccgagcccguguuagccagggugcagggugguccuugagagagaccgcuugccugggaaagucauacgcccagauguggcaacuuauguauuuucaucgccgggaucugaggcucgcagccaaugcgauuuguagugcugugcccgucgacugggugccaacuucuagaaccacauggagcauccacgcccaccaucaguggaugacgaccgaagauauguuauccguauggaaccgcguuuggaucgaggaaaaucccuggauggaggacaaaacucacgugucaagcugggaagaggucccuuaccugggcaagcgggaggaccaguggugcggcucuuugauugggcugacagcaagggccaccugggcuacuaacauacagguggccaucaaucaaguucgaagacucauuggaaacgaaaauuaucuugauuacaugacauccaugaaacgguucaagaacgagagugacccagaaggugcacugugguga

SEQ ID NO: 13544 - RNA, 9879 nt, Artificial Sequence
  derived and/or modified CDS sequence (opt3) from DENV-1__GU131838__SS-prME
agcgugaccaugcugcucaugcuucugcccacagcauuggcuuuccacuuaacuacgaggggcggggagccucauaugaucgucuccaagcaggaaaggggaaaaucucugcuauuuaagaccucagccgguguuaauaugugcacccucauugccauggaccugggcgagcuuugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaauagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagauagugcaguacgagaaccugaaauauuccgucauugugacaguucacaccggagaccagcaucaaguggguaaugaaacuacggagcacggcacaaucgccaccauuacuccccaggcgccuaccucagaaauccagcucacagauuacggggcccuuacccuggacuguaguccaaggacuggauuggacuuuaacgagaugguccuacugacaaugaaggagaaaagcuggcucgugcauaagcagugguuccuggaucuuccgcugcccuggacgucuggcgcauccaccucacaagaaacuuggaaucggcaggacuugcucguaacauuuaaaaccgcucacgccaagaagcaggagguugugguccuggguagccaagaaggggcuaugcacacagccuuaacuggcgcaaccgagauccagacgaguggaaccacaacuauuuucgccggccaucugaaaugccgucuaaagauggauaaacucacccugaaggggaugucuuaugugauguguacaggauccuucaaacuugaaaaggaggucgcugagacucagcacgguaccguguugguucaggugaaguacgaaggcacggacgcgccuugcaaaauaccauuuagcacacaagaugagaaggggguaacccagaacggacgccugaucacugcaaaucccauugucacagacaaagaaaagccugugaacaucgagaccgagccacccuucggcgaaucguauauaguugugggugccggggagaaagcucucaagcugucuugguuuaagagaggcuccucaauuggaaaaauguucgaagccacugcaaggggcgcccggcgaauggcuauccuuggggauaccgccugggacuuuggaaguaucgguggcgucuucacaagcguggggaagcugguacaucagguguuuggaacggcauacggcguuuuguucuccggugucucuuggaccaugaaaauugggaucggcauucuccugacuugguuaggacugaauagccgcucaacaagucuauccaugaccuguauagcggugggcauggugacacucuaccugggggucaugguucaggcugauagcggaugcgugaucaacuggaagggcagagagcuuaaaugugguucugggauuuuugugacuaacgaaguacacaccuggacggagcaauauaaguuccaggccgacucaccgaagagguugagugcagccaucggaaaggcuugggaggaaggcgucugcgguauccggagcgccacacgccuggagaauauuauguggaagcagauauccaacgaacucaaucauauccuguuagagaacgauaugaaauuuaccgugguugugggcgacgcaaaugggauucuggcucagggaaagaaaaugaucagaccucaacccauggaacacaaguacucuuggaaaucguggggcaaggccaagauuaucggggcggacauacagaacacuaccuucaucauugauggaccagacacaccugagugucccgauggccagagggccuggaauaucugggaggucgaagacuaugguuuugggguguucacuaccaacauuuggcuuaaauugcgugauagcuacacacagaugugcgaccaccggcucauguccgcugcaaucaaggauucaaaagccguucaugcugacaugggauauuggauagagagugaaaagaaugagacguggaaacuggcccgagcaucuuucauugaagugaagaccuguacuuggccaaagagccacacacuaugguccaacggcguacuggagucagagaugaucauucccaaaaucuacgguggcccuauaagccaacauaauuauagaccaggguacuuuacccagacugcgggaccguggcaccucggcaagcuggaacuugauuucgacuugugcgaggggacaaccgucgugguggaugaacacugcggaaacaggggccccucucugcgcacgacuaccgucacagguaaaaucauucaugagugguguugccgguccuguaccuuaccuccacucagauuuagaggggaagacggaugcugguacggcauggaaauccgccccguuaaggagaaagaagagaaucuggugcgaaguaugguaagcgccgguucuggcgaaguggauuccuucucacuugggauucugugugucaguaucaugauagaggaggugaugcggagccguuggucgagaaagauguugaugacuggaacacucgcuguuuuucugcuacugauuaugggccagcucaccuggaacgaccugaucaggcuuugcaucauggugggggccaaugcauccgaccgcaugggaaugggcacaacuuauuuggcucugauggccaccuucaagaugcggccuauguuugcagucgguuuacucuucagaaggcugacgucucgagaagugcuucugcuaacaauugggcucagccugguugccucaguggaguugccaaacagucuggaagaguuaggagauggccucgcuaugggcaucaugaugcugaaacuucugaccgaauuucaaccccaccaguuguggacuacccuccugucccuaacauucgucaagacuacccugucucuugacuacgcguggaaaacgacagccaugguacucagcauugugucccuguuuccguugugucugucaaccacuagccagaagacaaccugguuaccuguucuccuggggaguuucggaugcaaaccacuuacuauguuucugauaacagagaacaagaucuggggucgcaagucuuggcccuugaaugagggcauuauggcaaucgggauuguguccauccuccugagcucgcuacugaaaaacgaugucccucuugcuggaccccucauagccggcgguaugcugaucgccuguuaugugauuucagggucuagugcugacuuguccuuagaaaagaccgcagagguaagcugggaacaggaggccgaacauucuggagcgagccacaauauccugguggagguccaagaugacggcacgaugaaaauuaaggaugaggaacgggacgauacucucaccauccugcuuaaagcuacacuguuggccguuuccggcguguacccaaugucaauaccugcaacccuauucgugugguauuucuggcagaagaaaaagcagagaagugggguccugugggacacacccagcccaccggagguggaaagggccguucucgaugacggaauuuaccguauccugcagcgcggucuuuuaggccggucucaaguaggggugggagucuuucaggauggcguguuccauacuauguggcacguuaccagaggugcugugcugauguaucaggggaagaggcucgagccuuccugggcaucagucaaaaaggacuugaucaguuacggaggcggcuggcgauuucaggggagcuggaacacgggagaggaagugcaaguaauugccgucgagcccgguaaaaauccaaagaacgugcagacaacucccggcaccuucaaaacaccugaaggggagguuggagcgauagcucuggacuuuaagccaggcaccuccgguucucccaucgugaaucgggaagggaagauugucggacucuacggcaacggcgugguuacuaccucggggacauaugugagcgccaucgcacaggccaaggcuucacaagagggaccucugccggagauugaagaugaggucuucaagaaacgcaaucuuacgaucauggaccugcacccagguuccggcaagacuagaagguacuugcccgccauagugcgggaagcaaucaaacgaaagcuaagaacccugauucucgcuccuacacgcguaguggccagugagauggcggaagccuuaaaggggaugccaaucagguaucagaccacugcaguuaaaucugagcauacaggacgugagauugucgaucugaugugccacgcuaccuuuacgaugcggcuucugagccccgugagagugccuaacuacaauaugaucauaauggacgaagcccauuucacugauccggcuuccauugcagccaggggcuauaucucaacacgcgucgguaugggggaggccgcugcgaucuuuaugaccgcaacacccccaggaucuguagaagccuucccucagagcaacgcugugauucaggacgaggaacgagauauccccgagagaaguuggaacuccggcuacgacuggauaacugauuuuccaggcaagacaguuugguucgugccuagcauuaaaucugggaacgacaucgccaauugucuccggaagaacggaaaaagggucauucaauugucacgcaagaccuucgauacagaguaucagaagacuaaaaacaaugacugggacuacgugguuacgaccgauaucuccgaaaugggugcaaacuuucgugccgacagagugauagauccccggaggugccugaagccagucauucucaaagacggcccggagcgcgugauccuggcugggccuaugcccguaacaguggcgagugccgcacagcgaagaggacggaucggcaggaaucagaacaaggaaggugaucaauacguuuauauggggcagccacuuaauaacgacgaggaucacgcucauuggacugaggccaaaaugcuacuggacaauauuaacacccccgaaggcaucauuccugcauuguucgagccagaacgcgagaaaagcgccgcuauagauggagaauacagauuaaggggcgaagcccggaagacauuugucgagcugaugcgucgcggggaccuccccguguggcugucguauaaaguggcgucugaaggauuccaguacuccgaucgaagauggugcuuugacggugagaggaauaaccagguccuugaagagaauauggauguugaaaucuggaccaaggagggcgagcggaaaaagcugcgcccuagauggcucgacgcaaggacuuauagcgacccguuggcccugcgggaguucaaagaguuugcugccgggcgaagaucagugaguggagaucuaauucuggaaaucggcaagcucccacaacaccuuacgcugcgcgcucagaacgcauuagacaauuugguaaugcugcacaacucugagcagggugggaaagccuacaggcaugcuauggaggaacuccccgauaccaucgagacacugaugcuucuggcccucauugcaguguugacuggcggagucacccuguucuuuuuauccggcaaggggcuaggaaagacaagcauaggucugcucugugugaccgcgucaagugcccuucuguggauggcuagcguugaaccucacuggaucgccgcauccauuaucuuggaguucuuucugauggugcuccugauucccgaaccagaccggcagcguacuccucaagauaaucagcuugcuuaugucguaaucggccuccuguucaugauauugacaguggccgcaaacgagauggggcuguuagagacgaccaaaaaggaccuaggaaucggcuacguugccgcugaaaaccaucagcacgcgacuaugcuggauguggaccuccaccccgccucugcauggacacuuuacgcugucgccaccaccgugauuacaccaaugaugagacauacuaucgagaauacgaccgccaacauuagccugacagcaaucgcuaaucaagccgcgauauugaugggucuggauaaaggguggccuauuuccaagauggacaucggcgucccgcuccuggcucuuggaugcuauucacaggugaaccccuuaacucugaccgccgcaguucucauguugguggcccacuacgcuauuaucggcccagggcugcaggcaaaagccacaagggaagcgcagaagcgcaccgcugccggaauaaugaagaauccuacuguagauggcaucguggcaauugaccuagaucccgucguuuaugacgccaaauuugagaagcaacugggucagaucaugcuccuuauucuguguacgucucagaucuugcugaugcggacaaccugggcucucugcgaaaguauaacucuggccaccgggccauuaacaacucuuugggagggaucgccuggcaaauucuggaacaccacaauugcagugagcauggcuaauaucuuccgagguuccuaccuggccggcgcggggcucgccuuuucucuaaugaagucacugggaggcgggagaaggggaacgggcgcacagggugagaccuugggggaaaaauggaagcgccaacugaaccagcucagcaaguccgaguucaauacuuauaaacggaguggaaucauggaagucgacagaucugaggcuaaggaaggccuuaaacguggugagacaaccaagcaugccgugagcaggggcacugcaaaacugcggugguuuguagagcgcaacuuggugaagcccgaagggaagguuauugaucugggauguggccgagggggauggucauacuauugcgcuggccucaaaaaggugacagaggucaaagguuacaccaaagggggaccgggccacgaggaaccaaucccuauggccacguacggcuggaauuuagugaaacugcauuccgggaaggacgucuucuuuaugcccccagaaaaaugugauacccuucugugcgacauaggagagaguagccccaacccuacaauugaggaagguagaacucuaagggugcucaagaugguugagccguggcugcggggcaaucaguucuguaucaagauuuugaaccccuauaugccaucuguaguggaaacccuggagcagaugcaacgcaaacacgggggaaugcucgucagaaauccucuuuccaggaacucaacacacgagauguacugggugagcugcggcacugguaauaucguuucggccgugaacaugaccucucgaaugcuguuaaaccgguuuacaauggcgcaucguaagcccaccuaugaaagagaugucgaccugggggcuggaacucgccacguggcaguagagccugaaguggccaauuuggauauaaucggccagaggauugagaacaucaaaaaugaacauaagaguacguggcacuacgacgaggauaacccauauaaaacaugggcuuaccacggcuccuaugagguuaagcccagcgggucagccuccucuauggucaauggaguggugcggcuccugaccaagccuugggacgucauuccaaugguuacucagaucgcaaugaccgauacaacgcccuucggucaacagagaguguuuaaagaaaagguagacacccgcacuccgagggccaaacgaggcacaacccagauuauggaggugacugcuaaguggcuauggggguuccuuagccggaacaaaaagccuagaaucuguacaagggaagaguuuacccgcaagguccguaguaaugcggccauaggagcaguguucguugacgaaaaccaguggaacuccgcuaaagaggccguggaggaugaacgguuuugggaccugguccauagagagagggaacuccacaagcaaggcaaaugcgcaacaugcguguacaacaugauggguaagcgcgagaaaaagcugggggaguucggaaaggccaaaggcagccgagcuauuugguacaugugguugggcgcccgguuccuggaguuugaggcgcucggguucaugaaugaagaucauugguuuucuagagagaacucacuuaguggaguagaaggugagggccugcacaaguuaggguauauccugagggacaucuccaaaauuccaggaggcaauauguacgcagaugacacugccgguugggauacccgcauaacggaggacgauuugcagaacgaagcuaagaucaccgacauuauggagcccgaacaugcccuccuggcaacaagcaucuucaaacuaacuuaucagaauaagguugugagaguccagcggccugcuaaaaacgggaccgugauggaugugauuucuaggcgugaccaacgaggaucgggccaggucggcacauacgggcuuaacacuuuuaccaauauggagguucagcugauccgccagauggaaucagagggaauauuccucccaagcgagcuggaaacgcccaacuuggccgagagagcuuuagauuggcuggaaaagcacggugccgagcggcucaagaggauggcaaucuccggcgacgacugugugguaaaaccgauugaugaccgcuuugcgacagcccuuaccgcucugaaugauauggggaaggugagaaaagacaucccucaaugggaacccaguaagggauggaacgauuggcagcaggucccauucugcucucaccauuuucaccagcuaauuaugaaagacggccgggagaucgugguuccuuguaggaaucaagaugagcuggugggucgagcccgugucagccagggggcaggauggucccucagagaaacugcuugcuugggcaagucauaugcccagauguggcaacugauguacuuccaucgccgggaccuuaggcuggcagccaacgcgauauguagugcugugcccguagauuggguuccaacaucuagaaccacuuggagcauucacgcccaccaucaguggaugaccacagaggacaugcucuccguguggaaucgcgucuggaucgaagagaaccccuggauggaagauaagacgcacgugucaagcugggaggagguuccuuauuuaggcaaacgggaagaccaguggugcgggucucugaucggauugaccgcaagggccacuugggcuacaaauauucagguggccauaaaccaaguccgaagacugaucgguaaugagaacuaccucgacuacaugaccuccaugaagcgguuuaaaaaugaaagugauccagagggcgcacuuugguga

SEQ ID NO: 13545 - RNA, 9879 nt, Artificial Sequence
  derived and/or modified CDS sequence (opt3) from DENV-1__GU131839__SS-prME
agcgugaccaugcugcucaugcuucugcccaccgccuuggcuuuccacuuaacuacgaggggcggggagccucauaugaucgucuccaagcaggaaaggggaaagucucugcuauuuaagaccucagcugguguuaacaugugcacacucauugccauggaccugggcgagcuuugugaagauacuaugaccuacaaaugcccacggauaaccgaggcggaaccggacgauguggacuguuggugcaaugcuaccgauacuuggguaacauaugggaccuguagucagacgggagagcaccgccgagagaagcguagcguggcccuggcaccccaugucggcuugggucucgaaacuagaaccgagacauggauguccucugaaggggccuggaaacagauccagaggguggagacuugggcucugcggcacccuggauucaccguuauugcauuuuuccuggcccaugcuaucggcacaucgauuacccagaagggcaucauauuuauccucuuaaugcuggugacgccaucaauggccaugcgcugcgucgggauuggaaacagagacuucguggagggucuuagcggcgcgacuuggguagauguuguguuggaacacgggaguugugucacaaccauggcaaagaauaaacccacucuggacaucgagcuacucaagacagaagugaccaacccugccgugcugaggaaacuuugcauugaggcuaagaucuccaauacgaccacagauucucgguguccaacucaaggagaagccacccuggucgaggagcaggacgcaaacuuuguuugccgccgaacauucguggauagaggcugggguaauggguguggauuguuuggcaaaggcagccuccugacuugcgcuaaguucaagugcguaaccaaauuagaagggaagacagugcaguacgagaaccugaaauauuccgucauagugaccguucacacuggagaccagcaucaaguggguaaugaaacgacagagcacggcaccauugccacuaucacaccccaggcgccuacaucagaaauucagcucaccgauuacggggcccuuacucuggacuguaguccaaggacaggauuggacuuuaacgagaugguccuacugacgaugaaggagaaaagcuggcucgugcauaagcagugguuccuggaucuuccgcugcccuggaccucuggcgcauccacuucacaagaaacauggaaucggcaggacuugcucguaaccuuuaaaacagcucacgccaagaagcaggagguugugguccuggguagccaagaaggggcuaugcacacugccuuaaccggcgcaacggagauccagaccaguggaacaacuaccaucuucgccggccaucugaaaugccgucuaaagauggauaaacucacacugaaggggaugucuuaugugauguguacuggauccuucaaacuugaaaaggaggucgcugagacccagcacgguacgguguugguucaggugaaguacgaaggcacagacgcgccuugcaaaauuccauuuagcacccaagaugagaaggggguaacucagaacggacgccugauaacagcaaaucccaucgucaccgacaaagaaaagccugugaacauugagacugagccacccuucggcgaaucguauaucguugugggugccggggagaaagcucucaagcugucuugguuuaagagaggcuccucaauaggaaaaauguucgaagccaccgcaaggggcgcccggcgaauggcuauucuuggggauacagccugggacuuuggaaguaucgguggcgucuucacgagcguggggaagcugguacaucagguguuuggaaccgcauacggcguuuuguucuccggugucucuuggacuaugaaaaucgggauuggcauccuccugacaugguuaggacugaauagccgcucaaccagucuauccaugacauguauugcggugggcauggugacucucuaccugggggucaugguucaggcugauagcggaugcgugauaaacuggaagggcagagagcuuaaaugugguucugggaucuuugugaccaacgaaguacacacguggacagagcaauauaaguuccaggccgacucaccgaagagguugagugcagccauuggaaaggcuugggaggaaggcgucugcgguauccggagcgccacccgccuggagaauaucauguggaagcagauuuccaacgaacucaaucauauacuguuagagaacgauaugaaauuuacugugguugugggcgacgcaaaugggauccugguccagggaaagaaaaugauuagaccucaacccauggaacacaaguacucuuggaaaucguggggcaaggcuaagaucauuggggccgacacccagaacacaacuuucaucauagauggaccagacaccccugagugucccgauggccagagggcguggaauaucugggagguggaagacuaugguuuugggguuuucacaacgaacauuuggcuuaaauugcgugauagcuacacccagaugugcgaccaccggcucauguccgccgcuaucaaggauucaaaagcagugcaugccgacaugggauauuggauugagagugaaaagaaugagacuuggaaacuggcucgagccucuuucaucgaaguaaagacauguaccuggccaaagagccacacucuaugguccaacggcguccuggagucagagaugauaauucccaaaaucuacgguggcccuauuagccaacauaauuauagaccaggguacuuuacacagaccgcaggaccguggcaccucggcaagcuggaacuugauuucgacuugugcgaggggacgacugugguggucgaugaacacugcggaaacaggggccccucucugcgcaccacaaccguuacugguaaaaucauacaugagugguguugccgguccuguacauuaccuccacucagauuuagaggggaagacggaugcugguacggcauggaaauccgccccgugaaggagaaagaagagaaucugguacgaaguauggugagcgcggguucuggcgaagucgauuccuucucacuugggauucugugugugaguaucaugauugaggagguuaugcggagccguuggucgagaaagauguugaugaccggaacacucgccguguuucugcuacugaucaugggccagcucacuuggaacgaccugauaaggcuuugcauuauggucggggcuaaugccuccgaccgcaugggaaugggcaccacguauuuggcacugauggcuacauucaagaugcggccuauguuugccguggguuuacucuucagaaggcugaccucucgagaaguucuucugcuaacuaucgggcucagccugguggcaucagucgaguugccaaacagucuggaagaguuaggagauggccucgccaugggcaucaugaugcugaaacuucugaccgaauuucaaccccaccaguuguggacaacucuccugucccuaaccuucguaaagacggcucugucucuugacuacgcguggaaaacaaccgccauggugcucagcauuguuucccuguuuccguugugucugucaacuacaagccagaagaccacuugguuaccugugcuccuggggaguuucggaugcaaaccacuuacaauguuucugaucaccgagaacaagauuuggggucgcaagucuuggcccuugaaugagggcauaauggcaaucgggauugucuccauccuccugagcucgcuacugaaaaacgaugugccucuugcuggaccccucauugccggcgguaugcugaucgccuguuauguaauaucagggucuagugcugacuuguccuuagaaaaggcagccgaggugagcugggaacaggaggcggaacauucuggagcuagccacaauauccuggucgagguucaagaugacggcacgaugaaaauuaaggaugaggaacgggacgauacucucaccauccugcuuaaagccacacuguuggcaguguccggcguguacccaaugucaauuccugccacccuauucgucugguauuucuggcagaagaaaaagcagagaaguggggugcugugggacacacccagcccaccggagguugaaagggcuguacucgauaacggaaucuaccguauacugcagcgcggucuuuuaggccggucucaagugggggucggaguguuucaggacggcguuuuccauacuauguggcacgugaccagaggugcaguccugauguaucaggggaagaggcucgagccuuccugggccucagugaaaaaggauuugauuaguuacggaggcggcuggcgauuucaggggagcuggaauacgggagaggaaguacaagucaucgcgguggagcccgguaaaaacccaaagaauguucagacaacucccggcaccuucaaaacaccugaaggggaggugggagcuaucgcccuggacuuuaagccaggcaccuccgguucucccauugucaaccgggaagggaagauagugggacucuacggcaauggcguugugacuaccucggggacauaugucagcgcaaucgcccaggcuaaagccucacaagagggaccucugccggagauugaagacgagguguucaagaaacgcaaccuuacgaucauggaucugcacccagguuccggcaagacuagaagguacuugcccgcaauuguacgggaagcuaucaaacgaaagcuaagaacccugauacucgccccuacacgcgugguugcgagugagauggccgaagcauuaaaggggaugccaaucagguaucagaccacugcugucaaaucugagcauacaggacgugagauuguggaccugaugugccacgccaccuuuacgaugcggcuucugagccccgugagagucccuaauuacaacaugaucauuauggaugaagcucauuucacugacccggcauccaucgccgccaggggcuauauaucaacacgcguagguaugggggaggcugcggcaauuuuuaugaccgccacacccccaggaucuguggaggcuuucccucagagcaaugccguuauccaggaugaggaacgagacauccccgagagaaguuggaacuccggcuacgauuggauuacugacuuuccaggcaagacagugugguucgucccuagcaucaaaucugggaaugauauagcaaacugucuccggaagaacggaaaaagggugauucaauugucacgcaagaccuucgacacagaguaucagaagacuaaaaauaacgauugggacuacguugugacgaccgacaucuccgaaaugggugccaauuuucgugcugauagagucauugacccccggaggugccugaagccagugauccucaaagauggcccggagcgcguaauacuggcggggccuaugcccgugacaguugccagugcagcucagcgaagaggacggauuggcaggaaccagaauaaggaaggugaccaauacgucuauauggggcagccacuuaacaaugaugaggaccacgcccauuggacugaggcaaaaaugcuacuggauaacaucaauacccccgaaggcaucauuccugccuuguucgagccagaacgcgagaaaagcgcugccaucgacggagaauacagauuaaggggcgaagcgcggaagacauuuguggagcugaugcgucgcggggaucuccccguguggcugucguauaaagucgcaucugaaggauuccaguacuccgaccgaagauggugcuuugauggugagaggaacaaucagguucuugaagagaacauggacguggaaauuuggaccaaggagggcgagcggaaaaagcugcgcccuagauggcucgaugccaggacuuauagcgacccguuggcucugcgggaguucaaagaguuugccgcugggcgaagaucaguaaguggagaccuaauacuggaaaucggcaagcucccacaacaccuuacgcugcgcgcacagaaugccuuagauaacuuggugaugcugcacaauucugagcagggugggaaggcuuacaggcaugccauggaagaacuccccgacaccauugagacacugaugcuucuggcacucaucgcggucuugacuggcggagugacccuguucuuuuuauccggcaaggggcuaggaaagacaagcaucggucugcucuguguuaccgccucaagugcacuucuguggauggccagcguggaaccucacuggauugcagcuuccauaaucuuggaguucuuucugaugguccuccugauucccgaaccagaucggcagcguacuccucaagacaaccagcuugccuauguagugaucggccuccuguucaugauuuugacaguugcagccaacgagauggggcuguuagagacgaccaaaaaggaucuaggaaucggcuacguggcugcggaaaaucaucagcacgccacuaugcuggacgucgaucuccaccccgcaucugcuuggacacuuuacgccguggccaccaccgucauaacaccaaugaugagacauacuaucgagaacacgaccgcaaauauuagccugacagcuaucgccaaccaagcggcuauuuugaugggucuggacaaaggguggccuaucuccaagauggauauaggcgugccgcuccuggcccuuggaugcuauucacagguuaaucccuuaacucugaccucugcagugcucauguugguagcccacuacgcuauuaucggcccagggcugcaggcaaaagccacaagggaagcgcagaagcgcaccgcugccggaauuaugaagaacccuacuguggacggcaucgucgcaauagaucuagaccccguuguguaugaugccaaauuugagaagcaacugggucagaucaugcuccuuauucuguguacgagucagaucuugcugaugcggacaaccugggcucucugcgaaucgauuacucuggccaccgggccauuaacaacucuuugggagggaagcccuggcaaauucuggaauaccacaaucgcagucuccauggcuaacauauuccgagguucuuaccuggccggcgcggggcucgccuuuucacuaaugaaaagccugggaggcgggagaaggggaacgggcgcacagggugagaccuugggggaaaaauggaagcgccaacugaaucagcucuccaagagugaguucaacacuuauaaacggucuggaauuauggaaguggacagaagcgaggcuaaggaaggccuuaaacguggugagacaaccaagcaugccguaucaaggggcacugcaaaacugcggugguuuguggagcgcaauuugguuaagcccgaagggaaggugaucgaccugggauguggccgagggggaugguccuacuauugcgcuggccucaaaaaggucacagaggugaaagguuacaccaaagggggaccgggccacgaggaaccaaucccuauggccacguacggcuggaacuuagucaaacugcauagugggaaggauguguucuuuaugcccccagaaaaaugugacacccuucugugcgauauuggagagagcucucccaauccuacaaucgaggaagguagaacucuaaggguucucaagaugguagagccguggcugcggggcaaccaguucuguauaaagauuuugaaucccuauaugccauccguggucgaaacccuggagcagaugcaacgcaaacacgggggaaugcucgugagaaacccucuuucaaggaauagcacacacgagauguacuggguuucgugcggcacugguaacaucgugucugccgucaacaugaccagucgaaugcuguuaaaucgguuuacaauggcgcaucguaagcccaccuaugaaagagacguggaucugggggcuggaacucgccacguagcaguggagccugaaguugccaacuuggacauuaucggccagaggauagagaauaucaaaaacgaacauaaguccacguggcacuacgaugaggacaauccauauaaaacaugggcuuaccacggcagcuaugaggucaagcccucaggguccgccucuagcauggugaacggagugguccggcuccugaccaagccuugggauguuauuccaauggugacucagaucgcaaugaccgacacaacgcccuucggucaacagagaguauuucgcgaaaaaguggauaccaggacuccgcgagccaagcggggcacaacccagauuauggaggucacugcuaaauggcuauggggguuccuuaguagaaauaagaaaccuaggaucuguacacgcgaagaguuuacccguaaggugcgguccaacgcggccauuggagcaguuuucguggacgaaaaucaguggaacagcgcuaaggaggccgucgaggacgaaagauuuugggaucuggugcauagggagcgcgaacuccacaaacaaggcaagugcgcaacaugcguauacaauaugauggguaaacgagagaagaaacugggggaguucggaaaggccaagggcucucgggcuaucugguacaugugguugggcgccagauuccuggaguuugaggcgcucggguucaugaacgaagaccauugguuuucaagggagaauagucuuuccggaguugaaggugagggccugcacaaauuaggguauauacugcgcgauauuagcaagaucccaggaggcaacguguacgcagacgauacugccgguugggacaccagaaucacggaggaugacuugcagaaugaagcuaaaauuaccgauauaauggagcccgaacaugcccuccuggcaacaucuaucuucaagcuaacuuaucagaacaaagucgugcgggugcagaggccugcuaagaacgggaccgucauggacguuauuucgcgucgagaucaacgcggaucaggccaggugggcacauacgggcuuaauacuuuuaccaacauggagguacagcugaucagacagauggaaagcgagggaauuuuccucccauccgagcuggaaacgcccaauuuggccgagcgggcuuuagacuggcuggaaaaacacgguguggagaggcucaagcgcauggccaucaguggcgaugacugugucgugaagccgauagacgauagauuugcaacagcgcuuaccgcccugaacgacauggggaaaguucggaaggauaucccucaaugggaacccucuaaaggauggaaugacuggcaacaggugccauucugcagccaccauuuucaccagcuaauuaugaaggauggcagggagaucgucgugccuugucgaaaccaagacgagcugguaggucgugcuagaguuucccagggggccggauggucacuccgcgaaacugcaugcuugggcaaaaguuaugcucagauguggcaacugauguacuuccaucggagggaucuuagacuggccgcaaaugccauuuguucugcggugcccgucgacugggugccaacaagccgcaccacuugguccauccacgcucaccaucaguggaugaccacagaggauaugcucucaguuuggaaccggguguggauagaagagaaucccuggauggaagacaagacgcacgucagcucuugggaggaggugccuuauuuaggcaagagggaagaucaguggugcgggucccugauuggauugaccgcccgagcaacuugggccacaaacauccagguagcuaucaaucaagugagacggcugauugguaacgagaauuaccucgacuacaugaccaguaugaaaagguuuaagaacgaaagcgacucggagggcgcccuuugguga

SEQ ID NO: 13546 - RNA, 9879 nt, Artificial Sequence
  derived and/or modified CDS sequence (opt3) from DENV-1__GU131841__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagagaagcguagcgucgcucuggccccccaugugggcuugggucucgaaacuagaaccgagacauggauguccucugaaggggcauggaaacagauccagaggguugagacuugggcccugcggcacccuggauucaccgugauugcuuuuuuccuggcauacgccaucggcacaucgauuacccagaagggcaucauauuuauccucuuaaugcuggucacgccaucaauggcuaugcgcugcguggggauuggaaacagagacuucguagagggucuuagcggcgccacuuggguugauguggucuuggaacaugggaguugugugacaaccauggcgaagaauaaacccacucuggacaucgagcuacucaagacagaagugaccaacccugcaguccugaggaaacuuugcauugaggccaagaucuccaauacgaccacagauucucgguguccaacucaaggagaagcuacccugguugaggagcaggacgccaacuuugugugccgccgaacauucguagauagaggcugggguaauggguguggauuguuuggcaaaggcagccuccugacuugcgcaaaguucaagugcgugaccaaauuagaagggaagauaguccaguaugagaaccugaaauacuccgugauuguuacagugcacaccggagaccagcaccaagucgguaaugaaacuacggagcauggcacaaucgcuaccauuacuccccaggccccuaccucagaaauccagcucacagauuauggggcgcuuacccuggacuguaguccaaggacuggauuggacuuuaacgagauggugcuacugacaaugaaggagaaaagcuggcucguacacaagcagugguuccuggaucuuccgcugcccuggacgucuggcgccuccaccucacaagaaacuuggaaucggcaggacuugcucguuacauuuaaaaccgcacaugcuaagaagcaggagguggucgugcuggguagccaagaaggggccaugcacacagcuuuaacuggcgccaccgagauccagacgaguggaaccacaacuauuuucgcaggccaccugaaaugccgucuaaagauggauaaacucacccugaaggggaugucuuacgucauguguacaggauccuucaaacuugaaaaggagguggccgagacucagcaugguaccguuuuggugcagguaaaguaugaaggcacggacgcuccuugcaaaauaccauuuagcacacaagaugagaagggggucacccagaacggacgccugaucacugcgaaucccauugugacagacaaagaaaagccuguuaacaucgagaccgagccacccuucggcgaaucguacauaguggucggugcaggggagaaagcccucaagcugucuugguuuaagagaggcuccucaauuggaaaaauguucgaagcuacugccaggggcgcacggcgaauggccauccuuggggauaccgcuugggacuuuggaaguaucgguggcguguucacaagcguagggaagcuggugcaccagguuuuuggaacggccuacggcgucuuguucuccggugugucuuggaccaugaaaauugggaucggcauucuccugacuugguuaggacugaauagccgcucaacaagucuauccaugaccuguauagcagugggcauggucacacucuaucuggggguuauggugcaggcggauagcggaugcgugaucaacuggaagggcagagagcuuaaaugugguucugggauuuuuguaacuaacgaaguccauaccuggacggagcaauacaaguuccaggcugacucaccgaagagguugagugccgcaaucggaaaagccugggaggaaggcgugugcgguauccggagcgcuacacgccuggagaauauuauguggaagcagauauccaacgaacucaaucacauccuguuagagaacgauaugaaauuuaccguuguggucggcgacgccaaugggauucuggcacagggaaagaaaaugaucagaccucaacccauggaacauaaguauucuuggaaaucguggggcaaggcuaagauuaucggggccgacauacagaacacuaccuucaucauugauggaccagacacaccugagugucccgauggccagagggcguggaauaucugggagguggaagacuacgguuuugggguuuucacuaccaacauuuggcuuaaauugcgugauagcuauacacagaugugcgaccaccggcucauguccgccgcuaucaaggauucaaaagcagugcacgccgacaugggauacuggauagagagugaaaagaaugagacguggaaacuggcucgagccucuuucauugaaguaaagaccuguacuuggccaaagagccauacacuaugguccaacggcguccuggagucagagaugaucauucccaaaaucuaugguggcccuauaagccaacacaauuacagaccaggguacuuuacccagacugcaggaccguggcaucucggcaagcuggaacuugauuucgacuugugcgaggggacaaccgugguggucgaugaacacugcggaaacaggggccccucucugcgcacgacuaccguuacagguaaaaucauucacgagugguguugccgguccuguaccuuaccuccacucagauuuaggggggaggacggaugcugguauggcauggaaauccgccccgugaaggagaaagaagagaaucugguacgaaguauggugagcgcggguucuggcgaagucgauuccuucucacuugggauucugugugugaguaucaugauagaggagguuaugcggagccguuggucgagaaagauguugaugacuggaacacucgccguguuucugcuacugauuaugggccagcucaccuggaacgaccugaucaggcuuugcaucauggucggggcuaaugccuccgaccgcaugggaaugggcacaacuuacuuggcacugauggcuaccuucaagaugcggccuauguuugccguggguuuacucuucagaaggcugacgucucgagaaguucuucugcuaacaauugggcucagccugguggcaucagucgaguugccaaacagucuggaagaguuaggagauggccucgccaugggcaucaugaugcugaaacuucugaccgaauuucaaccccaucaguuguggacuacccuccugucccuaacauucguaaagacuacccugucucuugacuaugcuuggaaaacgacagcgauggugcucagcauuguuucccuguuuccguugugucugucaaccacuagccagaagacaaccugguuaccugugcuccuggggaguuucggaugcaaaccacuuacuauguuucugauaacagagaacaagaucuggggucgcaagucuuggcccuugaaugagggcauuauggccaucgggauugucuccauccuccugagcucgcuacugaaaaacgaugugccucuugcaggaccccucauagcuggcgguaugcugaucgccuguuacguaauuucagggucuagugccgacuuguccuuagaaaaggcugcagaggugagcugggaacaggaggccgaacacucuggagcgagccauaauauccuggucgagguucaagaugacggcaccaugaaaauuaaggaugaggaacgggacgauacgcucacuauccugcuuaaagcuacccuguuggccguguccggcguguauccaaugucaauaccugcaacacuauucgucugguacuucuggcagaagaaaaagcagagaaguggggugcugugggacacccccagcccaccggagguugaaagggccguacucgaugacggaauuuaucguauccugcagcgcggucuuuuaggccggucucaagugggggucggaguguuucaggauggcguuuuccacacaauguggcaugugacuagaggugcuguccugauguaccaggggaagaggcucgagccuuccugggcaucagugaaaaaggacuugaucaguuacggaggcggcuggcgauuucaggggagcuggaacaccggagaggaaguacaagucauugccguggagcccgguaaaaauccaaagaacguucagacgacacccggcacuuucaaaaccccugaaggggaggugggagcgauagcucuggacuuuaagccaggcacauccgguucucccaucgucaaucgggaagggaagauugugggacucuauggcaacggcguugugaccacuucggggaccuacgucagcgccaucgcacaggccaaagcuucacaagagggaccucugccggagauugaagaugagguguucaagaaacgcaaucuuacaaucauggaccugcacccagguuccggcaagacgagaagguauuugcccgccauaguacgggaagcaaucaaacgaaagcuaagaacucugauucucgcuccuacccgcgugguugccagugagauggcggaagccuuaaaggggaugccaaucagguaccagacaaccgcagucaaaucugagcacacuggacgugagauuguggaucugaugugccaugcuacauuuaccaugcggcuucugagccccgugagagucccuaacuauaauaugaucauaauggacgaagcccacuucacggauccggcuuccauugcagccaggggcuacaucucaacucgcguagguaugggggaggccgcugcgaucuuuaugacagcaacccccccaggaucuguggaagccuucccucagagcaacgcuguuauucaggacgaggaacgagauauccccgagagaaguuggaauuccggcuaugacuggauaaccgauuuuccaggcaagacugugugguucgucccuagcauuaaaucugggaacgacaucgccaauugucuccggaagaacggaaaaagggugauucaauugucacgcaagacauucgauaccgaguaccagaagacaaaaaacaaugacugggacuacguugugacuacggauaucuccgaaaugggugcaaacuuucgugccgacagagucauagauccccggaggugccugaagccagugauucucaaagacggcccggagcgcguaauccuggcugggccuaugcccgugaccguugcgagugccgcacagcgaagaggacggaucggcaggaaucagaacaaggaaggugaucaauaugucuacauggggcagccacuuaauaacgacgaggaucaugcucacuggacagaggccaaaaugcuacuggacaauauuaacacucccgaaggcaucauuccugcauuguucgagccagaacgcgagaagagcgccgcuauagauggagaauauagauuaaggggcgaggcccggaagaccuuuguggagcugaugcgucgcggggaccuccccguguggcugucguacaaagucgcgucugaaggauuccaguauuccgaucgaagauggugcuuugacggugagaggaauaaccagguucuugaagagaauauggauguggaaaucuggacaaaggagggcgagcggaaaaagcugcgcccuagauggcucgacgcaaggaccuacagcgacccguuggcccugcgggaauucaaagaguuugcugccgggcgaagaucaguaaguggagaucuaauucuggaaaucggcaagcucccacaacaucuuacucugcgcgcucagaacgcauuagacaauuuggugaugcugcacaacucugagcagggugggaaagccuauaggcacgcuauggaagagcuccccgauacgaucgagacccugaugcuucuggcccucauugcagucuugacaggcggagugacucuguucuuuuuauccggcaaggggcuaggaaagaccagcauaggucugcucuguguuacagcgucaagugcccuucuguggauggcuagcguggaaccucauuggaucgccgcauccauuaucuuggaguucuuucugaugguccuccugauucccgaaccagaccggcagcguaccccucaagauaaucagcuugcuuacguagugaucggccuccuguucaugauauugacuguugccgcaaacgagauggggcuguuagagacaacgaaaaaggaccuaggaaucggcuacguggccgcugaaaaccaccagcaugcgaccaugcuggaugucgaccuccaccccgccucugcauggacucuuuaugcuguggccacaaccgucauuaccccaaugaugagacacacaaucgagaauacuacggccaacauuagccugaccgcaaucgcuaaucaagccgcgauauugaugggucuggauaaaggguggccuauuuccaagauggacaucggcgugccgcuccuggcucuuggaugcuacucacagguuaaccccuuaacacugacugccgcagugcucauguugguagcccauuaugcuauuaucggcccagggcugcaggcaaaagccaccagggaagcgcagaagcgcacagcugccggaauaaugaagaauccuaccguggauggcaucgucgcaauugaccuagaucccguuguguacgacgccaaauuugagaagcaacugggucagaucaugcuccuuauucuguguacuucucagaucuugcugaugcggacgacaugggcucucugcgaaaguauaacccuggccacugggccauuaaccacacuuugggagggaucgccuggcaaauucuggaacacuaccauugcagucagcauggcuaauaucuuccgagguuccuaucuggccggcgcggggcucgccuuuucucuaaugaagucacugggaggcgggagaaggggaacaggcgcacagggugagacguugggggaaaaauggaagcgccaacugaaccagcucagcaaguccgaguucaauaccuacaaacggaguggaaucauggaaguggacagaucugaggcuaaggaaggccuuaaacguggugagacuacaaagcacgccguaagcaggggcaccgcaaaacugcggugguuuguggagcgcaacuugguuaagcccgaagggaaggugauugaucugggauguggccgagggggauggucauauuacugcgcuggccucaaaaaggucacugaggugaaagguuacacaaaggggggaccgggccaugaagagccaaucccuauggccaccuauggcuggaauuuagucaaacugcacuccgggaaggacguguucuuuaugcccccagaaaaaugugauacgcuucugugcgacauaggagagaguagccccaacccuaccauugaggaagguagaacacuaaggguucucaagaugguagagccguggcugcggggcaaucaguucuguaucaagauuuugaaccccuacaugccaucuguggucgaaacucuggagcagaugcaacgcaaacaugggggaaugcucgugagaaauccucuuuccaggaacucaacccacgagauguauuggguuagcugcggcacagguaauaucgugucggccgucaacaugacuucucgaaugcuguuaaaccgguuuaccauggcgcaccguaagcccacauacgaaagagauguggaccugggggcuggaacccgccauguagcaguggagccugaaguugccaauuuggauauaaucggccagaggauugagaacaucaaaaaugaacacaagaguacuuggcauuaugacgaggauaacccauacaaaacgugggcuuaucacggcuccuacgaggucaagcccagcgggucagccuccucuauggugaauggagugguccggcuccugacaaagccuugggacguuauuccaauggugacccagaucgcaaugacugauaccacacccuucggucaacagagaguauuuaaagaaaagguggacacgcgcaccccgagggccaaacgaggcacuacacagauuauggaggucaccgcuaaguggcuauggggguuccuuagccggaacaaaaagccuagaaucuguacuagggaagaguuuacacgcaaggugcguaguaaugcggccauaggagcaguuuucguggacgaaaaccaguggaauuccgcuaaagaggccgucgaggaugaacgguuuugggaccuggugcacagagagagggaacuccauaagcaaggcaaaugcgcaaccugcguauacaacaugauggguaagcgcgagaaaaagcugggggaauucggaaaggccaaaggcagccgagcuauuugguauaugugguugggcgcccgguuccuggaguuugaggcgcucggguucaugaaugaagaucacugguuuucuagagagaacucacuuaguggaguugaaggugagggccugcauaaguuaggguacauccugagggacaucuccaaaauuccaggaggcaauauguaugcagaugacacagccgguugggauacucgcauaaccgaggacgauuugcagaacgaagcuaagaucacggacauuauggagcccgaacacgcccuccuggcaaccagcaucuucaaacuaacauaccagaauaagguggucagagugcagcggccugcuaaaaacgggacugugauggaugucauuucuaggcgugaccaacgaggaucgggccagguuggcaccuaugggcuuaacacauuuacuaauauggaggugcagcugauccgccagauggaaucagagggaauauuccucccaagcgagcuggaaacccccaacuuggccgagagagcuuuagauuggcuggaaaagcauggugccgagcggcucaagaggauggcaaucuccggcgacgacuguguagugaaaccgauugaugaccgcuuugcgacggcccuuacagcucugaaugauauggggaaggucagaaaagacaucccucaaugggaacccaguaagggauggaacgauuggcagcaggugccauucugcucucaccacuuucaucagcuaauuaugaaagacggccgggagaucguugugccuuguaggaaucaagaugagcuggucggucgagcccgugugagccagggggcaggauggucccucagagaaaccgcuugcuugggcaagucauacgcccagauguggcaacugauguauuuccaccgccgggaccuuaggcuggcagccaacgcgauauguagugcuguacccguugauugggugccaacuucuagaacaaccuggagcauucaugcccaccaccaguggaugacuaccgaggacaugcucuccgucuggaaucgcguguggaucgaagagaaccccuggauggaagauaagacacauguuucaagcugggaggaggugccuuacuuaggcaaacgggaagaccaguggugcgggucucugaucggauugacggcaagggccaccugggcuacuaauauucaggucgccauaaaccaagugcgaagacugaucgguaaugagaacuaccucgacuauaugacauccaugaagcgguuuaaaaaugaaagugauccagagggcgcacuuugguga

SEQ ID NO: 13547 - RNA, 9879 nt, Artificial Sequence
  derived and/or modified CDS sequence (opt3) from DENV-1__GQ868601__SS-prME
agcgugaccaugcugcucaugcuucugcccacagccuuggcuuuccacuuaacuacgagaggcggggagccucauaugaucgucuccaagcaggaaaggggaaaaucucugcuauuuaagaccucaguuggugugaacaugugcacacucauugcaauggaccugggcgagcuuugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggccccccaugugggcuugggucucgagacuagaaccgaaacauggauguccucugagggggcauggaaacagauccagaagguugaaacuugggcccugaggcacccuggauucaccgugauugcucuguuucucgcacaugccaucggcacaucgauuacccagaagggcaucauauucaucuuacugaugcuugucacgccaucaauggcuaugcggugcguggggauuggaaaccgcgauuuuguagaggguuugagcggcgccacuuggguugacgugguccuggagcacgggaguugugugacaaccauggcgaaaaauaagcccacucuagauaucgaacuccugaaaacagaggugaccaacccugcaguccuuagaaagcugugcauugaagccaaaaucuccaauacgaccacagacucuagguguccaacucaaggagaggcuaccuugguugaagagcaggaugccaacuucgugugccggcgcacauuuguagaccgaggcugggguaauggguguggacucuucggcaagggcagccuguuaacuugcgcaaaguuuaaaugcgugaccagacuggaggggaagauaguccaguacgaaaaccucaaauauuccgugauuguuacagugcacaccggagaucagcaucaagucgguaaugagacuacggaacacggcacaaucgcuaccauuacuccccaggccccuaccucagagauccagcuuacagacuacggggcgcugaccuuggacuguaguccaaggacuggacuagauuucaacgaaauggugcugcucacaaugaaggagaaaagcuggcugguacauaagcagugguuucuugaccugccguugcccuggacgucuggcgccuccaccucacaagagacuuggaaucggcaggaucuccugguuacauucaaaaccgcacacgcuaagaagcaggaaguggucguguuagguagccaagagggggccaugcacacagcucugacuggcgccaccgaaauccagacgaguggaaccacaacuauuuuugcaggccaucuaaaaugccgucucaagauggacaaacugacccuuaaggggaugucuuaugucauguguacaggauccuucaaauuggagaaggaaguggccgagacucagcacgguaccguucuggugcagguaaaguacgagggcacggaugcuccuugcaaaauaccauuccucacacaagacgaaaagggggucacccagaacggacgccugaucacugcgaaucccauugugacagauaaagagaagccuguuaacaucgaaaccgagccacccuuuggcgagagcuauauaguggucggugcaggggaaaaagcccuuaagcugucgugguucaagaaaggcucuuccauuggaaagauguuugaggcuacugccagaggcgcaaggcggauggccaucuugggggacaccgcuugggauuucggaucaaucgguggccucuuuacaaguguggggaaacugauucaucagguauucggaacggccuacggcguguuauuuagcgguguuuccuggaccaugaagaucgggauuggcauacugcuaacuuggcucggacugaauucucgaagcacaucacuuaguaugaccuguaucgcagucggcauggugacauuguaccugggggugaugguccaggcggacuccggaugcguuauuaacuggaaaggccgcgaacucaagugugguagcgggaucuucgugacuaacgaggugcacaccuggacggaacaauauaaguuucaggcugauucuccgaaaagacugucagccgcaaucggaaaggccugggaggagggcguaugcgguauuaggagugcuacacgguuagaaaauauaauguggaaacagaucagcaacgagcugaauuacauucuuuuggaaaacgacaugaaguucaccgucgugguuggcgacgccaaugggauccucgcacagggaaaaaagaugauucgcccucaacccauggagcauaaauauuccuggaagucuuggggcaaggcuaaaaucauaggggccgauauccagaacacuaccuuuauuaucgacggaccagauacaccugaaugucccgacgaucagagagcguggaauauuugggagguggaggacuacggcuucgguaucuuuacuaccaacauauggcugaagcuaagggauucguauacacagaugugcgaccaccgucugaugagcgccgcuauuaaagauuccaaggcaguccacgccgacaugggguacuggaucgaaucagagaaaaaugaaacguggaagcucgcucgggccaguuucauugaggugaagaccuguaucuggccaaaaucucauacucuguggagcaacggaguucuugaauccgagaugauaauccccaagauuuauggcgguccuaucucacaacacaauuaccgaccaggcuacuucacacagaccgcagggccguggcauuugggaaaacuggaguuagauuuugaccucugcgaaggcacuacagugguagucgaugagcacugcggguauagaggacccagccugaggaccacgacugugaccggcaagauuauccacgaaugguguugccgcucuuguacacuuccuccacugcgguucagaggugaggacgggugcugguacggaauggagauaaggcccgugaaagaaaaggaggaaaacuugguccgcuccaugguuagugcgggcagcggugagguggacucuuuuucccucggcauucuguguguaucaauccuaaucgaagaggugaugcgaagucgguggagccguagaaugcugaugaccgggacucucgccgucuuccugcuuuugauuaugggacagcugacauggaaugauuuaaucaggcucugcauuauggugggcgcuaacgccucggaccgcauggggaugggaaccacauaucuggcacuuauggcuacuuuuaagaugcggccuauguucgccguuggccugcuauuuagaaggcucaccucccgagaggugcuguugcugacgauagguuuaucucucgucgcaagcguggaacugccaaauucacuugaggaacugggggauggauuggccaugggcaucaugaugcucaaacugcuaacagacuuccaaccccaucagcuguggaccacucuucucagucugaccuuuauucgcacaacuuugucccuggauuacgcuuggaagaccauggcgauggccuuaucuaucguuagccucuucccgcugugucuuuccacgacaucacagaaaaccacuuggcugccuguguugcucggcagcuuugggugcaagccacugacaauguuccuaauuaccgagaacaaaaucuggggacggaagaguuggcccauaaacgaagguaucauggcagucggcauuguaucuauccugcuuuccagccuccugaagaaugacgugccuuuggcugggcccuuaauugccggaggcaugcugaucgccuguuauguuauaucggguucaucugcugaucucagucuggagaaagcagccgagguguccugggaagaggaagcggagcacagcgggacuucucauaacauucuugucgaagugcaggacgauggaacaaugaagaucaaagacgaggagagagaugacacccugacgaucuugcuaaaggcuacucugcucgccguaagcggcguguacccaauguccauuccugcaacccuguuugucugguauuucuggcaaaaaaagaaacagaggucaggcguucuuugggauacacccaguccaccggaaguggagcgugccguguuagacgacgggauauaccgcauccugcagcggggacucuuggguagaagccaggucggcguggggguuuuccaagauggaguauuucacaccauguggcaugugacaaggggcgcuguccugauguaccaggguaagcgacucgaaccuucuugggcauccgugaagaaagaccugauuucauaugggggaggcuggcgguuccagggcaguuggaauacuggggaggagguucaggugaucgccgucgaacccggaaagaacccaaaaaaugugcaaaccacgcccgguacauuuaagacuccugagggcgaaguaggggcgauugcucuugauuucaaaccaggaaccagcggcucccccaucgucaaccgcgaggguaagauaguggggcuguacggaaauggcguugugacaaccucuggcacuuaugucucggccaucgcacaggccaaggcuagccaggaagggccuuugccggagauugaggacgaaguguuuaaaaagagaaaccuaaccaucauggaucugcacccaggaucagguaaaacaaggcgguaccuccccgccauuguucgagaggcaaucaagagaaaauuacgcacgcugauacuugcuccuacuaggguggucgccuccgaaauggcggaggcccugaagggcaugccaauucguuaucaaaccacagcagugaagagugaacacaccgggcgggagaucguagaccucaugugccaugcuacuuucacaaugagauugcugucucccgugaggguuccuaauuacaacaugaucauuauggaugaggcccacuuuaccgacccggcuagcaucgcagcccgcggauauauauccacgcgagucggcaugggugaagccgcugcgauuuucaugacugcaacacccccagggucaguggaggccuuuccucagucuaaugcugugauccaggaugaagagagagacauucccgaacggagcuggaacaguggauacgauuggaucaccgacuucccaggcaaaaccgucugguuuguaccuuccauaaagagcggcaaugacauugccaacugucucaggaaaaaugggaagcgcgugauccagcugucucguaaaacuuucgauacagaguaccaaaagaccaagaacaacgacugggauuauguugugacaacugacaucucagagaugggagcaaauuucagagccgaucgggucauugaccccaggcgcugccuuaaaccagugauccuaaaggaugguccggaacgaguuauucuggcuggcccuaugcccgugacggucgcguccgccgcacagagacgggggaggauaggacgcaaccagaauaaagagggcgaccaguacaucuauaugggucaaccauugaacaaugaugaagaccaugcucacuggaccgaggccaagauguuacuggauaacauuaauacacccgaggggaucaucccugcacucuuugaaccagagagagaaaaaagugccgcuauugacggcgaguacaggcugcggggagaagcccguaagacuuucguggagcuuaugcgccgaggcgaucugcccguauggcucagcuauaagguggcgucggagggguuucaguacucugacagaagguggugcuucgacggagaacggaacaaucagguuuuggaggaaaacauggaugucgagauauggaccaaagaaggugagcgcaagaaacugagaccuagguggcuagacgcacggacauauuccgauccgcuggcccuccgagaguuuaaggaauucgcugccggcagacgcagcgugucaggggaccuuauccuggagauuggaaaauuaccacagcauuugacccugagggcucaaaaugcacucgauaaccuggugaugcuucacaauagugaacagggcgguaaggccuaccggcacgcuauggaggaacugcccgacacuaucgagacgcucauguugcuggccuuaauugcaguccuaaccgggggcguuacacuguuuuuccucucuggaaaaggccuugggaagacuuccaucggacuguugugugugauggcgagcucagcccugcucuggauggcuaguguagagccucauuggauagccgcaagcaucauucuggaauuuuuccuuauggugcuccugauccccgagccagaucgucagagaaccccucaggacaaccaauuggcuuacgucgugauuggucuguuauuuaugauccuaacaguugccgcaaaugaaaugggccugcucgagaccacuaagaaagaucuugggauaggacacguggccgcugagaaccaucaccacgcgacaaugcuggacgucgauuugaggcccgccuccgcauggacgcuguaugcuguagccaccacugugauuacaccaaugaugcgccauaccaucgaaaacaccacagccaauauuucucucacugcaaucgcuaaccaggccgcgauacugaugggccuugacaaggguuggccuaucagcaaaauggauauugggguuccguuacuggcucucggcugcuacucccaggugaaucccuugacgcugaccgccgcaguccuaaugcugguggcccacuaugcuaucauuggaccaggccuccaagcaaaggccacacgggaggcgcagaaacgaacugcugccgggaucaugaagaacccuaccgucgacggaauagugacaauugaccuugaucccguuguguacgacgcaaaguucgaaaaacagcugggccagaucauguugcugauccucuguaccucacaaauucuguuaaugagaacuacgugggcccuuugcgagucuaucacacuggcuaccgguccacucacuacccuaugggaagggaguccuggaaaguuuuggaauacaacuauagccguaucgauggcaaacauuuucaggggcagcuaucuggcuggugccggcuuggcguucucccugaugaaaucucucgggggaggccgccgggggaccggagcccagggcgagacacuuggugagaaguggaaaagacagcugaaucaguugucaaagagcgaauuuaacacguacaagcguuccgggaucauggagguggauaggagugaagcaaaagagggacugaagcggggcgaaaccacuaaacaugcugucucucgcgguacagccaagcuccgaugguucguugagagaaauuuagugaaacccgagggcaaggucauugaccugggguguggaaggggcggguggagcuauuacugcgcaggacuuaagaaagugaccgaaguaaagggcuacacuaaaggugggccgggacacgaggaaccaaucccuauggcuacauauggcuggaaccuggugaagcuacauucaggcaaagauguuuuuuucacccccccagagaagugugacacgcuccugugcgauauaggggaauccagucccaauccuaccaucgaggagggacggacauugcgcgugcugaaaauggucgaaccguggcucagagguaaccaauuuuguauuaagauccuuaaucccuacaugccaagcguggucgagacucuggaacagaugcagaggaagcacggcgggauguuagugcgaaacccucugucucggaauuccacccacgagauguauuggguuucaugcggaacaggcaacauuguaagcgccgugaauaugacuucgcguauguugcucaacagauucaccauggcccaucgcaaacccacauacgagagggacgucgaucugggugcggggacccggcacguggcuguugaaccugagguggcaaaccuagacaucauuggacagagaaucgaaaauauaaagaacgagcauaaaucuacuuggcacuaugaugaagacaauccauacaagacgugggccuaucacggcaguuacgaggucaaacccuccggcagcgcuucauccauggugaacgggguagugcgccuucugacaaagccuugggacguuauuccaauggucacccaaaucgccaugacugauaccacacccuuuggacagcagaggguguucaaggagaaaguggacacgcgaaccccgcgggcaaagagagguacugcccaaaucauggaagucacagcuaaauggcucuggggcuuucugucuaggaauaagaaaccucgcauuuguacccgugaggaauucacucggaagguuagaagcaacgcggccauaggggcaguguuuguagaugagaaucaguggaacagugcuaaggaagccguggaggacgagagguucugggauuugguccaucgcgaacgagagcugcacaaacagggaaagugcgcaacaugcguguacaauaugaugggcaaacgggaaaagaaacucggugaguuugggaaggccaagggauccagagcuaucugguauauguggcuuggcgccagguuccuggaauucgaggcguuaggcuuuaugaacgaggaccauugguucagccgcgaaaauucucugucagggguugagggagaagguuugcacaaacucggcuacauucugagagauaucaguaagauuccagggggaaacauguaugcagacgauaccgccggcugggacacacggaucacugaggaugaccuacagaaugaggcuaaaauaaccgauaucauggaacccgagcaugcccuucuggcaacguccauuuuuaagcucaccuaccaaaacaaaguggucagggugcagcguccugcuaagagcgguacaguaauggacguuaucucucgacgcgaccagagagggucgggacaggugggcacuuauggccugaauaccuucacaaacauggaaguccaauugauucggcagauggagucagaagggaucuuuagcccauccgaguuagagacucccaaccuggccaaaagggugcucgauuggcuugaaaagcagggagcugagcgccugaagagaauggccauaaguggugacgauuguguggucaaaccgauugacgaucgguucgcaaccgcgcuaacggcccugaaugacaugggcaagguuaggaaagauaucccucagugggaacccucuaagggguggaacgacuggcaacaggugccauuuugcagccaccacuuccaucagcucaucaugaaagauggacgagagauuguagugccuugucguaaucaggacgaauuggucggcagagcucgcgugucccaaggugccggguggucacugcgggagacagcaugccuuggaaagaguuacgcucagauguggcagcugauguauuuucacaggagagaucuccgcuuagccgcaaacgccauauguucugcgguucccguggacugggucccaaccagccggacuacaugguccauccaugcucaccaccaauggaugaccacugaggacaugcugucaguguggaauaggguauggauugaagagaaccccuggauggaagauaagacccauguuagcucuugggaggaagugccuuacuugggcaaacgagaggaccaguggugcggcucccugaucgggcucacagccagagcaacgugggccaccaauauucaggucgcuaucaaccaggugcggaggcuuauaggaaaugagaacuaccuggauuauaugacuaguaugaagcgcuucaaaaaugaaagcgacccagagggugcccuaugguga

SEQ ID NO: 13548 - RNA, 9879 nt, Artificial Sequence
  derived and/or modified CDS sequence (opt3) from DENV-1__EU660390__SS-prME
uccgugaccaugcugcucaugcuuaugcccacagcacuggcuuuccacuugacuacgcggggcggggaaccucauaugaucgucuccaagcaggaaaggggaaagucuuuacuguuuaagaccucagccgguguuaauaugugcacauugauugcaauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguaauugucggcgauguggcugggauccuuggacagggccgcaaaaugauaagaccucaacccauggaguacaaguauucguggaaaagcugggggaaggccaagaucauuggagcggacgcccagaauacuaccuucaucauugauggcccaaacacaccugaaugucccgacgaucagagggcuuggaauaucugggagguugaggacuacgguuuugggauauucacuaccaacauuugguugaaacuccgugauuccuauacacaggugugcgaccaccggcugaugucagcagccaucaaggauaguaaagcuguccacgccgacaugggauacuggauugaaucugagaagaaugaaacguggaaacuagcacgagcgagcuuuaucgaggugaagaccuguauauggccaaagucccauacucuguggucaaacggcguucucgaaagcgagaugaucauucccaaaaucuaugguggcccuauuucucaacacaauuacagaccaggguacuucacacagaccgccggaccguggcaucugggcaaacuugaguuggauuucgaccugugcgaagggacuacagugguagucgaugagcacugcggaaacaggggccccuccuuacgcaccacgacugugaccgguaaaaucauacacgaaugguguugccggaguuguacacucccuccacugagauuuaggggagaagacggaugcugguauggcauggagauucgccccgugaaggaaaaagaggaaaaucuugucaagagcaugguuucugcugguuccggcgagguggacucauucagucugggguugcucuguaucagcaucaugauugaagagguaaugcgaucgcgguggucccguaagaugcugaugaccggaacucuagccguguuuuuccugcucaucaugggccagcugacauggaacgaucuuauuagauugugcauaauggucggggcaaaugcuucugacaggaugggaaugggcaccacauaccuggccuuaauggcaacuuuuaaaaugcgcccuauguucgccgugggucuccuguuucggagacuuaccagcagggagguucugcuacucacgaucgggcugucauugguggcuagugucgaacugccaaacuccuuagaggaacucggagauggccuggcgaugggcauuaugauccuuaagcuguugacagacuuccaaucucaucagcucugggccacccugcuaagccugacuuuuauuaaaaccacauucucccuucacuaugcauggaagacuauggcuauggugcucucaaucguuagccuguuucccuugugucugaguaccacgucucagaaaacaaccugguuaccggugcuccuggggucccuuggaugcaagccucugacuauguucuugauagccgagaauaagaucuggggucgaaaaagcuggccacucaacgaaggcauuauggccgucgggaucguaucgauucugcuaucaucucugcuuaagaacgaugugccccucgcuggaccucugguugcaggcgguauguugaucgccuguuacgugauaaguggguccagcgcggacuuaucucuggagaaagcugccgaggucagcugggaagaggaagcagagcauuccggagccucacacaauauucucguggaaguacaggaugacggcacaaugaagaucaaagaugaggagcgcgacgauacccugacuauccuucugaaggcuacauugcuagcagugaguggcgucuauccccugagcauuccagccacccucuuuguuugguacuucuggcagaagaagaagcagcggucuggggugcugugggacacgccuucacccccagaaguggagagagcgguccuugaugacggaauauauaggaucaugcagcgugguuuacugggccgcagccagguggggguuggaguauuccaagaaaacguguuucauacuauguggcacgucacccggggcgcugugcucauguaccaggguaaaagauuggagccgaguugggccagcguuaagaaagaccugauuuccuacgggggaggcuggaggcuccgaggcucuuggaauacaggggaggaagugcaggucaucgcaguggagccuggaaagaaccccaaaaauguacagaccgccccagguacauucaagacucccgaaggcgaggucggggcuauugcccuggauuuuaagccuggaaccucgggcagcccaaucgugaaccgggaagguaaaauaguugggcuuuauggaaauggcguggucacgacaucaggcacuuacguguccgcaaucgcucaagccaaggcgagucaggaggggccccugccugagauugaagacgagguuuuccgcaaaagaaacuugaccaucauggaucuacacccgggaucugguaagacaaggcgguaucugccagccauugugcgagaagcaaucaaaagaaagcuccgcaccuuaauacuggcucccacuagggucguggccagcgagauggcugaagcacuuaagggcaugccuauucguuaccagaccacagccguaaaauccgagcauacggggaaggagaucguggaccugaugugccacgccacuuuuaccaugcggcucuugucaccaguuagaguccccaauuauaacaugaucauuauggaugaagcucauuucacagacccuucuagcaucgcggcaaggggauacauaaguacccgcgugggcaugggugaggccgcugccauuuuuaugacugcaacaccgcccggguccguggaagccuucccacaaagcaaugcugucauccaggaugaggaacgagacauuccugagagaucuuggaacucaggauaugaguggaucaccgauuuucccggcaaaacgguaugguucgugccauccauaaagaguggcaaugacauugcgaacugucugcggaaaaaugggaagaggguuauccagcucagccgcaagacuuuugauacagaauaccagaaaaccaagaacaacgacugggacuacguggucaccacugauaucucggagaugggagccaauuuccgugcagacagagugauugauccucggaggugccugaaacccguuauccuuaaggacgguccagaacgcgugauucuagcuggcccgaugccugucacaguggccucugcagcccaacgaagagggcggauaggaaggaaccacaauaaagagggcgaucaguauaucuacaugggucagccccugaacaaugacgaggaucaugcucacuggaccgaagccaagauguuguuagacaacauuaauacaccagaggggaucauccccgcgcuguucgaaccugagcgcgaaaaguccgcagccguagauggcgaguauagacucaggggagaggcucggaaaacuuuuguggaacugaugcgucgcggcgaccuuccaguuuggcugagcuacaaggucgccucagagggguuccaguauagugaucgaagauggugcuuugacggagaaaggaacaaucaagugcucgaggaaaacauggauguggagauuuggacgaaagagggugaacggaagaaauugcgccccagauggcuggacgcuaggaccuacucugacccucuagcacugcgggaguucaaggaauuugccgcuggccgaagauccgucagcggggaucucauacuugagaucggaaaacugccgcagcacuuaacacagcgcgcccagaaugcauuggacaaccugguuaugcuccauaauucagaacaaggcgguagggcguaucggcacgccauggaggagcugccagauacuauugaaacccuuaugcugcucgcuuugaucgccgugcugacagggggcguaaccuuauucuuucuaaguggacguggccuggggaagacuagcauuggacuccuuugugugauggcauccucuguccuguuguggauggcuagcguggagccccauuggaucgccgcauccauaauccuggaguucuuucucaugguucugcuuauuccugagcccgacagacagaggacgccacaggauaaccagcucgccuacguggucaucggucuguuguucaugauucugaccguagcugcgaaugagaugggcuuacuagaaacaacuaagaaagaccuggggaucggacacguggccguugagaaccaccaucacgcagcuaugcucgauguggaccuucauccugccucagccuggacccuguacgcagucgcuacaaccauaauuacucccaugaugcgccacacaaucgaaaacacgaccgccaauauuucuuugacugcgaucgcuaaccaagccgcaauacugaugggccucgauaaggguuggccaaucaguaaaauggacauuggggugccucugcuugccuuaggcugcuauucgcaggucaauccgcugacacucaccgcugcaguguugaugcugguugcccauuacgcgaucauuggacccggccuacaggcuaaggccacccgggaggcacaaaaacgaacagccgcugggaucaugaagaacccaacuguggauggaauaguagccauugaccuggauccuguggucuaugacgcaaaguuugaaaaacagcucggccagaucaugcuucugaucuuguguacgagccagauucugcucaugagaaccacaugggcucugugcgaguccaucacuuuagccaccgguccccuuacaacccugugggaggggucuccaggaaaguucuggaauacuacgauagcgguuucaauggccaacauuuuuaggggcagcuaccucgccggugcuggccuagccuucucccugaugaaaagucuagggggaggccgccgggggacaggagcacaaggcgaaacccugggugagaaguggaaaagacagcucaaucagcuuucuaagagcgaguucaacacuuauaagcguucagggaucauggagguggacagguccgaagcuaaagagggacugaagcggggcgagaccacaaaacacgccgucagucgcgguacugccaaguugcgaugguuuguggaaagaaaucugguaaaaccugagggcaaggugauugaucucggguguggaaggggcggguggagcuacuauugcgcgggauuaaagaaaguuaccgaagugaagggcuacacaaaaggugggcccggacacgaggaaccgaucccaauggcuacguacggcuggaaccuggucaaacuucauucuggcaaagacguguucuuuauaccucccgagaagugugauacccugcuaugcgacaucggggaguccucaccaaaucccacuauugaagagggacggacacuccgcguccugaaaaugguggaaccuugguugagagguaaccaguucuguaucaagauucugaauccguauaugcccagcguuguagagacccucgagcaaaugcagaggaagcacggcgggaugcuugugcgaaacccacugucgagaaauucuacucaugaaauguacugggucaguugcggaacaggcaacaucguguccgcaguuaauaugaccagccguauguuacugaacagauuuacgauggcccaccgcaaaccuaccuaugagagggauguggacuuggguacagggacucggcacgucgcuguggaacccgagguagccaaccucgauauuaucggacagagaauagaaaauauuaagcaugagcacaaaucaaccuggcauuacgacgaggauaacccuuauaagacaugggcauaccacggcuccuaugaagugaaaccaucuggcagcgccaguuccaugguuaauggggucgugaagcugcuaacuaagcccugggacgugaucccuauggucacccagaucgcuaugacagauaccacuccauucggacaacagcgcguuuuuaaagagaagguggacacgaggacacccaaagcgaagcgagguaccgcccagauuauggaaguaacugcacgguggcuuuggggcuuccugagcagaaacaaaaagccgaggauauguacccgcgaggaauuuacacguaaggugcggucuaaugcugccaucggggcagucuucguggacgagaaccaauggaacucagccaaagaggcuguugaagaugagagauuuugggaccucgugcauagggaacgcgagcugcacaagcagggaaaaugcgccacgugcgucuacaacaugaugggcaagcgagagaagaaguugggugaguucgggaaggcgaaaggaagucgggcaauuugguacauguggcugggcgccagauuucucgaguucgaagcucuuggcuucaugaaugaggaucacugguuuuccagggaaaacagccugucugggguggagggagaggguuuacauaagcugggcuauaucuugcgcgacauuucgaaaaucccugggggaaauauguacgccgaugacaccgcaggcugggauacuagaauaacagaagacgaucuccagaacgaggcuaagaucaccgacauuauggaaccagagcacgcccugcuagcuaaagccaucuucaaacuuacuuaucagaauaaaguaguucgggugcaaaggcccgcaaagaacgguacagucauggaugugauuucacgucgagaccagcgcgggagcggacaggugggcaccuacggccugaauacauuuacuaacauggaagcgcagcucaucagacaaauggaguccgaggggauauucaguccuucugaacuggagaccccaaacuuggccgaacgggcuuuagauuggcuggagaaguauggagucgaaaggcucaaacgcauggccauuagcggugacgacuguguugugaagcccaucgaugacagauuugcaacggcucuuaccgcccugaaugauaugggcaaaguacggaaggacaucccgcagugggagccuuccaaaggguggaacgauuggcaacaggugcccuucugcucacaucacuuucaccaacuaauuaugaaggacggaagggagauagucgugccaugucgaaaucaggaugaacugguuggccgugcaagagugagucagggugccggguggucucuccgcgagacagcgugcuugggaaagagcuacgcucagauguggcaacugauguauuuccaucggagggaccuuagacuggccgcaaacgccaucuguuccgcugucccuguggauuggguacccacuucacgcaccacauggagcauucacgcccaucaccaguggaugacuaccgaagacaugcucucuguuuggaaucggguguggaucgaggaaaacccauggauggaggauaaaacgcauauuuccaguugggaggacguccccuacuuaggcaagagggaagaccaguggugcggcagccugaucggguugacagcacgagcuaccugggccacuaauauacaaguggcgaucaaccagguuagacggcugauuggaaaugagaacuaccucgauuauaugacaucgaugaaaagguuuaagaaugaauccgacccugagggugcucuuugguga

SEQ ID NO: 13549 - RNA, 9879 nt, Artificial Sequence
  derived and/or modified CDS sequence (opt3) from DENV-1__EU660391__SS-prME
agcgugacaaugcugcuaaugcuuaugcccacagcacuggcuuuccacuugacuacgcgaggcggggagccucauaugaucgucuccaagcaggaaagggggaaaucuuuacuguuuaagacaucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucugcaacgcgguuggaaaacaucauguggaagcagauuucgaacgagcugaaucauauccuccuggaaaacgacaugaaauuuacaguagucgugggcgauguugcugggauuuuagcccagggaaagaaaaugauccgcccucagcccauggaguacaaguauagcuggaaguccuggggcaaagcgaagauaaucggggccgacgugcaaaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaggauucuaaagcuguucacgccgacaugggguacuggaucgaaagcgagaagaaugaaacauggaagcucgcacgggcguccuucauugaggugaaaacguguaucuggccaaagucacauacccuguggagcaacggaguacuagaaucugagaugauaauccccaaaauuuauggcgguccuaucucccagcacaauuaccgaccaggcuacuuuacucaaacagccgggccguggcaucugggaaagcucgagcuggauuucgaccuuugcgaaggcaccacugucgugguggaugagcacugcgggaacagaggacccaguuugaggacaaccacggucacuggcaaaauuauccacgaaugguguugccgcagcuguacccugccuccauuacgguuuaagggugaggacgggugcugguauggaauggagauaagacccguuaaggaaaaagaggaaaaucucgugaagucuaugguauccgcuggcucaggugagguggacaguuucagccugggccuucuguguauuucgaucaugaucgaagaggucaugaggucccgcuggucucgaaaaauguugaugacagggacccucgccguguuuuuccugcuaauuaugggacagcugacuuggaacgaucucauccggcugugcauuaugguuggcgcaaaugcuagcgaccguauggggaugggaacaaccuaccuugccuugauggcaacauuuaagaugagaccuauguucgccgugggccuguuauuuaggcgccucacuucacgggagguccugcuucugaccauaggucuaagucucguggcuuccguugaacugccaaacucuuuggaggaacugggggauggauuagcgaugggcaucaugauucucaaacugcuuacggacuuccagagccaucaacugugggccacauugcucucccugaccuuuaucaagacuaccuucucacuacacuaugcauggaagacaauggcuauggugcugagcauugucagucuuuuuccccucugucugucuacuaccucccagaaaacgacaugguugccgguacuguuaggcagccucgggugcaagccucugaccauguuccuuaucgccgagaauaaaauauggggaagaaagucguggccacugaacgaagguaucauggccgugggcauuguuucaaucuugcucucuagucugcucaagaaugaugugccccuggcugggccucuuauugcaggaggcaugcucaucgccuguuacgucauauccgguagcucugcggaccugagcuuggagaaggcugccgagguguccugggaagaggaagcagagcauucaggggccagucacaauauuuuaguagaagugcaggaugacggaacuaugaaaaucaaggaugaggagagggacgauacacugaccauccuccugaaggcuacucuucuggcagucagcggcguuuaucccuugucuauuccagccacacuauucgugugguacuuuuggcagaaaaagaaacaacgauccggcgugcugugggacaccccuucacccccagaagucgagcgcgcggugcucgaugacgggauauaucggaucaugcagagaggacugcuugguaggagucagguuggcguagggguguuccaggaaaacgucuuucauacgauguggcacgugacucguggagcuguuuuaauguaccaaggcaagcgccuggagccgagcugggccuccgugaaaaaggaccucauuucuuacggugggggauggcgguugcagggcucguggaauaccggcgaggaaguccaggugaucgcaguagagccugggaagaaccccaaaaauguccagacagccccaggaaccuucaagacaagcgaaggugaggugggcgcuauugcccuggauuuuaaacccgggacuucaggauccccuaucguuaacagagaaggcaagauagugggucucuaugggaauggagucgugaccacgaguggcacauacguuucugcaaucgcucaagccaaagcgagccaggacggcccacugcccgagauugaggaugaaguguucaggaagcgaaaccuuacuaucauggaccugcacccuggguccggaaagacccggcgcuauuugccggccauugucagagaggcaaucaaaaggaagcuacggacacugauacucgcuccaacccgagugguagccucagaaauggcugaggcauuaaaagguaugcccauuagauaccagacuaccgccgugaagucugaacauacaggcaaagagaucguugaucugaugugccacgccacguuuacuaugcgccuucugagcccugucagggugccaaauuauaacaugaucauuauggacgaggcucauuucaccgaucccaguuccaucgcggcacguggguacauaagcacacgggugggaaugggcgaagccgcugccauuuuuaugaccgcaacuccuccggguucugucgaggccuucccccaaucaaaugcuguaauccaggacgaagagagagauauuccagaaagguccuggaacaguggguaugaguggaucacagacuuuccuggaaagaccgugugguucguucccagcauaaagucgggcaaugauauugcgaacugucuccgcaaaaauggcaagcgagugauccaguugucuagaaaaacguucgacacugaguaccagaagaccaagaacaacgacugggauuacgucgugaccaccgacaucuccgaaaugggggccaauuuucgggcagauaggguuauugacccacgccguugccugaagccugugauccucaaggauggacccgagagagucauucuggcugguccaaugccggugacuguagccagcgcagcccaacggaggggccgcauagggcgaaaccacaauaaagaaggagaccaguauaucuacaugggccagccucuuaacaaugaugaggaccaugcucacuggacagaggccaagaugcuacuggauaacauuaauacccccgaagguaucaucccagcguuguucgagcccgaaagagagaaaucagcagccauugacggggaauaucgguuaaggggcgaggcucgcaagacauuuguggagcugaugagaaggggagaucucccuguuuggcugaguuacaaagucgccucugaaggcuuccaguauuccgaccggcguuggugcuuugauggggagcgcaacaaucaagugcuugaagagaacauggacguggaaauauggacuaaggagggagagaggaaaaagcugagaccaagauggcucgacgcucggacguacagcgaucccuuggcacugcgcgaguucaaggaguuugccgcugguagaaggucagucaguggcgaccuaauccuggaaauugggaaacucccucagcaccuuacccagcgggcccagaaugcacuggauaacuuaguuauguugcauaauagcgagcaaggaggccgagcguauagacacgccauggaagaacugccggacacaaucgagacucucaugcugcuugcucugauugccgugcucaccggugggguaacauuguucuuucuguccggccgcggauuaggcaagaccucuaucgggcuacugugugugauggcaagcuccguccuccuuuggauggcuucaguggaaccacauuggauagccgcaucuaucauucuggaguucuuuuugaugguucugcucauccccgaaccugauaggcagcggacuccccaggacaaccagcuggccuacguggucauuggacuucucuucaugauccugacgguagcugcgaaugagauggguuugcuggagaccaccaaaaaggauuuaggcauagggcacguggccguugaaaaccaccaucacgcagcuaugcuagacguggaucugcauccagccagugccuggacucucuacgcagucgcuaccacaauuaucaccccuaugaugcgucacacuauugagaacacaacggccaauaucucgcuuaccgcgauagcuaaccaagccgcaauccugaugggauuggacaaaggcuggcccauuagcaagauggauaucggugugccacugcucgcccuggggugcuauucccaggucaauccucuuacuuuaacagcugcagugcugaugcucguugcccauuacgcgauuaucggcccgggauugcaggcuaaggccaccagagaagcacagaaaaggaccgccgcuggcauaaugaagaaccccacaguggacgggauuguagccaucgaucuggacccaguggucuaugacgcaaaauuugagaagcagcuaggacagaucaugcugcucauucuuuguacuucucagauccuguugaugcgcacgaccugggcucugugcgaaucaauaacacucgccacuggcccucugaccacauuaugggaggguagccccgggaaauucuggaauaccacuauugcgguuuccauggccaacaucuuccggggaaguuaccuugcaggcgcuggucuggccuuuucucucaugaaaagccuaggcgggggacgaagaggcacgggggcacaaggagagacacugggcgaaaaguggaaaaggcaguugaaucagcugucaaaguccgaguucaacaccuauaaacgcagugguauuauggaaguggaucggagcgaggcuaaggaagggcucaaaagaggagagacuaccaagcacgccgucucucguggcacagccaaacuuaggugguuuguggagcggaaucugguaaaaccagaagguaaggugaucgacuugggcugugggcgcggaggcugguccuacuauugcgcggggcugaaaaagguuacugaggugaaaggauacaccaagggcgguccugggcacgaggaacccauaccgauggcuacauacggauggaaccucgucaaauuacauucaggcaaggauguguucuuuaucccaccugaaaagugugacacgcugcuuugcgauauuggcgagagcucgcccaauccaaccaucgaggaagggcgaacucugagaguccuaaaaaugguggagcccuggcucaggggaaaccaguucuguauuaagauccugaauccuuauaugccgucuguuguagaaacauuggagcaaaugcagcggaaacacgguggcaugcuggugcgcaacccccucaguagaaauuccacccaugagauguacugggucagcugcgggacuggaaacauugugucagcaguuaauaugacauccaggaugcuucugaaccgauuuaccauggcccaccggaagccaacguaugaacgugacguggauuuaggcgcugguaccagacacgucgccguggagccugaaguagcaaaccuggacaucauagggcagcgcauugagaauaucaaauacgaacauaagucuacauggcacuaugaugaggacaaccccuacaagacuugggccuaucauggaagcuacgaggugaaaccuaguggcuccgcuagcucuaugguuaauggcgucgugaaguugcucaccaaaccaugggaugugauccccauggucacacagauugcgaugacugacaccacaccuuucgggcaacagaggguuuuuaaggaaaaaguggacacccggacuccaaaggccaagagaggaacggcacagauaauggagguaacagcuaaauggcugugggguuuccuaucacgcaacaagaaacccaggaucuguacccgagaagaguuuacucggaaggugagaaguaaugccgcaauuggcgccgucuucguggaugaaaaccaauggaacuccgcuaaagaggccguugaggacgaaagguuuugggaucuugugcaccgcgagcgugaacugcauaagcaggggaagugcgcgaccugcgucuacaacaugaugggaaaacgggagaagaaacucggcgaguucgguaaggcaaaagggagcagagccaucugguauauguggcugggagcuagguucuuggaguuugaggcccugggcuucaugaaugaagaccacugguuuucucgcgagaacucgcucucaggcguggaaggggagggacuucacaagcuggguuacauuuuacgagauaucagcaaaauaccgggcgggaauauguaugcagacgauacagcuggaugggacacgcggaucaccgaggaugaccugcagaacgaagccaagauuacugauaucauggagccugaacaugcuuugcucgccaaguccauuuucaaacugacauaccagaauaagguaguuagagugcaaaggccagccaaaaacggcaccgucauggacgugaucagucgcagagaucagcgggguucuggacaggugggaacuuauggccuaaauacauuuaccaacauggaggcgcagcuuauaaggcaaauggaaagcgagggcauuuucucccccucagagcuggaaacaccuaaccucgccgggcguguccuggacugguuggagaagcacggaguugaacgauuaaaacgcauggcuaucaguggugacgauugugugguaaagccaaucgacgauagauuugccacugcacugaccgcucucaaugacaugggcaaggugcggaaagauauuccccagugggagccgucuaagggguggaacgacuggcagcaggucccuuucugcagccaucacuuucaccaacuuauaaugaaagauggaagggaaaucgugguucccugucgcaaucaggacgagcuggugggcagagcccgggucucccagggugcaggguggucacuaagggagacggccugccugggaaagagcuacgcgcagauguggcaacucauguauuuccaucgacgugauuugagacuggcugccaacgcaauuuguucugccgugccaguagacuggguuccuaccucccgcacaacuuggaguauccacgcucaucaccaguggaugaccacagaagauaugcuuagcguguggaaucgggucuggauugaggaaaaccccuggauggaggacaaaacucauaucucguccugggaagacgugccauaccugggcaagagggaggaucaguggugcggcucucucauaggguuaaccgccagagcaacgugggcuacaaauauccaaguugccauuaaccaggugcgccggcugaucggaaaugagaacuacuuggacuauaugaccucaaugaagagguuuaaaaaugaaagcgaucccgagggugcgcugugguga

SEQ ID NO: 13550 - RNA, 9879 nt, Artificial Sequence
  derived and/or modified CDS sequence (opt3) from DENV-1__EU660393__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaacaugugcacacuaauugccauggaccucggagaacugugugaagauacuaugaccuacaaaugcccacggauaacagaaaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucucgacucaagaugaaaaggggauuacacagucuggacgcuugaucaccgcgaaccccauagugacugacaaagagaagccuguaaauauugaagcagagccacccuuuggcgaguccuauaucaucauuggugccggggaaaaagcucugaagcucucaugguucaagaaaggcaguagcaucggaaagauguuugaggccaccgcaagaggcgccaggcggauggcuauucugggggauacagccugggacuucggauccauagguggcgucuuuacgucuguggggaaacuuguucaucagaucuucggaaccgcauacggcgugcuguuuagcggugucucauggacuaugaagauugggaucggcguguugcucacauggcugggauuaaacagucgauccaccagccugucuaugacauguaucgcgguaggccuagugacucucuaccuggggguuaugguccaggcugauucaggaugcgugauuaauuggaaaggccgcgaacuuaagugugguagugggauauucgugaccaacgagguccacacguggacagaacaauauaaguuucaggccgacagcccgaaaagauuguccgcagccaucggaaaggcuugggaggagggcguuugcgguauuaggucugccacccggcuggaaaauaucauguggaaacagauuucgaacgagcucaaccauauccuguuagaaaaugacaugaaguucacuguggugguaggcgaugucgcagggauacuggcucagggcaaaaagaugauccgcccucaacccauggaguacaaauauagcuggaaguccuggggcaaggccaaaauuaucggggcggacgugcagaacaccacauuuauuaucgauggaccaaauacuccugaaugucccgacgaucagagagccuggaacauaugggagguugaggacuacggcuucgguauuuuuaccacaaauaucuggcuuaaguugagggauucauauacacaggugugcgaccaccgucucaugagugcugcaauuaaagauucuaaggccguccacgcugacaugggguacuggaucgaaagcgagaaaaacgaaaccuggaagcuggcccgggcauccuucauagaggugaagacuuguaucuggccaaaaucacauacacuauggagcaauggaguucuggaaucugagaugauuauccccaagauuuauggcgguccuaucucccaacacaacuaccgaccaggcuacuucacccagacugcggggccguggcaucucggaaaacuggagcuugauuuugacuugugcgaaggcacaaccgugguagucgaugagcacugcgggaauagaggacccagucugaggacgacuaccgugacaggcaagauaauucacgaaugguguugccgcagcuguaccuuaccuccacuccgguucagaggugaggacgggugcugguauggaauggagaucaggcccgugaaagaaaaggaggaaaaccuggucaagucuaugguuuccgccggcucaggugagguggacaguuuuagccuuggccuguuguguaucucgauuaugaucgaagagguaaugcgcucccgauggucucggaaaaugcucaugacugggacacuggcuguguucuuucuacugauuaugggacagcucaccuggaaugaucugauacgucuuugcaucauggucggcgccaacgcaagcgacagaauggggaugggaacaacuuacuuggcucugauggccaccuucaagaugaggccuauguuugcagugggcuuacucuuccgccggcugacgucaagagagguucuucugcuaacaauuggucucagucugguggccuccgucgaauugccaaauucucuggaggaauuaggggauggacucgcuaugggcaucaugauucugaaacuucugaccgacuuucaaagccaucaguugugggcgacucuccugucccuaaccuucaucaagacaacuuuuucacugcacuaugccuggaaaaccauggcaauggugcuuagcauaguuagucucuucccccuguguuugucuacgacaucccagaagaccacuuggcugccgguguuacucggcagccuggggugcaagccucuuacaauguuucugaucgcugagaacaaaauuuggggaaggcgaucguggccauugaaugaagguaucauggccgucggcauuguaucaauccuccugucuagucuacugaagaacgaugugccccuugccgggccucucauagcuggaggcaugcugauugcauguuacguuaucuccgguagcucugccgacuugagcuuagagaaagcggcugagguguccugggaagaggaagccgagcauucaggggcaagucacaacauccuggucgaagugcaggaugacggaaccaugaagauuaaagaugaggagcgcgacgauacucucacaauacugcuuaaggccacccuguuggcuguaagcggcguguauccccuaucuaucccagcaacgcuguucgucugguacuucuggcagaaaaagaagcagcgguccggcguucucugggacacuccuucacccccagaaguggagagagccgugcuggaugacgggauuuauaggaucaugcagcguggacuuuuaggucgcagucaggucggcguggggguuuuucaagaaaauguauuccauaccauguggcacgugacacggggagcgguccugauguaccagggcaaaagacucgagccgagcugggcuuccgugaagaaagacuugauuucuuacggugggggauggaggcugcagggcucguggaacaccggcgaggaaguucaggugaucgccgucgagccugggaagaaucccaaaaacgugcaaacagcaccaggaacuuuuaagacccccgaaggugagguaggcgccauagcucucgauuucaagccugggacgagcggaucaccaaucgucaaucgagaaggcaaaauugugggucuguaugggaacggaguugugacaacuuccggcaccuacgucagugccaucgcacaggcuaaggccucucaggagggcccccuuccugagauugaagacgagguguuucggaaacgcaaucugacaaucauggauuugcacccggggagcggaaagaccagaagguaucuaccagcgauaguucgggaagccauuaaacgaaagcugagaacucucaucuuagcacccacccgcguggucgcuuccgagauggccgaagcucugaaggguaugccuaucagguaccaaacaacggcagugaaaucagagcauacuggcaaggagauuguagaccuuaugugccacgccaccuucacaaugcgucugcucucuccagugcggguucccaacuauaauaugaucauaauggaugaagcccauuuuaccgacccuagcaguauugcugcgagaggguacaucuccacuagggucggaaugggcgaggcagccgcuauuuucaugacagccaccccgcccgguagcguggaagcauuuccacagucuaacgccgugauccaggaugaggaacgcgacauaccugagcgaucauggaacuccggguaugaguggauuacggauuuccccggaaaaacugucugguuuguaccaaguaucaagagcggcaacgacaucgcuaauuguuugaggaaaaauggcaagcgggugauucagcugucgaggaagacauucgauaccgaauaccagaaaaccaagaauaacgacugggacuacguugugacuacagauaucucugagaugggggcgaacuuccgcgccgaccgugucauugauccuagacggugccucaaacccgugauacugaaggacggaccagaaaggguuauccuugcagguccgaugccugugaccgucgcuuccgccgcacagcgccgaggcagaauugggcggaaucacaacaaagagggagaucaguauaucuacaugggccagccccuaaauaacgacgaggaucaugcccacuggacagaagcuaagaugcuguuggacaauaucaacacuccagaggguauuauacccgccuuauuugaaccugagagggaaaagagcgcggcaaucgauggggaguaucgccugagaggcgaggccaggaaaacguucguggaacucaugcggcguggagaccugccaguauggcuuucauacaagguggcuagugagggcuuucaauauucugaucgccgauggugcuucgacggggaaagaaauaaccagguucuggaggaaaauauggaugucgagauuuggaccaaagagggagaaaggaagaaacuccggccccgcugguuggacgccagaacauacuccgacccucuggcucuaagggaguuuaaggaguucgcagccggucggcgaagcgugucaggcgaucugauccucgagauugggaaacuuccgcagcaccugacucagagagcucaaaacgccuuagacaauuuggugaugcugcauaacagugaacagggaggccgcgcauauaggcacgcgauggaggagcucccagauaccaucgaaacacugaugcuucuggcccucauagcugucuugaccggugggguuacucuguuuuucuuaagcggccggggacuaggcaagacguccaucgggcugcucugugugauggccucuagcguacuucuguggauggcauccguggagccccauuggauugcugccucaaucauuuuggaauuuuuccugaugguccuccugaucccugagcccgaccgucagagaaccccacaggauaaucaacuugcauacgugguuauaggacuccuguuuaugauuuugacaguggccgcuaacgagaugggucuguuagaaacuaccaagaaagaccuaggcaucgggcacgucgcgguagagaaucaccaucacgccgcaaugcuggauguggaccuccauccugcuucugccuggacacuuuacgccguugcaaccacuauuaucacacccaugaugaggcacacgauagaaaacaccacugcuaacaucagucugacagccauugcgaaucaggcugccaucuugaugggacuggauaagggcuggccaauuucgaaaauggacaucggugugccucuccuggcacuugggugcuauagccaggucaacccguuaacccugaccgccgcugugcucauguuggucgcacauuacgccauaauuggccccggacugcaagcgaaggcuacacgcgaggcccagaaacggacugcagccggcaucaugaagaauccaacgguggaugggaucguugcuauugaccuagauccugugguauaugacgccaaguucgaaaaacagcugggacagaucaugcuccuuauacuguguaccucccaaauuuugcugaugcgaacaacuugggcacucugcgagucuaucacccuggcuacaggccccuuaaccacucuuugggaggguucaccagggaaguuuuggaacacgacaauugccgugagcauggcgaauaucuucagaggauccuaccuggccggcgcaggucucgcuuucagucuaaugaaaucucugggcgggggaaggcgcggcaccggggcccagggagaaacuuugggcgagaaguggaaacggcagcugaaccagcucagcaagucagaauuuaauaccuauagacguuccgguauaauggaggucgacaggagugaagcaaaggaggggcuuaaacggggagagacaacuaagcacgcuguuagccgcggcaccgccaaacugcgaugguucguggaaagaaacuuggucaagccugaggguaaagugaucgaucugggcugugggaggggaggcuggucuuacuauugcgccgggcucaagaagguaacagaagugaaaggauacacgaagggcggucccgggcacgaggaaccgauuccaauggcgaccuacggauggaauuuaguuaaacugcauuccggcaaggacguguuuuucaucccucccgagaaaugugauacucuucugugcgacauuggcgagucaagcccaaaccccacaaucgaagaggggcggacccuacgcguccucaagaugguggaaccuuggcugagaggaaaucaauuuuguauuaaaaucuugaacccguauaugcccucggucguggagacucuggagcagaugcagaggaagcacgguggcaugcucguucgaaauccacuuucucggaacaguacacaugaaauguacuggguauccugcgggaccggaaauauagugagcgcugucaacaugacgucacguaugcuguuaaauagauucaccauggcacaccgcaagccuacauaugagagggauguggaccugggcgccgguacucggcacguugcuguggaacccgaggucgccaacuuggauauuaucgggcagagaaucgaaaacauuaaacaugagcacaaguccaccuggcauuacgacgaggauaauccuuauaaaacaugggcauaccacggaucuuaugaagugaagccaagcggcagugccuccagcaugguaaacggcgugguuaaacuccugacuaagcccugggacgucauaccuauggugacccaaaucgcuaugacagauaccacuccauuugggcagcagcgcguguucaaggagaaagucgacacgaggacacccaaggcgaaacgaggaaccgcccaaauuauggaaguuacugcaaaguggcuaugggguuuucuuucucggaauaaaaagccgagaaucuguaccagggaggaguucacacgcaaggugcguucaaacgcugccauuggcgcaguauuuguggacgagaaucaguggaacagugccaaagaggcugucgaagaugagcgguucugggaccuggugcauagagaaagggagcuccacaagcaggggaaaugcgccacgugcguuuacaauaugaugggaaagcgcgagaaaaagcugggcgaguuugguaaggcgaaagggucccgagcaaucugguacaugugguugggagcccgguuccuggaguucgaagcucucggcuuuaugaacgaggaucacugguucagcagagaaaauucucuuucgggcguggagggggagggacugcauaaguuagguuauauacugagggacaucucaaaaauuccuggcgggaacauguacgccgaugacaccgcaggaugggauacucgcaucacagaagacgauuugcagaaugaggcuagaauuaccgacaucauggaaccagagcacgcccuccuggcuaagagcauauuuaaacuaacuuaucaaaacaaggucgugcggguacagaggcccgccaaaaauggcacaguuauggaugugauuucccgucgagaccagcgcgguagugggcaggucggaaccuacggccuuaacacauucacuaauauggaagcacaacugaucagacagauggagucugagggcaucuuuagcccuuccgaacucgagaccccaaaccuggcggaacggguguuggauugguuagagaaguaugggguggaaaggcugaagcgcauggccauuucaggagacgacugugucguuaaacccauagaugacagauucgcuacggcccucaccgcacuuaacgauauggguaaggugcggaaagacaucccgcagugggagccuaguaagggcuggaaugauuggcagcaaguacccuuuugcucucaucacuuccaccagcugauuaugaaagacgggagggagaucguggucccaugucgaaaccaggaugagcuagugggacgugcuagaguuagccagggcgccgguuggucccugcgcgagacagcaugccucgggaagucauacgcccaaauguggcaguugauguauuuucaucggagggaccugagacuugcggcuaaugccauuuguagcgcagugccugucgauuggauccccacuucucgcaccacaugguccauacacgcccaucaccaguggaugacuaccgaagacaugcugaguguguggaaccggguauggaucgaggaaaauccauggauggaggauaagacgcauauuagcucguggggagacguucccuaccucggcaaaagggaggaccaauggugcggcuccuuaaucgggcugacagcucgagccaccugggcaacuaacauucagguggcuaucaaucaggucagacgguugauuggaaacgaaaauuaccuggauuauaugacaucuaugaagagguucaaaaacgagucagacccugaaggugcccucugguga

SEQ ID NO: 13551 - RNA, 9879 nt, Artificial Sequence
  derived and/or modified CDS sequence (opt3) from DENV-1__EU660401__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauuaucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaaaaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauucccacacgcaggucugcgaccaccgucucaugucagcugcaaucaaagauaguaaggccgugcaugcugacaugggguauuggauugaaucugagaaaaaugaaaccuggaagcuggcccgggcauccuucaucgagguuaagacuuguauauggccaaaaucccacacacuauggucaaacggagugcuggaaagcgagaugaucauucccaagaucuacggcgguccuauuucucaacauaauuaucgaccaggcuacuucacccagacugcggggccguggcaccucggaaaacuggagcuugauuuugacuugugcgaaggcacaaccguagucguggaugagcacugcgggaacagaggacccucccugaggacgacuaccgugacaggcaagaucauacaugaaugguguugccgcaguuguaccuuaccuccacuccgguucagaggugaggacgggugcugguacggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuucuuucuacugaucaugggacagcucaccuggaacgaucugauucgucuuugcauaauggugggcgccaaugcaucugacagaauggggaugggaacaacuuauuuggcucugauggccaccuucaagaugaggccuauguuugcaguuggcuuacucuuccgccggcugacgagcagagaggugcuucugcuaacaaucggucucucacuggucgccaguguggaauugccaaacucccuggaggaauuaggggauggacucgcuaugggcauuaugauccugaaacuucugaccgacuuucaaucucaccaguugugggcgacucuccugagccuaaccuucauuaagacaacuuuuucccugcauuacgccuggaaaaccauggcaaugguucuuucaaucgugagccucuucccccuguguuugaguacgacaucucagaagaccacuuggcugccggucuuacucggcucccuggggugcaagccucuuacaauguuucugauagcugagaauaaaaucuggggaaggcgaagcuggccauugaacgaagguauuauggccguaggcaucgugucgauucuccugucaucucuacugaagaacgauguuccccuugccgggccucucaucgcuggaggcaugcugauagcauguuaugugauuagugguuccagcgccgacuugucuuuagagaaagcggcugaggucagcugggaagaggaagccgagcacuccggggcaucacauaauauccugguggaaguacaggaugacggaaccaugaagaucaaagaugaggagcgcgacgauacucucacaauucugcuuaaggccacccuguuggcugugaguggcgucuacccccuaagcauaccagcaacgcuguucguuugguauuucuggcagaaaaagaagcagcggucuggcgugcucugggacacuccuucacccccagaaguggagagagccguccuggaugacgggaucuacaggauuaugcagcguggacuuuuaggucgcagccaggugggcguugggguauuucaagaaaacguguuccacaccauguggcacgucacacggggagcggugcugauguaucagggcaaaagacucgagccgaguugggcuagcguuaagaaagacuugaucuccuacggugggggauggaggcugcagggcucuuggaauaccggcgaggaagugcaggucauugccguggagccugggaagaaccccaaaaauguacaaacagcaccaggaacuuuuaagacccccgaaggugaggucggcgccaucgcucucgauuucaagccugggacgucgggaagcccaauagugaaccgagaaggcaaaaucguuggucuguacgggaauggaguggucacaacuucaggcaccuauguguccgccauugcacaggcuaaggccagucaggagggcccccuuccugagaucgaagacgagguuuuucggaaacgcaaccugacaauuauggauuugcauccggggucuggaaagaccagaagguaccuaccagcgaucgugcgggaagccauaaaacgaaagcugagaacucucauuuuagcacccacccgcgucguggcuagcgagauggccgaagcucugaaggguaugccuaucagguaucaaacaacggcaguaaaauccgagcacacuggcaaggagaucguggaccuuaugugccaugccaccuucacaaugcgucugcucucaccaguucggguccccaauuacaacaugauuaucauggaugaagcccacuuuaccgacccuucuagcauagcugcgagaggguauauuaguacuagggugggaaugggcgaggcagccgcuaucuucaugacagccaccccgcccgguuccguggaagcauuuccacagagcaaugccgucauucaggaugaggaacgcgacaucccugagcgaucuuggaacucaggguacgaguggauaacggauuuccccggaaaaacuguaugguuugugccauccauuaagaguggcaaugacaucgcuaacuguuugaggaaaaauggcaagcggguuauccagcugagcaggaagacauucgauaccgaauaucagaaaaccaagaacaacgacugggacuacguggucacuacagauauuucggagaugggggcgaauuuccgcgccgaccgugugaucgauccuagacggugccucaaacccguuauucugaaggacggaccagaaagggugauacuugcagguccgaugccugucaccguggcuucugccgcacagcgccgaggcagaaucgggcggaaccauaauaaagagggagaucaguacauuuauaugggccagccccuaaacaaugacgaggaucacgcccacuggacagaagcuaagaugcuguuggacaacaucaauacuccagaggguaucauucccgccuuauuugaaccugagagggaaaaguccgcggcaauagauggggaguaccgccugagaggcgaggccaggaaaacguucguagaacucaugcggcguggagaccugccaguguggcuuagcuauaagguugcuucagagggcuuucaauacagugaucgccgauggugcuucgacggggaaagaaacaaucagguccuggaggaaaacauggauguggagaucuggaccaaagagggagaaaggaagaaacuccggccccgcugguuggacgccagaacauauucugacccucuggcucuaagggaguuuaaggaguucgcagccggucggcgauccgugagcggcgaucugauucucgagaucgggaaacuuccgcagcaucugacucagagagcucaaaaugccuuagacaacuuggucaugcugcacaauucagaacagggaggccgcgcauacaggcaugcgauggaggagcucccagauaccauugaaacacugaugcuucuggcccucaucgcuguuuugaccgguggggugacucuguuuuucuuaaguggccggggacuaggcaagacgagcauagggcugcucuguguaauggccuccucugugcuucuguggauggcaagcgucgagccccacuggaucgcugccuccauuaucuuggaauuuuuccugauggugcuccugauuccugagcccgaccgucagagaaccccacaggauaaccaacuugcauauguugugaucggacuccuguuuaugauauugacagucgccgcuaaugagaugggucuguuagaaacuaccaagaaagaccuaggcauugggcacguagcgguggagaaccaucaccaugccgcaaugcuggauguugaccuccacccugcuucagccuggacacuuuacgccguggcaaccacuaucauuacacccaugaugaggcauacgaucgaaaacaccacugcuaauauaucucugacagccaucgcgaaccaggcugccauuuugaugggacuggauaagggcuggccaaucaguaaaauggacauuggugucccucuccuggcacuugggugcuacagccaggugaauccguuaacccugaccgccgcuguccucauguugguggcacacuaugccaucauaggccccggacugcaagcgaaggcuacacgcgaggcccagaaacggacugcagccggcauuaugaagaacccaacgguugaugggaucguggcuaucgaccuagauccuguaguguacgacgccaaguucgaaaaacagcugggacagauuaugcuccuuauccuguguaccagccaaauauugcugaugcgaacaacuugggcacucugcgaguccauuacccuggcuacaggccccuuaaccacucuuugggaggguucuccagggaaguuuuggaauacgacaaucgccgucucaauggcgaacauuuucagaggaagcuaucuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuacaagagaucagguaucauggagguugaccguuccgaagcaaaagaggggcuuaagaggggagagacaacuaaacacgcugugagucggggcaccgccaagcugcgcugguucgucgaacgaaauuuggugaaaccugaggguaagguaauagaucugggcugugggagaggaggcuggagcuauuacugcgccgggcucaagaaagugacagaaguuaagggauauacgaaaggcggucccgggcaugaggaaccgaucccaauggcgaccuacggauggaacuuagugaagcugcacucuggcaaagacgucuuuuucauuccucccgagaagugugauacucuucugugcgacaucggcgaguccucaccaaaucccacaauugaagaggggaggacccuacgggugcucaaaauggucgaaccuuggcugcgcggaaaccaauuuuguaucaagauuuugaauccguacaugcccagcgugguugagacucuggagcagaugcagagaaagcaugguggcaugcucguaaggaacccacuuucgcgaaauucuacacacgaaauguauugggugaguugcgggaccggaaacaucgucuccgcugugaauaugacgagccggaugcuguuaaaccguuucaccauggcacacagaaaaccuacauacgagcgcgauguugaccugggcgccgguacuaggcauguggcugucgaacccgagguggccaacuuggauauaauugggcagcggaucgaaaauaucaagcacgagcauaaaucaaccuggcacuaugacgaggauaacccuuacaagacaugggcauaucauggauccuacgaaguaaaaccaucuggcagcgccaguuccauggugaauggcguugucaagcuccugacuaagcccugggacgugauuccuauggugacccaaauagcuaugacagauaccacuccauuugggcagcagagagucuucaaagagaagguugacacgcgcacacccaaagcgaagaggggaaccgcccaaaucauggaagugacugcaaaauggcuaugggguuuucuuagccgaaacaagaagccgcggauuuguaccagagaggaguucacaaggaaaguacgcucuaaugcugccaucggcgcaguguuugucgacgagaaccaguggaacucagccaaggaggcuguggaagaugagcguuucugggaccugguucaccgggaaagagagcuccacaaacaggggaagugcgccacgugcguguauaacaugaugggaaaaagggaaaagaagcugggcgaguuugguaaagcgaaggggagucgcgcaauuugguacaugugguugggagcccgauuccuggaguucgaagcucucggcuuuaugaaugaggaucauugguucucccgggaaaacagccuuucuggcgucgagggggagggacugcacaaauuagguuacauccugagagacauaucgaagaucccuggcgggaauauguaugccgaugacaccgcaggaugggauacuaggauuacagaagacgauuugcagaacgaggcucgcaucaccgacauuauggaaccagagcaugcccuccuggcuaaaucaaucuuuaagcuaacuuaccaaaauaaagugguaagaguucagcggcccgccaagaacggcacagugauggaugucauaagcaggcgugaccagcgagguuccggacaggugggaaccuauggccuuaauacauucacuaacauggaagcacaacugauucgccagauggagagugagggcaucuuuucuccuagcgaacucgagaccccaaaccuggcggaaagaguguuggauugguuagagaaguacggggucgaacggcugaaaaggauggccaucuccggagacgacuguguugugaagcccauugaugaccgcuucgcuacggcccucaccgcacuuaaugauauggguaaaguaagaaaggacauaccgcagugggagccuucaaaaggcuggaacgauuggcagcaagugcccuuuugcagucaccacuuccaucagcugaucaugaaggacgggcgggagauugucgugccauguaggaaucaggaugagcuaguuggacgagcucgugugucucagggcgccgguuggagccugagagagacagcaugccucgggaaguccuaugcccaaauguggcaguugauguacuuucaccgccgggaccugaggcuugcggcuaacgccaucuguucagcagucccuguggauuggauucccacuagcagaaccacauggucuauccaugcccaccaucaguggaugacuaccgaagacaugcuguccguauggaaucgcguuuggauagaggaaaacccauggauggaggauaaaacgcacaucaguagcuggggagacgugcccuaucucggcaagcgggaggaccaauggugcggcucguuaauugggcugacagcuagggccaccugggcaacuaauauccaggucgcuauuaaccaggugcgaagauugaucggaaaugaaaacuaccuggauuacaugacauccaugaaacgguucaagaaugagggugacccugaaggcgcccucugguga

SEQ ID NO: 13552 - RNA, 9879 nt, Artificial Sequence
  derived and/or modified CDS sequence (opt3) from DENV-1__FJ373305__SS-prME
agcgugaccaugcugcucaugcuuaugcccacagcccuggcuuuccacuugacuacgagaggaggggaaccucauaugaucgucuccaagcaggaaagagggaaaucuuuacuguuuaagaccucagccgguguuaauaugugcacacuaauugccauggaccucggagagcugugugaagauacuaugaccuacaaaugcccacggauaacagagaccgaaccggacgauguggacuguuggugcaaugcgacugauacauggguaaccuaugggacguguagucaaacuggggagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcguugggaaacuggugcaucagauauucggaaccgcauacggcgucuuguuuuccggugugucuuggacuaugaagaucgggauuggcguacuccugacaugguuaggacugaauagccgaucaaccagucuauccaugacauguaucgcggugggccucguuacucuguaccuuggggucauggugcaggcugauagcggaugcgugaucaacuggaaaggccgcgaauugaagugugguucugggauuuucgucaccaaugagguucacacguggacagaacaauauaaguuucaggccgacucaccgaaaagacugagugcagccauaggaaaggcuugggaggagggcgugugcgguaucaggagcgccacccggcucgaaaacauuauguggaaacagaucuccaacgagcugaaucauauuuuacuggaaaacgacaugaaguucacugugguagucggcgauguggcagggauccuugcucagggcaagaagaugauacgcccucaacccauggaguacaaauauucuuggaagucguggggcaaggccaaaaucauuggggcggacguucagaauaccacauuuaucauugauggaccaaacacuccugaaugucccgacgaucagagagccuggaauaucugggagguggaggacuacggcuucgguauauuuaccacaaacauuugguugaagcucagggauagcuauacgcaggucugcgaccaccgucugauguccgcugcaaucaaagauucaaaggccgugcacgcugacaugggguacuggauugaaagugagaaaaaugaaaccuggaagcuagcccgggcaucuuucaucgagguuaagacuuguauauggccaaaaagccauacacugugguccaacggagugcucgaaucagagaugaucauucccaagaucuauggcgguccuauuagccaacacaauuaccgaccaggcuacuucacccagacugcggggccguggcaucugggaaaacuugaguuggauuuugaccugugcgaaggcacaaccguagucguggaugagcacugcgggaacagaggacccucuuuaaggacgacuaccgugacaggcaagaucauacacgaaugguguugccgcuccuguacccucccuccacugcgguucagaggugaggacgggugcugguauggaauggagauuaggcccgucaaagaaaaggaggaaaaucuuguuaagaguauggugagcgccggcucuggugagguagacuccuuuucacugggcuugcucuguaucaguaucauuaucgaagaggugaugcgcagccgauggucgcggaaaaugcugaugacugggacacuagcugucuucuuucugcucauuaugggacagcugaccuggaacgaucuuauacguuugugcaucauggugggcgccaaugcauccgacagaauggggaugggaacaacuuaccuggcuuuaauggccaccuucaagaugaggccuauguuugcaguuggccuccuguuccgccggcuuacgucuagagaggugcugcuacucacaauuggucugagcuuggucgccucaguggaacugccaaacaguuuagaggaacucggggauggacuggcuaugggcaucaugauucuuaaacuguugaccgacuuucaaucccaucagcucugggcgacucugcuaucucugaccuucaucaagacaacuguuagccuucacuaugccuggaaaaccauggcaauggugcucuccauagucucacuguuucccuugugucugagcacgacaagucagaagaccacuugguuaccgguacuccugggcucucuugggugcaagccucugacaauguucuugaucgcugagaauaaaauuuggggaaggcgauccuggccacucaacgaagguaucauggccgugggcauuguuagcauccugcuaucgucacugcuuaagaacgaugugccccucgccgggccucugauagcuggaggcauguugauugcauguuacgucaucucugguaguuccgccgacuuaagccuggagaaagcggcugaggugucuugggaagaggaagccgagcauagcggggcaucccacaauauccucguagaagugcaggaugacggaaccaugaagauuaaagaugaggagcgcgacgauacucugacaauacuucugaaggccaccuugcuagcugucucaggcguuuauccccugaguaucccagcaacgcucuuugugugguacuucuggcagaagaagaagcagcggagcggcgugcugugggacacuccuucucccccagaagucgagagagccgugcuugaugacgggauuuauaggaucaugcagcguggauuacugggucgcucccagguuggcguagggguguuccaagaaaacgucuuucauaccauguggcacgugacacggggagcgguucucauguaccagggcaaaagauuggagccgucaugggcuagugugaagaaagaccugauuagcuacggugggggauggaggcuccagggcuccuggaauaccggcgaggaaguccaggugaucgccguagagccugggaagaaccccaaaaauguccaaacagcaccaggaacuuucaagacccccgaaggugaggugggcgccauagcucuggauuuuaagccugggacgucuggaucgccaaucguuaaccgagaaggcaaaauugugggucuuuaugggaauggagucgugacaacuagcggcaccuacguuucagccaucgcacaggcuaaggccucccaggagggcccccugccugagauugaagacgagguguuccggaaacgcaacuugacaaucauggaucuacacccggggaguggaaagaccagaagguaucugccagcgauaguccgggaagccauuaaacgaaagcucagaacuuuaauccuggcacccacccgcgugguagcuucugagauggccgaagcucuuaaggguaugccuaucagguaccaaacaacggcagugaaaagcgagcauacuggcaaggagauuguugaccugaugugccacgccaccuuuacaaugcgucucuuguccccaguccgggugcccaauuauaacaugaucauaauggaugaagcccauuucaccgacccuucaucuauugcugcgagaggguacaucagcacuagggugggaaugggcgaggcagccgcuauuuuuaugacagccaccccgcccgguagugucgaagcauucccacaguccaaugccguaauccaggaugaggaacgcgacauaccugagcgaagcuggaacucuggguaugaguggauuacggauuuucccggaaaaacugugugguucguuccaucaaucaaguccggcaaugacaucgcuaacugucugaggaaaaauggcaagcgggugauucagcucaguaggaagacauuugauaccgaauaccagaaaaccaagaacaacgacugggacuacgucgugacuacagauaucagcgagaugggggcgaauuuccgcgccgaccguguuauugauccuagacggugccugaaacccgugauacuuaaggacggaccagaaagggucauccuagcagguccgaugccugugaccguagcuucggccgcacagcgccgaggcagaauugggcggaaccacaauaaagagggagaucaguauaucuacaugggccagccccugaacaaugacgaggaucaugcccacuggacagaagcuaagauguuguuagacaacaucaauacuccagaggguauuauacccgcccuguucgaaccugagagggaaaagucugcggcaaucgauggggaguaucgccucagaggcgaggccaggaaaacguuuguggaacugaugcggcguggagaccuuccaguuuggcuguccuacaaggucgcuagcgagggcuuccaauauucagaucgccgauggugcuuugacggggaaagaaacaaucaggugcucgaggaaaacauggauguggagauuuggaccaaagagggagaaaggaagaaauugcggccccgcuggcuggacgccagaacauacagugacccucuagcucugagggaguucaaggaauuugcagccggucggcgaucugucuccggcgaucucauccuugagauugggaaacugccgcagcacuuaacucagagagcucaaaaugccuuggacaaccugguuaugcuccauaauagcgaacagggaggccgcgcauauaggcacgcgauggaggagcugccagauaccaucgaaacacuuaugcugcucgccuugauagcugugcugaccggugggguaacuuuauucuuucuaucaggccggggacugggcaagacgaguaucgggcuccuuugugugauggccagcuccguccuguuguggauggcaucuguggagccccauuggauugcugccagcaucauucuggaguucuuucucaugguucugcuuaucccugagcccgaccgucagagaaccccacaggauaaccaacucgcauacguggucauaggacuguuguucaugauucugacaguagccgcuaaugagauggguuuacuagaaacuaccaagaaagaccugggcaucgggcacguggcgguugagaaccaccaucacgccgcaaugcucgauguggaccuucauccugcuuccgccuggacacuguacgccgucgcaaccacuauuaucacacccaugaugaggcacacgauagaaaacaccacugcuaauaucucauugacagccauugcgaaccaggcugccauccugaugggacucgauaagggcuggccaauuucuaaaauggacaucggugugccucugcuugcauuagggugcuauagucaggucaauccgcugacccucaccgccgcuguguugaugcugguugcacauuacgccauaauuggccccggacuacaagcgaaggcuacacgcgaggcccagaaacggacugcagccggcaucaugaagaacccaacgguggaugggaucguagcuauugaccuggauccuguggucuaugacgccaaguuugaaaaacagcucggacagaucaugcuucugauauuguguaccucgcaaauucugcucaugcgaacaacuugggcacugugcgagagcaucaccuuagcuacaggcccccuuaccacucugugggaggguuccccagggaaguucuggaauacgacaauugccguuucuauggcgaacaucuuuagaggaucauaccucgccggcgcaggucuagcuuucagccugaugaaauccuugggcgggggaaggcgcggcaccggggcccagggagaaacucugggcgagaaguggaaacggcagcucaaucagcuuaguaagucugaguucaacaccuauaagagaagcgguauaauggagguggaccguucagaagcaaaagaggggcugaagaggggagagacaacuaaacacgcugucucccggggcaccgccaaguugcgcugguuuguggaacgaaaucugguaaaaccugaggguaaggugaucgaucucggcugugggagaggaggcuggaguuacuauugcgccggguuaaagaaaguuacagaagugaagggauacacgaaaggcggucccgggcacgaggaaccgauuccaauggcgaccuacggauggaaccuggucaaacuucauagcggcaaagacguguucuuuaucccucccgagaagugugauacucugcuaugcgacauuggcgagucuuccccaaaucccacaaucgaagaggggaggacccuccggguccugaaaaugguggaaccuugguugcgcggaaaccaauucuguauuaagauccugaauccguauaugcccucaguuguagagacucucgagcagaugcagagaaagcacgguggcaugcuugugaggaacccacugagccgaaauucgacacaugaaauguacugggucucuugcgggaccggaaacauagugagugcuguuaauaugacgucccggauguuacugaaccguuuuaccauggcacacagaaaaccuacauaugagcgcgauguggacuugggcgccgguacuaggcacgucgcuguggaacccgagguagccaaccucgauauuaucgggcagcggaucgaaaauauuaagcaugagcacaaaagcaccuggcauuacgacgaggauaacccuuauaagacaugggcauaccacggaucauaugaagugaaaccauccggcucugccagcaguaugguuaauggcgucgugaagcugcuaacuaagcccugggacgugauaccuauggucacccaaaucgcuaugacagauaccacuccauucgggcagcagagaguuuuuaaagagaagguggacacgcgcacacccaaagcgaagaggggaaccgcccaaauuauggaaguaacugcaaaauggcuuugggguuuccugucccgaaacaagaagccgcggaucuguaccagagaggaauuuacaaggaaagugcgcagcaaugcugccauuggcgcagucuucguggacgagaaccaguggaacucugccaaggaggcuguugaagaugagcguuuuugggaccucgugcaucgggaaagagagcugcacaaacaggggaagugcgccacgugcgucuacaacaugaugggaaaaagggaaaagaaguugggcgaguucgguaaagcgaaggggucacgcgcaaucugguacauguggcugggagcccgauuucucgaguucgaagcucuuggcuucaugaaugaggaucacugguuuagucgggaaaacucccugagcggcguggagggggagggauuacauaaacuggguuauauauugagagacaucucuaagauuccuggcgggaauauguacgccgaugacaccgcaggaugggauacuaggaucacagaagacgaucuccagaacgaggcucgcauuaccgacaucauggaaccagagcacgcccugcuagcuaaaucgauauucaaacuuacuuaucaaaauaaaguaguuagagugcagcggcccgccaagaacggcacagucauggaugugauuucaaggcgugaccagcgagguagcggacaggugggaaccuacggccugaauacauuuacuaacauggaagcacaacucauccgccagauggaguccgagggcaucuucaguccuucugaacuggagaccccaaacuuggcggaaagagucuuagauuggcuggagaaguaugggguugaacggcucaaaaggauggccauuagcggagacgacugugugguaaagcccauagaugaccgcuuugcuacggcccuuaccgcacugaaugauauggguaaagugagaaaggacaucccgcagugggagccuuccaaaggcuggaacgauuggcagcaaguccccuucugcucacaucacuuucaccagcuaauuaugaaggacgggcgggagaucgugguuccauguaggaaucaggaugaacuggugggacgagcucgugucagucagggcgccgguuggucucucagagagacagcaugcuugggaaagagcuacgcccaaauguggcagcugauguauuuccaucgccgggaccuuaggcuggcggcuaacgccauuuguuccgcagugccuguagauuggauccccacuucaagaaccacauggagcauacacgcccaucaccaguggaugacuaccgaagacaugcucucuguuuggaaucgcguguggaucgaggaaaacccauggauggaggauaaaacgcauauuuccaguuggggagacguccccuacuuaggcaagcgggaggaccaauggugcggcagccugaucggguugacagcuagggccaccugggcaacuaauauucagguggcuaucaaccagguucgaagacugauuggaaaugaaaacuaccucgauuauaugacaucgaugaaacgguuuaagaaugagggugacccugaaggcgcccuuugguga

SEQ ID NO: 13553 - RNA, 9879 nt, Artificial Sequence
  derived and/or modified CDS sequence (opt3) from DENV-1__EU660402__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcaucgacgcgccuugcaaaauuccauuuucuacgcaagaugaaaagggggugacacagaacggacgccuuaucaccgcaaaucccauaguaacugacaaagagaagccugucaacauugaagccgagccacccuucggcgaguccuauaucgugaucggugcuggggaaaaagccuugaagcugucaugguuuaagaaaggcaguagcauuggaaagauguucgaggcaacagccagaggcgcuaggcggauggccauccucggggauaccgcaugggacuuuggauccauugguggcguuuucacuucuguggggaaacugguccaucagauauuuggaaccgcguacggcgugcuuuucagcgguguaucauggacaaugaagaucgggauuggcgugcuguugacguggcucggacugaauagucgauccaccagcuuaucuaugacuuguaucgcuguuggccuggucacacuauaccucggggugauggugcaggccgauucaggaugcgucaucaacuggaaaggccgcgaacugaagugugguagugggauuuuuguuaccaaugaggugcacacauggacugaacaauauaaguuccaggcagacagcccgaaaagacuuuccgccgcuauaggaaaggccugggaggagggcgugugcgguaucaggucugcaacccgguuggaaaacauuauguggaaacagaucucgaacgagcugaaucauauucuccuggaaaacgacaugaaguuaacgguagucgugggcgauguugcugggauccuggcccagggaaaaaagaugauacgcccucaacccauggaguacaaauauagcuggaagaucuggggcaaggcgaaaauuaucggggccgacgugcagaauacaaccuuuauuaucgauggaccaaacacuccugaaugucccgacgaucagagagcuuggaauauaugggaggucgaggacuacggcuucgguauuuuuaccacaaacaucuggcuuaaguugagggauuccuauacucaggugugcgaccaccgucucaugucagcagccauuaaagauaguaaggcuguucacgccgacaugggguacuggaucgaaucugagaaaaaugaaaccuggaagcuggcacgggcgagcuucauagaggugaagacauguaucuggccaaaaucccauacgcuauggucaaacggaguacuggaaagcgagaugauuauccccaagauuuauggcgguccuaucucucaacacaauuaccgaccaggcuacuucacccagacugccgggccguggcaucucggaaaacuggagcuugauuuugacuugugcgaaggcacaaccgucgugguggaugagcacugcgggaacagaggacccucccugaggacuacaaccgucacgggcaagauaauucacgaaugguguugccgcaguuguacuuuaccuccacuccgguucaaaggugaggacgggugcugguauggaauggagaucagacccguuaaggaaaaggaggaaaaucuggugaaaagcaugguaucugcuggcuccggugagguggacucauuuagucuuggccuguuguguaucagcauuaugaucgaagaggucaugaggucgcgcuggucccgaaagaugcucaugaccgggacacuggccguguucuuucuacugauuaugggacagcucaccuggaacgaucugauacggcuuugcaucaugguuggcgcaaaugcuuacgaccguauggggaugggaacuacauauuuggcccugauggcaaccuucaaaaugagaccuauguuugccgugggcuuacucuucaggcgccugacaucucgggagguccuucugcuaacuauuggucucagccugguggcuucaguugaauugccaaacagucuggaggaauuaggggauggacucgcgaugggcaucaugauucugaagcuucugaccgacuuucaaucccaucaguugugggccacgcuccugucucuaacauucaucagaaccacuuuuagccugcacuacgcauggaaaaccauggcuauggugcuuuccauagucucacucuucccccuguguuugagcacaacuagucagaagaccacguggcugccgguauuacucggcucucuggggugcaagccucuuacaauguuucugaucgccgagaauaaaauuuggggaaggaaguccuggccauugaacgaagguaucauggccgugggcauuguuagcauccuccugucgucacuacugaaaaacgaugugccccuugcugggccucucauagcaggaggcaugcugauugccuguuaugucaucucugguaguuccgcggacuugagcuuagagaaggcugccgaggugucuugggaagaggaagcagagcauagcggggccucccacaauauccugguagaagugcaggaugacggaaccaugaaaauuaaggaugaggagcgagacgauacucucacaauacugcuuaaagcuacccuguuggcagucucaggcguuuacccccuaaguaucccagccacucuguucgugugguauuucuggcaaaagaagaaacagcgcagcggcgugcucugggacacaccuucucccccagaagucgagcgggcggugcuggaugacgggauuuacagaaucaugcagaggggacuuuuaggucguucccagguuggcguagggguguuucaagaaaacgucuuccauaccauguggcacgugacgcgcggagcuguucugauguaccagggcaagcggcucgagccgucaugggccagugugaaaaaggacuugauuagcuauggugggggauggagacugcagggcuccuggaauacuggcgaggaaguccaggugaucgcaguagagccugggaaaaaccccaagaauguccaaaccgccccaggaacauuuaagaccucugaaggugaggugggcgcuauagcccucgauuucaaacccgggacaucgggaagcccuaucguuaacagggaaggcaagauugugggucuguacgggaauggagucgugacuaccucaggcacguauguuuccgcaaucgcucaggccaaagcgagucaggagggcccacuucccgagauugaagacgagguguuucgaaagcggaaccugacaaucauggauuugcacccugggucuggaaaaacucgcagauaccuaccggccauagucagggaagcaauuaagcggcgacugagaacccucaucuuagcuccaacacgcgugguagccagcgagauggcugaagcacugaaggguaugcccaucagguaucaaaccacugccgugaaauccgagcauaccggcaaggagauuguugaccuuaugugccacgccacauucacgaugcgucugcucucaccuguccgggugccaaauuacaacaugaucauaauggaugaagcucauuuuacugaccccucuagcauugcggcaagaggguauaucaguaccagggugggaaugggcgaggccgcugccauuuucaugacagcaaccccuccggguuccgucgaagccuuuccccagagcaaugcuguaauccaggaugaggaacgcgacauaccagagcgaucuuggaacucaggguacgaguggauuacugauuucccuggaaaaacagugugguuuguucccuccaucaagaguggcaaugacaucgcgaacuguuugagaaaaaauggcaagcgggugauucagcugagcaggaagaccuucgauacggaauaccaaaaaacuaagaacaacgacugggacuaugucgugacaaccgauaucucggagaugggggccaauuuccgcgcagaccguguuauugauccaagacggugccucaaaccugugauacugaaggacggacccgaaagggucauccuugcugguccaaugccggugaccguagccucugcagcccagcgccgaggcagaauugggcggaaccacaauaaagagggagaucaguacaucuauaugggccagccucuaaacaaugacgaggaucaugcucacuggacugaagccaagaugcuguuggacaacaucaauacacccgaggguauuauaccagcguuauuugaacccgagagggaaaaguccgcagccaucgauggggaguaccgccugagaggcgaggcuaggaaaaccuucguggaacucaugcggcguggagaccugccuguuuggcuuagccacaaggucgccucagagggcuuucaauauagugaucgccgauggugcuucgacggggaaagaaacaaucaggugcuggaggaaaacauggauguggagauuuggacaaaagagggagaaaggaagaaacuccggccacgcugguuggacgcuagaacuuacucugacccccuggcacuaagggaguuuaaggaauucgccgcuggucggcgauccgucagcggcgaucugauccucgagauugggaaacuuccucagcaucugacgcagagagcccaaaaugcauuagacaacuugguuaugcugcacaauucagaacagggaggccgcgcguauaggcaugccauggaggagcucccggauaccaucgaaacacugaugcuucuggcucucauagccguguugacuggugggguaaugcuguuuuucuuaaguggccggggacuaggcaagaccagcaucgggcugcucugugugauggcauccucuguccuucuguggauggcuagcguggagccacacuggauugccgcauccaucauuuuggaauuuuuccugaugguucuccugauccccgagccugaccgucagagaacaccccaggauaaccaacuugccuacguggucauaggacuccuguuuaugauuuugaccguagcugcgaaugagaugggucuguuagaaacuacgaagaaagaccuaggcaucgggcacguggccguugagaaccaucaccaugcagcuaugcuggauguggaccuccacccagccucagccuggacccuuuacgcagucgcuacaacuauuaucaccccuaugaugaggcauacaauagaaaacaccacugccaauaucucucugacagcgauugcuaaccaggccgcaaucuugaugggacuggauaagggcuggcccauuaguaaaauggacaucggugugccacuccuggcccuugggugcuauucgcaggucaauccuuuaacgcugaccgcugcagugcucauguugguugcccacuacgcgauaauuggcccgggacugcaagcuaaggccacucgcgaggcacagaaacggacagccgcuggcaucaugaagaaccccaccguggaugggaucguagccauugaccuagauccaguggucuaugacgcaaaguucgaaaaacagcugggacagaucaugcuccuuauacuguguaccagccaaauuuugcugaugcgaacaacuugggcucucugcgaguccaucacgcuggccaccggcccuuuaacaacucuuugggaggguucucccgggaaguuuuggaauaccacaauugcgguuucaauggccaacaucuucagaggaagcuaccuggcaggcgcuggucucgccuucucccuaaugaaaagucugggcgggggaaggcgcggcaccggggcacagggagaaacuuugggcgagaaguggaaacggcagcugaaucagcucucuaagagcgaauuuaacacguauaagagaucagguauaauggagguggaccguuccgaagcuaaagaggggcuuaagaggggagagacaaccaaacacgccgucagucggggcacugccaagcugcgcugguucguggaacgaaauuugguaaaaccagaggguaaggugaucgaucugggcugugggagaggaggcuggagcuacuauugcgcggggcucaagaaaguuaccgaagugaagggauacacaaaaggcgguccugggcaugaggaacccauuccgauggcuacuuacggauggaacuuagucaagcugcacucuggcaaagacguguuuuucaucccaccugagaagugugauacccuucugugcgacauuggcgaguccucacccaauccaacaaucgaagaggggaggacgcuacggguccucaaaaugguggaacccuggcugcgcggaaaccaauuuuguauuaagaucuugaauccuuauaugccgagcguuguagagacccuggagcagaugcagagaaagcaugguggcaugcucgugaggaacccccuuucgcgaaauucuacucacgaaauguacugggucaguugcgggacaggaaacauaguguccgcaguuaauaugaccagccggaugcuguuaaaccguuucacuauggcccacagaaaaccaacauaugagcgcgauguggaccugggcgcugguaccaggcaugucgccguggaaccugagguagcaaacuuggauauuaucgggcagcggaucgaaaauauuaagcacgagcauaaaucaacguggcacuacgacgaggauaaccccuauaagaccugggccuaccauggauccuaugaagugaaaccuucuggcagcgcuaguuccaugguuaauggcgucgugaagcuccugacaaagccaugggacgugauacccauggucacucaaaucgcgaugaccgauacaacuccuuuugggcagcagagaguuuucaaagagaagguggacacccgcacaccaaaagccaagaggggaaccgcacaaauuauggaaguaacugcuaaauggcuaugggguuuucuuagccgaaacaagaagccccggaucuguacgagagaggaauucacaaggaaagugcgcucuaaugccgcaauuggcgccgucuuuguggacgagaaccaguggaauucagcuaaggaggccguugaagaugagcguuucugggaccuggugcaccgggaaagagagcuccacaaacaggggaagugcgcgaccugcgucuacaacaugaugggaaaaagggaaaagaagcugggcgaguuugguaaagcaaaggggagucgcgccaucugguacaugugguugggagcucgauuccuggaguucgaagcccucggcuuuaugaaugaggaucauugguucucccgggaaaacagccuuucuggcguggagggggagggacugcacaaauuagguuauauacugagagacaucucgaagauuccgggcgggaauauguacgcagaugacacugcuggaugggauaccaggaucacagaagacgauuugcagaacgaggccaaaauuacggacaucauggaaccugagcaugcucuccuggccaagucaauauuuaaacuaaccuaucaaaauaagguaguucgcgugcagagaccagcaaagaacggcacugucauggaugugauuagccggagggaccagcgugguuccgggcaggugggaacauacggccuuaauaccuucacuaacauggaagcgcaacugauccgacagauggagagugagggcaucuuuucucccagcgaacucgagacaccuaaccuggccgggcgcgucuuggauugguuagaaaaacacggaguugagagacugaagcggauggcuauuuccggugacgacugugugguaaaaccaauagaugacagguucgccaccgcacucacagcucuuaaugauaugggcaaggugcgcaaagacaucccccagugggaaccgucaaagggguggaacgauuggcagcaagucccuuuuugcagucaccauuuccaccagcugauuaugaaggacggaagagagaucgugguucccugucggaaucaggaugagcuagugggcagggcccgagucucucagggugcaggguggagccugcgugaaacugccugccucggaaaauccuaugcgcaaauguggcaguugauguacuuucauagacgcgaccugcggcuugcugccaacgcaauuuguucagccgugccaguagauuggguuccuaccagcaggacgaccuggucuauccacgcucaucaccaguggaugacaacugaggacaugcuguccguguggaauagagucuggauagaagagaaccccuggauggaagauaagacccacgugaguagcuggggcgacguuccauaucucggcaaacgcgaggaccaauggugcgggucguuaaucggacugacagcccgggcaacuugggcuaccaauauucagguggccaucaaccaggucaggcgauugcuggguaaugagaacuaccucgauuacaugacguccaugaagagauucaaaaaugaaucugaccccgagggcgcgcuuugguga

SEQ ID NO: 13554 - RNA, 9879 nt, Artificial Sequence
  derived and/or modified CDS sequence (opt3) from DENV-1__EU660403__SS-prME
agcgugaccaugcugcucaugcuuaugcccacggcccuggcuuuccacuugacuacgagaggaggggaaccucauaugaucgucuccaagcaggaaagagggaaaucuuuacuguuuaagaccucagccgguguuaauaugugcacacuaauugccauggaccucggagagcugugugaagauacuaugaccuacaaaugcccacggauaacagagaccgaaccggacgauguggacuguuggugcaaugcgacugauacauggguaaccuaugggacguguagucaaacuggggagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcguugggaaacuggugcaucagauauucggaaccgcauacggcgucuuguuuuccggugugucuuggacuaugaagaucgggauuggcguacuccugacaugguuaggacugaauagccgaucaaccagucuauccaugacauguaucgcggugggccucguuacucuguaccuuggggucauggugcaggcugauagcggaugcgugaucaacuggaaaggccgcgaauugaagugugguucugggauuuucgucaccaaugagguucacacguggacagaacaauauaaguuucaggccgacucaccgaaaagacugagugcagccauaggaaaggcuugggaggagggcgugugcgguaucaggagcgccacccggcucgaaaacauuauguggaaacagaucuccaacgagcugaaucauauuuuacuggaaaacgacaugaaguucacugugguagucggcgauguggcagggauccuugcucagggcaagaagaugauacgcccucaacccauggaguacaaauauucuuggaagucguggggcaaggccaaaaucauuggggcggacguucagaauaccacauuuaucauugauggaccaaacacuccugaaugucccgacgaucagagagccuggaauaucugggagguggaggacuacggcuucgguauauuuaccacaaacauuugguugaagcucagggauagcuauacgcaggucugcgaccaccgucugauguccgcugcaaucaaagauucaaaggccgugcacgcugacaugggguacuggauugaaagugagaaaaaugaaaccuggaagcuagcccgggcaucuuucaucgagguuaagacuuguauauggccaaaaagccauacacugugguccaacggagugcucgaaucagagaugaucauucccaagaucuauggcgguccuauuagccaacacaauuaccgaccaggcuacuucacccagacugcggggccguggcaucugggaaaacuugaguuggauuuugaccugugcgaaggcacaaccguagucguggaugagcacugcgggaacagaggacccucuuuaaggacgacuaccgugacaggcaagaucauacacgaaugguguugccgcuccuguacccucccuccacugcgguucagaggugaggacgggugcugguauggaauggagauuaggcccgucaaagaaaaggaggaaaaucuuguuaagaguauggugagcgccggcucuggugagguagacuccuuuucacugggcuugcucuguaucaguaucauuaucgaagaggugaugcgcagccgauggucgcggaaaaugcugaugacugggacacuagcugucuucuuucugcucauuaugggacagcugaccuggaacgaucuuauacguuugugcaucauggugggcgccaaugcauccgacagaauggggaugggaacaacuuaccuggcuuuaauggccaccuucaagaugaggccuauguuugcaguuggccuccuguuccgccggcuuacgucuagagaggugcugcuacucacaauuggucugagcuuggucgccucaguggaacugccaaacaguuuagaggaacucggggauggacuggcuaugggcaucaugauucuuaaacuguugaccgacuuucaaucccaucagcucugggcgacucugcuaucucugaccuucaucaagacaacuuuuagccuucacuaugccuggaaaaccauggcaaugguucucuccauagugucacuguuccccuugugucugagcacgacaagucagaagaccacuugguuaccgguccuccugggcucucuugggugcaagccucugacaauguuuuugaucgcugagaauaaaauuuggggaaggcgauccuggccacucaacgaagguaucauggccguaggcauugugagcauccugcuaucgucacugcuuaagaacgauguuccccucgccgggccucugauagcuggaggcauguugauugcauguuacgugaucucugguaguuccgccgacuuaagccuggagaaagcggcugaggucucuugggaagaggaagccgagcauagcggggcaucccacaauauccucguggaaguacaggaugacggaaccaugaagauuaaagaugaggagcgcgacgauacucugacaauacuucugaaggccaccuugcuagcugugucaggcgucuauccccugaguaucccagcaacacucuucguuugguacuucuggcagaagaagaagcagcggagcggcgugcugugggacacuccuucucccccagaaguggagagagccguccuugaugacgggauuuauaggaucaugcagcguggauuacugggucgcucccaggugggcguugggguauuucaagaaaacguguuccauaccauguggcacgucacacggggagcggugcucauguaccagggcaaaagauuggagccgucaugggcuaguguuaagaaagaccugauuagcuacggugggggauggaggcuccagggcuccuggaauaccggcgaggaagugcaggucaucgccguggagccugggaagaaccccaaaaauguacaaacagcaccaggaacuuuuaagacccccgaaggugaggucggcgccauagcucuggauuucaagccugggacgucuggaucgccaaucgugaaccgagaaggcaaaauuguuggucuuuaugggaauggaguggucacaacuagcggcaccuacgugucagccaucgcacaggcuaaggccucccaggagggcccccugccugagauugaagacgagguuuuucggaaacgcaacuugacaaucauggaucuacacccggggaguggaaagaccagaagguaucugccagcgauagugcgggaagccauuaaacgaaagcucagaacuuuaauccuggcacccacccgcgucguggcuucugagauggccgaagcucuuaaggguaugccuaucagguaccaaacaacggcaguaaaaagcgagcauacuggcaaggagauuguggaccugaugugccacgccaccuucacaaugcgucucuuguccccaguucggguccccaauuauaacaugaucauaauggaugaagcccauuuuaccgacccuucaucuauugcugcgagaggguacaucagcacuagggugggaaugggcgaggcagccgcuauuuucaugacagccaccccgcccgguaguguggaagcauuuccacaguccaaugccgucauccaggaugaggaacgcgacauaccugagcgaagcuggaacucuggguaugaguggauuacggauuuccccggaaaaacuguaugguuugugccaucaaucaaguccggcaaugacaucgcuaacugucugaggaaaaauggcaagcggguuauucagcucaguaggaagacauucgauaccgaauaccagaaaaccaagaacaacgacugggacuacguggucacuacagauaucagcgagaugggggcgaauuuccgcgccgaccgugugauugauccuagacggugccugaaacccguuauacuuaaggacggaccagaaagggugauccuagcagguccgaugccugucaccguggcuucggccgcacagcgccgaggcagaauugggcggaaccacaauaaagagggagaucaguauaucuacaugggccagccccugaacaaugacgaggaucaugcccacuggacagaagcuaagauguuguuagacaacaucaauacuccagaggguauuauacccgcccuguuugaaccugagagggaaaagucugcggcaaucgauggggaguaucgccucagaggcgaggccaggaaaacguucguagaacugaugcggcguggagaccuuccaguguggcuguccuacaagguugcuagcgagggcuuucaauauucagaucgccgauggugcuucgacggggaaagaaacaaucagguccucgaggaaaacauggauguggagauuuggaccaaagagggagaaaggaagaaauugcggccccgcuggcuggacgccagaacauacagugacccucuagcucugagggaguuuaaggaguucgcagccggucggcgaucuguguccggcgaucucauccuugagauugggaaacugccgcagcacuuaacucagagagcucaaaaugccuuggacaaccuggucaugcuccauaauagcgaacagggaggccgcgcauauaggcacgcgauggaggagcugccagauaccaucgaaacacuuaugcugcucgccuugauagcuguucugaccgguggggugacuuuauuuuuccuaucaggccggggacugggcaagacgaguaucgggcuccuuuguguaauggccagcuccgugcuguuguggauggcaucugucgagccccauuggauugcugccagcaucauucuggaauuuuuccucauggugcugcuuaucccugagcccgaccgucagagaaccccacaggauaaccaacucgcauacguugugauaggacuguuguuuaugauucugacagucgccgcuaaugagauggguuuacuagaaacuaccaagaaagaccugggcaucgggcacguagcgguggagaaccaccaucacgccgcaaugcucgauguugaccuucauccugcuuccgccuggacacuguacgccguggcaaccacuauuaucacacccaugaugaggcacacgauagaaaacaccacugcuaauaucucauugacagccauugcgaaccaggcugccauccugaugggacucgauaagggcuggccaauuucuaaaauggacaucggugucccucugcuugcauuagggugcuauagucaggugaauccgcugacccucaccgccgcugucuugaugcugguggcacauuacgccauaauuggccccggacuacaagcgaaggcuacacgcgaggcccagaaacggacugcagccggcaucaugaagaacccaacgguugaugggaucguggcuauugaccuggauccuguaguguaugacgccaaguucgaaaaacagcucggacagaucaugcuucugauauuguguaccucgcaaauucugcucaugcgaacaacuugggcacugugcgagagcaucaccuuagcuacaggcccccuuaccacucugugggaggguuccccagggaaguuuuggaauacgacaauugccgucucuauggcgaacaucuucagaggaucauaccucgccggcgcaggucuagcuuucagccugaugaaauccuugggcgggggaaggcgcggcaccggggcccagggagaaacucugggcgagaaguggaaacggcagcucaaucagcuuaguaagucugaauuuaacaccuauaagagaagcgguauaauggagguugaccguucagaagcaaaagaggggcugaagaggggagagacaacuaaacacgcugugucccggggcaccgccaaguugcgcugguucgucgaacgaaaucuggugaaaccugaggguaagguaaucgaucucggcugugggagaggaggcuggaguuacuauugcgccggguuaaagaaagugacagaaguuaagggauacacgaaaggcggucccgggcacgaggaaccgauuccaauggcgaccuacggauggaaccuggugaaacuucauagcggcaaagacgucuuuuucaucccucccgagaagugugauacucugcuaugcgacauuggcgagucuuccccaaaucccacaaucgaagaggggaggacccuccgggugcugaaaauggucgaaccuugguugcgcggaaaccaauuuuguauuaagauccugaauccguauaugcccucagugguugagacucucgagcagaugcagagaaagcacgguggcaugcuuguaaggaacccacugagccgaaauucgacacaugaaauguacugggugucuugcgggaccggaaacauagucagugcugugaauaugacgucccggauguuacugaaccguuucaccauggcacacagaaaaccuacauaugagcgcgauguugacuugggcgccgguacuaggcacguggcugucgaacccgagguggccaaccucgauauuaucgggcagcggaucgaaaauauuaagcaugagcacaaaagcaccuggcauuacgacgaggauaacccuuauaagacaugggcauaccacggaucauaugaaguaaaaccauccggcucugccagcaguauggugaauggcguugucaagcugcuaacuaagcccugggacgugauaccuauggugacccaaaucgcuaugacagauaccacuccauuugggcagcagagagucuucaaagagaagguugacacgcgcacacccaaagcgaagaggggaaccgcccaaauuauggaagugacugcaaaauggcuuugggguuuucugucccgaaacaagaagccgcggaucuguaccagagaggaguucacaaggaaaguacgcagcaaugcugccauuggcgcaguguuugucgacgagaaccaguggaacucugccaaggaggcuguggaagaugagcguuucugggaccucguucaucgggaaagagagcugcacaaacaggggaagugcgccacgugcguguacaacaugaugggaaaaagggaaaagaaguugggcgaguuugguaaagcgaaggggucacgcgcaaucugguacauguggcugggagcccgauuccucgaguucgaagcucuuggcuuuaugaaugaggaucacugguucagucgggaaaacucccugagcggcgucgagggggagggauuacauaaacuggguuauauauugagagacaucucuaagauuccuggcgggaauauguacgccgaugacaccgcaggaugggauacuaggaucacagaagacgaucuccagaacgaggcucgcauuaccgacaucauggaaccagagcacgcccugcuagcuaaaucgauauuuaaacuuacuuaucaaaauaaagugguaagaguucagcggcccgccaagaacggcacagugauggaugucauuucaaggcgugaccagcgagguagcggacaggugggaaccuacggccugaauacauucacuaacauggaagcacaacucauccgccagauggaguccgagggcaucuuuaguccuucugaacuggagaccccaaacuuggcggaaagaguguuagauuggcuggagaaguauggggucgaacggcucaaaaggauggccauuagcggagacgacuguguugugaagcccauagaugaccgcuucgcuacggcccuuaccgcacugaaugauauggguaaaguaagaaaggacaucccgcagugggagccuuccaaaggcuggaacgauuggcagcaagugcccuuuugcucacaucacuuccaccagcuaauuaugaaggacgggcgggagaucgucgugccauguaggaaucaggaugaacugguuggacgagcucgugugagucagggcgccgguuggucucucagagagacagcaugcuugggaaagagcuacgcccaaauguggcagcugauguauuuucaucgccgggaccuuaggcuggcggcuaacgccauuuguuccgcagucccuguggauuggauccccacuucaagaaccacauggagcauacacgcccaucaccaguggaugacuaccgaagacaugcucucuguauggaaucgcguuuggaucgaggaaaacccauggauggaggauaaaacgcauauuuccaguuggggagacgugcccuacuuaggcaagcgggaggaccaauggugcggcagccugaucggguugacagcuagggccaccugggcaacuaauauucaggucgcuaucaaccaggugcgaagacugauuggaaaugaaaacuaccucgauuauaugacaucgaugaaacgguucaagaaugagggugacccugaaggcgcccuuugguga

SEQ ID NO: 13555 - RNA, 9879 nt, Artificial Sequence
  derived and/or modified CDS sequence (opt3) from DENV-1__EU660397__SS-prME
agcgugaccaugcugcucaugcuuaugcccaccgcccuggcuuuccacuugacuacgcggggcggggaaccucauaugaucgucuccaagcaggaaaggggaaagucuuuacuguuuaagaccucagccgguguuaauaugugcacgcuaauugccauggaccucggcgaacugugugaagauacuaugaccuacaaaugcccacggauuacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucuccgcgggauguccuaugugauguguaccgggagcuucaagcuggagaaagaagucgccgagacgcagcacgguacagugcuuguucagauaaaguacgagggcaccgacgcuccuugcaagaucccauucucgacucaagaugaaaaaggggugacacagaacggaagauugauuaccgcgaaucccaucguaacugacaaggagaaaccugucaacauagaagcagagccacccuuuggcgagucuuauauugugaucggugccggggaaaaggcucugaaacucuccugguucaagaagggcucaaguaucggaaaaauguuugaggccaccgcaaggggcgcccggcgaauggcuauucugggggauacagccugggacuucggaagcaucgguggcguuuuuacguccguggggaaacuuguccaucagauuuucggaaccgcauacggcgugcuguuuucugguguaagcuggacuaugaaaauagggaucggcguguugcucacauggcugggauuaaauucacgcaguaccucccugagcaugacauguauugcgguuggccuagucacucucuaccugggggugauggugcaggcugauucuggaugcgucaucaacuggaagggcagagaacuuaaaugugguucagggaucuucguuaccaaugaggugcacacguggacagaacaauauaaguuucaggccgacaguccgaagagguugagcgcagccauuggaaaggcuugggaggagggcgugugcgguauacgguccgccacccgccuggaaaacaucauguggaagcagauuucuaacgagcucaaucauauccuguuagaaaacgacaugaaauucacuguagucgugggcgauguugcagggauucuggcucagggaaagaaaaugaucagaccucaacccauggaguacaaguauucguggaaaagcuggggcaaggccaagauaaucggggcggacgugcagaauaccacauuuauuaucgauggaccaaacacuccugaaugucccgacgaucagagggccuggaauauuugggaggucgaggacuacggcuucgguaucuuuaccacaaacauauggcuuaaauugcgugauuccuauacacaggugugcgaccaccggcucaugucagcugcaauuaaggauaguaaagccguucacgcugacaugggguacuggaucgaaucugagaagaaugaaaccuggaaacuggcccgagcauccuucauugaggugaagacuuguaucuggccaaagucccauacacuauggucaaacggaguacuggaaagcgagaugauaauccccaaaauuuauggcgguccuaucucucaacacaauuacagaccaggcuacuucacccagacugcggggccguggcaucucggaaagcuggagcuugauuuugacuugugcgaaggcacaaccgucgugguggaugagcacugcgggaacaggggacccucccugcgcacgacuaccgucacaggcaaaauuauccacgaaugguguugccggaguuguaccuuaccuccacucagauucaggggugaggacgggugcugguauggaauggagauacgccccguuaaggaaaaagaggaaaaucugguaaagagcaugguaucugccggcuccggugagguggacucauuuagucuuggccuguuguguauuagcaucaugaucgaagaggucaugcgaucgcgguggucccguaagaugcucaugacugggacacuggcuguguucuuucuacugauuaugggacagcucaccuggaacgaucugaucagacuuugcauuaugguuggcgccaaugcaucugacaggauggggaugggaacaacuuacuuggcucugauggccaccuucaaaaugcgcccuauguuugcagugggcuuacucuuccggagacugacgagcagggagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaaaacaacuuuuucccugcacuaugccuggaagaccauggcaauggugcuuucaauugucagccucuucccccuguguuugaguacgacaucucagaaaaccacuuggcugccgguauuacucggcucccuggggugcaagccucuuacaauguuucugaucgcugagaauaagauauggggacgacgcagcuggccauugaacgaagguaucauggccgugggcauuguuucgauccuccugucaucucuacugaaaaacgaugugccccuugccgggccucucauugcuggaggcaugcugaucgcauguuacgucauaagugguuccagcgccgacuugucuuuagagaaggcggcugaggugagcugggaagaggaagccgagcauuccggggcaucacacaauauucugguagaagugcaggaugacggaaccaugaaaaucaaggaugaggagcgggacgauacucucacaauccugcuuaaagccacccuguuggcugucaguggcguuuauccccuaagcauuccagcaacgcuguucgugugguacuucuggcaaaagaaaaagcagagaucuggcgugcucugggacacuccuucacccccagaagucgagagggccgugcuggaugacgggauauaucguaucaugcagcgcggacuuuuaggucggagccagguuggcguagggguguuucaagaaaacgucuuccauaccauguggcacgugacaagaggagcgguucugauguaccagggcaagaggcucgagccgaguugggcuagcgugaaaaaggacuugauuuccuacggugggggauggcgacugcagggcucuuggaauaccggcgaggaaguccaggugaucgccguagagccugggaaaaaccccaagaauguccaaacagcaccaggaacuuuuaaaacccccgaaggugaggugggcgccauugcucucgauuucaagccugggacgucgggaagcccaaucguuaaccgggaaggcaagauagugggucuguaugggaauggagucgugacaacuucaggcaccuacguuuccgccaucgcacaggcuaaagccagucaggagggcccccuuccugagauugaagacgagguguuucgcaagagaaaccugacaaucauggauuugcacccggggucuggaaaaaccaggcgguaucuaccagcgauuguccgagaagccaucaagagaaaacugcgcacucucauauuagcacccaccagggugguagcuagcgagauggccgaagcucugaaggguaugccuauucguuaccaaacaacggcagugaaguccgagcauacuggcaaagagaucguugaccuuaugugccacgccaccuucacaaugcggcugcucucaccagucagagugcccaauuauaacaugaucauuauggaugaagcccauuuuaccgacccuucuagcaucgcugcgaggggguacauaaguacucgcgugggaaugggcgaggcagccgcuauuuucaugacagccaccccgcccgguuccgucgaagcauuuccacagagcaaugccguaauccaggaugaggaacgagacauuccugagagaucuuggaacucaggguaugaguggaucacggauuuccccggaaagacugugugguuuguuccauccauaaaaaguggcaaugacauugcuaacuguuugcggaagaauggcaaaagggugauccagcugagccgcaagacauucgauaccgaauaccaaaagaccaaaaacaacgacugggacuacgucgugacuacagauaucucggagaugggggcgaauuuccgugccgacagaguuauugauccucggaggugccucaagcccgugauccugaaagacggaccagaacgcgucauucuugcagguccgaugccugugaccguagcuucugccgcacagcgaagaggccggauagggaggaaccacaauaaggagggagaucaguauaucuacaugggccagccccuaaacaaugacgaggaucaugcccacuggacagaagcuaaaaugcuguuggacaacauuaauacuccagaggguaucauccccgccuuauuugaaccugagcgcgaaaaguccgcggcaauugauggggaguauagacugaggggcgaggcccggaagacguucguggaacucaugcgucgcggagaccugccaguuuggcuuagcuacaaagucgcuucagagggcuuucaauauagugaucgaagauggugcuucgacggggaaaggaacaaucaggugcuggaggaaaacauggauguggagauauggaccaaggagggagaacggaaaaagcuccgccccagaugguuggacgccaggacauacucugacccucuggcucuacgggaguuuaaagaguucgcagccggucgaagauccgucagcggcgaucugauccucgagauugggaaacuuccgcagcaccugacucagcgcgcucaaaaugccuuagacaacuugguuaugcugcauaauucagaacagggaggcagggcauaucggcacgcgauggaggagcucccagauaccaucgaaacacugaugcuucuggcccucauugcuguguugaccggugggguaacucuguuuuucuuaaguggccguggacuaggcaaaacgagcaucgggcugcucugugugauggccuccucuguccuucuguggauggcaagcguggagccccauuggauagcugccuccaucauuuuggaauuuuuccugaugguucuccugaucccugagcccgacagacagaggaccccacaggauaaccaacuugcauacguggucauuggacuccuguuuaugaucuugacaguagccgcuaaugagaugggucuguuagaaacuaccaagaaggaccuaggcauagggcacguggcgguugagaaccaccaucacgccgcaaugcuggauguggaccuccauccugcuucagccuggacacuuuacgccgucgcaaccacuauuaucacacccaugaugcgccacacgauugaaaacaccacugcuaauaucucucugacagccauagcgaaccaggcugccaucuugaugggacuggauaaaggcuggccaauuaguaagauggacaucggugugccucuccuggcacuugggugcuauucgcaggucaauccguuaacccugaccgccgcugugcucauguugguugcacauuacgccauuaucggccccggacugcaagcgaaagcuacacgggaggcccagaagcgaacugcagccggcauaaugaaaaacccaacgguggaugggauuguagcuaucgaccuagauccuguggucuaugacgccaaguucgaaaagcagcugggacagaucaugcuccuuauucuguguaccagccaaaucuugcugaugagaacaacuugggcacucugcgaguccauaacccuggcuacaggccccuuaaccacucuuugggaggguucuccagggaaauuuuggaauacgacaauugccguuucaauggcgaacaucuucaggggaagcuaccuggccggcgcaggucucgcuuucucccuaaugaagagucugggcgggggacgccggggcaccggggcccagggagaaacuuugggcgagaaauggaagagacagcugaaucagcucucuaaaagcgaauuuaacaccuauaagcguucagguauuauggagguggacagguccgaagcaaaggaggggcuuaaacggggagagacaacuaagcacgcugucagucgcggcaccgccaaacugcgaugguucguggaaagaaauuugguaaagccugaggguaaagugaucgaucugggcugugggaggggaggcuggagcuacuauugcgccgggcucaagaagguuacagaagugaaaggauacacgaagggcggucccgggcacgaggaaccgauaccaauggcgaccuacggauggaacuuagucaaacugcauucuggcaaggacguguuuuucaucccucccgagaaaugugauacucuucugugcgacauuggcgaguccucaccaaaucccacaaucgaagaggggcggacccuacgcguccucaagaugguggaaccuuggcugagaggaaaccaauuuuguauuaaaaucuugaauccguauaugcccagcguuguagagacucuggagcagaugcagaggaagcacgguggcaugcucgugcgaaacccacuuucgagaaauucuacacaugaaauguacugggucaguugcgggaccggaaacauuguguccgcuguuaauaugacgagccguaugcuguuaaacagauucaccauggcacaccgcaagccuacauaugagagggauguggaccugggcgccgguacucggcacgucgcuguggaacccgagguagccaacuuggauaucauagggcagagaauugaaaauaucaaacaugagcacaagucaaccuggcauuacgacgaggauaacccuuauaaaacaugggcauaccacggauccuaugaagugaagccaucuggcagcgccaguuccaugguuaauggcgucgugaaacuccugacuaagcccugggacgugaucccuauggucacccaaauugcuaugacagauaccacuccauuugggcagcagcgcguuuucaaggagaaaguggacacgaggacacccaaggcgaaacgaggaaccgcccaaauaauggaaguaacugcaaaguggcuaugggguuuucuuagccggaacaaaaagccgagaaucuguaccagggaggaguucacacgcaaggugcguucuaaugcugccauuggcgcagucuuuguggacgagaaccaguggaacucagccaaagaggcuguugaagaugagcgguucugggaccuggugcauagagaaagggagcuccacaagcaggggaaaugcgccacgugcgucuacaacaugaugggaaagcgcgagaagaagcugggcgaguuugguaaggcgaaagggagucgagcaaucugguacaugugguugggagcccgguuccuggaguucgaagcucucggcuuuaugaaugaggaucacugguucuccagagaaaacagccuuucuggcguggagggggagggacugcauaaguuagguuauauucugagggacaucucgaaaauaccuggcgggaauauguacgccgaugacaccgcaggaugggauacucgcaucacagaagacgauuugcagaacgaggcuagaauuaccgacaucauggaaccagagcacgcccuccuggcuaagucaauuuuuaaacuaacuuaucaaaauaagguaguucgggugcagaggcccgccaaaaacggcacagucauggaugugaucagccgucgagaccagcgcgguuccggacaggugggaaccuacggccuuaauacauucacuaacauggaagcacaacugauaagacagauggagagugagggcauauuuucuccuagcgaacucgagaccccaaaccuggcggaacgggucuuggauugguuagagaaguaugggguugaaaggcugaagcgcauggccaucuccggagacgacugugugguaaaacccaucgaugacagauucgcuacggcccucaccgcacuuaaugauauggguaaggugcggaaagacauuccgcagugggagccuucaaagggcuggaacgauuggcagcaaguccccuuuugcagucaucacuuccaccagcugauaaugaaagacgggagggagaucgugguuccaugucgaaaucaggaugagcuagugggacgugcuagagucucucagggcgccgguuggagccugcgcgagacagcaugccucgggaaguccuacgcccaaauguggcaguugauguauuuucaucggagggaccugagacuugcggcuaacgccauuuguucagcagugccuguagauuggauccccacuagccgcaccacauggucuauucacgcccaucaccaguggaugacuaccgaagacaugcuguccguuuggaaucggguguggaucgaggaaaacccauggauggaggauaagacgcauauaaguagcuggggagacguccccuaccucggcaaaagggaggaccaauggugcggcucguuaaucgggcugacagcucgagccaccugggcaacuaauauucagguggcuaucaaccagguuagacgguugauuggaaaugaaaacuaccuggauuauaugacauccaugaagagguucaaaaaugagucugacccugaaggugcccucugguga

SEQ ID NO: 13556 - RNA, 9879 nt, Artificial Sequence
  derived and/or modified CDS sequence (opt3) from DENV-1__EU687247__SS-prME
uccgugaccaugcugcucaugcuuaugcccacagcacuggcuuuccacuugacuacgagaggaggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggcaagaagaugauccgcccucaacccauggaguacaaauauagcuggaagauauggggcaaggcgaaaaucauuggggccgacgugcagaauaccacuuuuaucauugauggaccaaacaccccugaaugucccgacgaucagagagcuuggaauaucugggaggucgaggacuacggcuucgguauauuuacaacuaacauuuggcuuaaguugagggauuccuauacccaggugugcgaccaccgucucaugucagcagccaucaaagauaguaaggcuguucacgccgacaugggguacuggauugaaucugagaaaaaugaaacauggaagcuggcacgggcgagcuucaucgaggugaagacguguauauggccaaaaucccauacccuauggucaaacggaguacuggaaagcgagaugaucauucccaagaucuauggcgguccuauuucucaacacaauuaccgaccaggcuacuucacucagacagccgggccguggcaucucggaaaacuggagcuugauuuugacuugugcgaaggcaccacugucgugguggaugagcacugcgggaacagaggacccucccugaggacaaccacggucacuggcaagaucauacacgaaugguguugccgcaguuguaccuuaccuccacuccgguucaaaggugaggacgggugcugguauggaauggagauuagacccguuaaggaaaaggaggaaaaucuggugaaaagcaugguaucugcuggcuccggugagguggacucauuuagucuuggccuguuguguaucagcaucaugauugaagaggucaugaggucgcgcuggucccgaaagaugcucaugacagggacccuggccguguucuuucuacugaucaugggacagcucacuuggaacgaucugauucggcuuugcauaaugguuggcgcaaaugcuucugaccguauggggaugggaacaaccuacuuggcccugauggcaacauucaaaaugagaccuauguuugccgugggcuuacucuucaggcgccugacuagccgggagguccuucugcuaaccaucggucucucacugguggcuaguguugaauugccaaacucccuggaggaauuaggggauggacucgcgaugggcauuaugauccugaaacuucugacggacuuucaaucucaucaguugugggccacacuccugagccuaaccuucauuagaacuaccuuuucccugcacuaugcauggaaaacaauggcuauggugcuuucaaucgucagccucuucccccuguguuugaguacuaccucucagaagacgacauggcugccgguauuacucggcucccuggggugcaagccucuuaccauguuucugauagccgagaauaaaaucuggggaagaaagagcuggccauugaacgaagguauuauggccgugggcaucguuucgauucuccugucaucucuacugaaaaacgaugugccccuugcugggccucucaucgcaggaggcaugcugauagccuguuacgucauuagugguuccagcgcggacuugucuuuagagaaggcugccgaggugagcugggaagaggaagcagagcauuccggggccucacacaauauccugguagaagugcaggaugacggaacuaugaaaaucaaggaugaggagcgagacgauacacucaccauucugcuuaaagcuacucuguuggcagucaguggcguuuauccccuaagcauaccagccacacuguucgugugguacuucuggcaaaagaagaaacagcgcucuggcgugcucugggacaccccuucacccccagaagucgagcgggcggugcuggaugacgggaucuauagaauuaugcagaggggacuuuuaggucguagccagguuggcguagggguguuucaagaaaacgucuuccauacgauguggcacgugacucgcggagcuguucugauguaccagggcaagcggcucgagccgaguugggccagcgugaaaaaggacuugaucuccuacggugggggauggagacugcagggcucuuggaauaccggcgaggaaguccaggugauugcaguagagccugggaaaaaccccaagaauguccaaacagccccaggaaccuuuaagacaucggaaggugaggugggcgcuaucgcccucgauuucaaacccgggacuagcggaucaccuauaguuaacagggaaggcaagaucgugggucuguaugggaauggagucgugaccacguccggcacauacguuagugcaauugcucaggccaaagcgucucaggagggcccacuucccgagaucgaagacgagguguuucgaaagcggaaccugacuauuauggauuugcacccugggagcggaaaaacccgcagauaucuaccggccaucgucagggaagcaauaaagcggcgacugagaacacucauuuuagcuccaacccgcgugguagccuccgagauggcugaagcacugaaggguaugcccaucagguaccaaacuaccgccgugaaaucagagcauacaggcaaggagaucguugaccuuaugugccacgccacguucacuaugcgucugcucucuccuguccgggugccaaauuauaacaugauuaucauggaugaagcucauuuuaccgaccccagcaguauagcggcaagaggguacauuuccacaagggugggaaugggcgaggccgcugccaucuucaugaccgcaacuccuccggguagcgucgaagccuuuccccagucuaaugcuguaauucaggaugaggaacgcgacaucccagagcgaucauggaacuccggguaugaguggauaacagauuucccuggaaaaaccgugugguuuguucccaguauuaagagcggcaaugacaucgcgaacuguuugaggaaaaauggcaagcgggugauccagcugucgaggaagacguucgauacugaauaccagaaaacaaagaacaacgacugggacuacgucgugaccaccgauauuucugagaugggggccaauuuccgcgcagaccguguuaucgauccaagacggugccucaaaccugugauucugaaggacggacccgaaagggucauacuugcugguccaaugccggugacuguagccuccgcagcccagcgccgaggcagaaucgggcggaaccacaauaaagagggagaucaguauauuuacaugggccagccucuaaacaaugacgaggaucaugcucacuggacagaagccaagaugcuguuggacaacaucaauacccccgaggguaucauuccagcguuauuugaacccgagagggaaaagagcgcagccauagauggggaguaucgccugagaggcgaggcuaggaaaacauucguggaacucaugcggcguggagaccugccuguuuggcuuucauacaaggucgccagugagggcuuucaauauucugaucgccgauggugcuucgacggggaaagaaacaaucaggugcuggaggaaaacauggauguggagaucuggacuaaagagggagaaaggaagaaacuccggccacgcugguuggacgcuagaacguacuccgacccccuggcacuaagggaguuuaaggaguucgccgcuggucggcgaagcgucucaggcgaucugauucucgagaucgggaaacuuccucagcaccugacccagagagcccaaaaugcauuagacaacuugguuaugcugcauaauagugaacagggaggccgcgcguauaggcacgccauggaggagcucccggauacaauugaaacucugaugcuucuggcucucaucgccguguugaccggugggguaacacuguuuuucuuaagcggccggggacuaggcaagaccuccauagggcugcucugugugauggcaucuagcguccuucuguggauggcuuccguggagccacauuggaucgccgcaucaauuaucuuggaauuuuuccugaugguucuccugauucccgagccugaccgucagagaacuccccaggauaaccaacuugccuacguggucaucggacuccuguuuaugauauugacgguagcugcgaaugagaugggucuguuagaaaccacaaagaaagaccuaggcauugggcacguggccguugagaaccaccaucacgcagcuaugcuggauguggaccuccauccagccucugccuggacucuuuacgcagucgcuaccacaaucauuaccccuaugaugaggcacacuaucgaaaacacaacggccaauauaagucugaccgcgaucgcuaaccaggccgcaauuuugaugggacuggauaagggcuggcccaucucgaaaauggacauuggugugccacuccuggcccuugggugcuauagccaggucaauccuuuaacucugacagcugcagugcucauguugguugcccauuacgcgaucauaggcccgggacugcaagcuaaggccacccgcgaggcacagaaacggaccgccgcuggcauuaugaagaaccccacaguggaugggaucguagccaucgaccuagauccaguggucuaugacgcaaaguucgaaaaacagcugggacagauuaugcuccuuauccuguguacuucccaaauauugcugaugcgaacgaccugggcucucugcgagucuauuacacuggccacuggcccuuuaaccacacuuugggaggguucacccgggaaguuuuggaauaccacuaucgcgguuagcauggccaacauuuucagaggauccuaccuggcaggcgcuggucucgccuucagucuaaugaaaucucugggcgggggaaggcgcggcacgggggcacagggagaaacauugggcgagaaguggaaacggcagcugaaucagcucagcaagucagaauuuaacaccuauaagagauccgguaucauggagguggaccguagugaagcuaaagaggggcuuaagaggggagagacuaccaaacacgccgucagccggggcacagccaagcugcgcugguucguggaacgaaauuugguaaaaccagaggguaaggugauagaucugggcugugggagaggaggcuggucuuacuauugcgcggggcucaagaaaguuacugaagugaagggauacaccaaaggcgguccugggcacgaggaacccaucccgauggcuacauacggauggaacuuagucaagcugcauuccggcaaagacguguuuuucauuccaccugagaagugugauacgcuucugugcgacaucggcgagucaagccccaauccaaccauugaagaggggaggacucuacggguccucaaaaugguggaacccuggcugcgcggaaaccaauuuuguaucaagauuuugaauccuuauaugccgucgguuguagagacacuggagcagaugcagagaaagcacgguggcaugcucgugaggaacccccuuucucgaaauaguacccaugaaauguacugggucuccugcgggacuggaaacaucgugagcgcaguuaauaugacaucacggaugcuguuaaaccguuucaccauggcccacagaaaaccaacguaugagcgcgauguggaccugggcgcugguaccaggcacgucgccguggaaccugagguagcaaacuuggauauaauugggcagcggaucgaaaauaucaagcaugagcacaaauccacauggcauuacgacgaggauaaccccuauaagacuugggccuaccacggaucuuaugaagugaaaccuagcggcagugcuuccagcaugguuaauggcgucgugaagcuccugaccaagccaugggacgugauucccauggucacacaaauagcgaugacugauaccacaccuuuugggcagcagagaguuuucaaagagaagguggacacccgcacuccaaaagccaagaggggaacggcacaaaucauggaaguaacagcuaaauggcuaugggguuuucuuucucgaaacaagaagccccggauuuguaccagagaggaguucacuaggaaagugcgcucaaaugccgcaaucggcgccgucuuuguggacgagaaccaguggaauagugcuaaggaggccguugaagaugagcguuucugggaccuggugcaucgggaaagagagcuccacaaacaggggaagugcgcgaccugcgucuacaacaugaugggaaaaagggaaaagaagcugggcgaguuugguaaagcaaaggggucccgcgccauuugguacaugugguugggagcucgauuccuggaguucgaagcccucggcuuuaugaaugaggaucacugguucagccgggaaaacucucuuucgggcguggagggggagggacugcauaaauuagguuauauccugagagacauaucaaagaucccgggcgggaauauguacgcagaugacacagcuggaugggauacgaggauuaccgaagacgauuugcagaacgaggccaaaaucacugacauuauggaaccugagcacgcucuccuggccaagagcaucuuuaaacuaacauaucaaaauaagguaguucgcgugcagagaccagcaaagaacggcaccgucauggaugugauaucccggagggaccagcgugguaguggacaggugggaacuuacggccuuaauacauucaccaacauggaagcgcaacugauucgacagauggagucugagggcaucuuuagccccuccgaacucgagacaccuaaccuggccgggcgcgucuugaauugguuagaaaaacauggaguugagagacugaagcggauggcuaucucaggugaugacugugugguaaaaccaauugacgauagguucgccacugcacucaccgcucuuaacgacaugggcaaggugcgcaaagauauaccccagugggaaccgaguaagggguggaaugacuggcagcaagucccuuuuugcucucaccacuuccaucagcugaucaugaaggauggaagagagauugugguucccugucggaaccaggacgagcuagugggcagggcccgagucagccagggugcaggguggucccugcgugaaacggccugccucggaaaaucauaugcgcaaauguggcaguugauguacuuucacagacgcgaucugcggcuugcugccaaugcaaucuguagcgccgugccaguagacuggguuccuaccucuaggacaacuugguccauucaugcucaccaucaguggaugaccacagaggauaugcugaguguguggaacagagucuggaucgaagagaaucccuggauggaagacaagacucacgugagcucguggggcgauguuccauaucucggcaaacgcgaggaccaauggugcggguccuuaauaggacugaccgcccgggcaacgugggcuacaaacauccagguggccauuaaucaggucaggcgauugcuggguaacgagaauuaccucgacuacaugaccucuaugaagagauucaaaaacgaaucagaucccgagggcgcgcuuugguga

SEQ ID NO: 13557 - RNA, 9879 nt, Artificial Sequence
  derived and/or modified CDS sequence (opt3) from DENV-1__EU660412__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacauuaauugccauggaccucggcgagcugugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuuggacagggcaaaaagaugauccgcccucaacccauggaguacaaauauucguggaaaagcugggggaaggccaaaauaaucggagcggacgcccagaauacuaccuucauuaucgauggcccaaacacaccugaaugucccgacgaucagagagcuuggaauauuugggagguggaggacuacgguuuugggaucuucacuaccaacauaugguugaagcucagggauuccuauacacaggucugcgaccaccgucugaugucagcagccauuaaagauaguaaggcugugcacgccgacaugggauacuggaucgaaucugagaaaaaugaaacguggaagcuagcacgggcgagcuuuauugagguuaagaccuguaucuggccaaaaucccauacucuguggucaaacggcgugcucgaaagcgagaugauaauccccaagauuuaugguggcccuaucucucaacacaauuaccgaccaggguacuucacacagaccgccggaccguggcaucugggcaaacuugaguuggauuucgaccugugcgaagggacuacaguagucguggaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgucaaagaaaaggaggaaaaucuuguuaagagcauggugucugcugguuccggcgagguagacucauucagucugggguugcucuguauuagcaucaugaucgaagaggugaugcgcucgcgauggucccggaaaaugcugaugaccggaacucuagccgucuuuuuccugcucauuaugggccagcugacauggaacgaucuuauccguuugugcauuauggugggggcaaaugcuucugacagaaugggaaugggcaccacauaccuggccuuaauggcaacuuuuaagaugaggccuauguucgccguuggucuccuguuucgccggcuuaccagcagagaggugcugcuacucacgauagggcugucauuggucgcuaguguggaacugccaaacuccuuagaggaacucggagauggccuggcgaugggcaucaugauucuuaaacuguugacagacuuccaaucucaucagcucugggccacccugcuaagccugacuuuuaucaagaccacauucucccuucacuaugcauggaaaacuauggcuaugguucucucaauugugagccuguuucccuugugucugaguaccacgucucagaagacaaccugguuaccgguccuccuggggucccuuggaugcaagccucugacuauguucuugaucgccgagaauaaaauaugggguaggaaguccuggccacucaacgaaggcaucauggccguagggauugugucgauccugcuaucaucucugcuuaaaaacgauguuccccucgcuggaccucugauugcaggcgguauguugaucgccuguuacgugauaaguggguccagcgcggacuuaucucuggagaaggcugccgaggucagcugggaagaggaagcagagcauuccggagccucacacaauauucucguggaaguacaggaugacggcacaaugaaaaucaaggaugaggagcgagacgauacccugacuauccuucugaaagcuacauugcuagcagugaguggcgucuauccccugagcauuccagccacccucuuuguuugguacuucuggcaaaagaagaaacagcgcucuggggugcugugggacacgccuucacccccagaaguggagcgggcgguccuugaugacggaauauauagaaucaugcagagggguuuacugggccguagccagguggggguuggaguauuccaagaaaacguguuucauacuauguggcacgucacccgcggcgcugugcucauguaccaggguaagcgguuggagccgaguugggccagcguuaaaaaggaccugauuuccuacgggggaggcuggagacucaggggcucuuggaauacaggggaggaagugcaggucaucgcaguggagccuggcaaaaaucccaagaauguacagaccgccccagguacauucaagacucccgaaggcgaggucggggcuauugcccuggauuuuaaaccuggaaccucgggcagcccaaucgugaaccgagaagguaagauaguugggcuuuauggaaauggcguggucacgacaucaggcacuuacguguccgcaaucgcucaagccaaagcgagucaggaggggccccugccugagauugaagacgagguuuuccggaagcgcaacuugaccaucauggaucuacacccgggaucugguaaaacaagaagguaucugccagccauugugcgggaagcaaucaagcgaaagcucagaaccuuaauacuggcucccacucgcgucguggccagcgagauggcugaagcacuuaaaggcaugccuauuagguaccagaccacagccguaaaguccgagcauacggggaaagagaucguggaccugaugugccacgccacuuuuaccaugcgucucuugucaccaguucggguccccaauuauaacaugaucauuauggaugaagcucauuucacagacccuucuagcaucgcggcaagaggauacauaaguaccagggugggcaugggugaggccgcugccauuuuuaugacugcaacaccgcccggguccguggaagccuucccacaaagcaaugcugucauccaggaugaggaacgcgacauuccugagcgaucuuggaacucaggauaugaguggaucaccgauuuucccggcaagacgguaugguucgugccauccauaaaaaguggcaaugacauugcgaacugucugagaaagaaugggaagcggguuauccagcucagcaggaaaacuuuugauacagaauaccagaagaccaaaaacaacgacugggacuacguggucaccacugauaucucggagaugggagccaauuuccgcgcagaccgugugauugauccuagacggugccugaagcccguuauccuuaaagacgguccagaaagggugauucuagcuggcccgaugccugucacaguggccucugcagcccaacgccgagggagaauaggacggaaccacaauaaggagggcgaucaguauaucuacaugggucagccccugaacaaugacgaggaucaugcucacuggaccgaagccaagauguuguuagacaacauuaauacaccagaggggaucauccccgcgcuguucgaaccugagagggaaaaauccgcagccguagauggcgaguaucgccucagaggagaggcuaggaagacuuuuguggaacugaugcggcguggcgaccuuccaguuuggcugagcuacaaagucgccucagagggguuccaguauagugaucgccgauggugcuuugacggagaaagaaacaaucaagugcucgaggaaaacauggauguggagauuuggacgaaggagggugaaaggaaaaaguugcggccccgcuggcuggacgcuagaaccuacucugacccucuagcacugagggaguucaaagaauuugccgcuggccggcgauccgucagcggggaucucauacuugagaucggaaagcugccgcagcacuuaacacagagagcccagaaugcauuggacaaccugguuaugcuccauaauucagaacaaggcggucgcgcguauaggcacgccauggaggagcugccagauacuauugaaacccuuaugcugcucgcuuugaucgccgugcugacagggggcguaaccuuauucuuucuaaguggacggggccuggggaagacuagcauuggacuccuuugugugauggcauccucuguccuguuguggauggcuagcguggagccccauuggaucgccgcauccauaauccuggaguucuuucucaugguucugcuuauuccugagcccgaccgucagagaacgccacaggauaaccagcucgccuacguggucaucggucuguuguucaugauucugaccguagcugcgaaugagaugggcuuacuagaaacaacuaaaaaggaccuggggaucggacacguggccguugagaaccaccaucacgcagcuaugcucgauguggaccuucauccugccucagccuggacccuguacgcagucgcuacaaccauaauuacucccaugaugaggcacacaaucgaaaacacgaccgccaauauuucuuugacugcgaucgcuaaccaagccgcaauacugaugggccucgauaaagguuggccaaucaguaagauggacauuggggugccucugcuugccuuaggcugcuauucgcaggucaauccgcugacacucaccgcugcaguguugaugcugguugcccauuacgcgaucauuggacccggccuacaggcuaaagccacccgcgaggcacaaaagcggacagccgcugggaucaugaagaacccaacuguggauggaauaguagccauugaccuggauccuguggucuaugacgcaaaauuugaaaagcagcucggccagaucaugcuucugaucuuguguacgagccagauucugcucaugcgaaccacaugggcucugugcgaguccaucacuuuagccaccgguccccuuacaacccugugggaggggucuccaggaaaauucuggaauacuacgauagcgguuucaauggccaacauuuuuagaggcagcuaccucgcaggagcuggccuagccuucucccugaugaagagucuagggggaggcaggcgcgggacaggagcacaaggcgaaacccugggugagaaauggaagcggcagcucaaucagcuuucuaagagcgaguucaacacuuauaaaagaucagggaucauggagguggaccguuccgaagcuaaggagggacugaaaaggggcgagaccacaaagcacgccgucagucgggguacugccaaauugcgcugguuuguggaacgaaaucugguaaagccugagggcaaggugauugaucucggguguggaagaggcggguggagcuacuauugcgcgggacuaaagaagguuaccgaagugaaaggcuacacaaagggugggcccggacacgaggaaccgaucccaauggcuacguacggcuggaaccuggucaaacuucauucuggcaaggacguguucuuuauaccucccgagaaaugugauacccugcuaugcgacaucggggaguccucaccaaaucccacuauugaagagggaaggacacuccggguccugaagaugguggaaccuugguugcgcgguaaccaguucuguaucaagauucugaauccguauaugcccagcguuguagaggcacucgagcaaaugcagagaaaacacggcgggaugcuugugaggaacccacugucgcgaaauucuacccaugaaauguacugggucaguugcggaacuggcaacaucguguccgccguuaauaugacaagccggauguuacugaaccguuuuaccauggcucacagaaagccuacguaugagcgcgauguggacuuggguaccgggacaaggcacgucgccguggaacccgagguagcaaaccucgauauuaucggacagcggauagaaaauauuaaacaugagcacaagucaacuuggcauuacgacgaggauaacccuuauaaaaccugggccuaccacggcuccuaugaagugaagccaucuggcagcgcuaguuccaugguuaauggggucgugaagcugcuaacaaaacccugggacgugaucccuauggucacucagaucgcgaugaccgauacaaccccauucggacaacagagaguuuuuaaggagaaaguggacacucgcacgcccaaggccaaaagggguacagcacagauuauggaaguaaccgcucgauggcuuuggggcuuccugagccggaacaagaagccgagaauauguacuagggaggaauuuacccgcaaagugcguucuaaugccgcaaucggggccgucuucguggacgagaaccaauggaacucagcuaaggaggccguugaagaugagcgguuuugggaccucgugcauagagaaagggagcugcacaaacagggaaagugcgcgacaugcgucuacaacaugaugggcaaacgcgaaaagaaguugggugaguucgggaaagcaaagggaagucgagccauuugguacauguggcugggcgcucgguuucucgaguucgaagcccuuggcuucaugaaugaggaucacugguuuuccagagaaaacagccugucugggguggagggagaggguuuacauaaacugggcuauaucuugagggacauuucgaagaucccugggggaaauauguacgcagaugacacggcuggcugggauacccgcauaacugaagacgaucuccagaacgaggccaaaaucacagacauuauggaaccagagcacgcucugcuagccaaggcaaucuucaaacuuaccuaucagaauaagguaguuagagugcaacggcccgcgaagaacgguacugucauggaugugauuucaaggcgugaccagcgagggagcggacaggugggcacauacggccugaauaccuuuacaaacauggaagcccagcucauccgccaaauggaguccgaggggauauucaguccuucugaacuggagacuccaaacuuggcugaaagagccuuagauuggcuggagaaauauggagucgaacggcucaagaggauggcaauuagcggugacgacuguguugugaaacccaucgaugaccgcuuugcuaccgcccuuacggcacugaaugauaugggcaagguaagaaaagacaucccgcagugggagccuuccaagggguggaacgauuggcaacaggugcccuucugcucacaucacuuucaccaacuaauuaugaaggacggacgggagauagucgugccauguaggaaucaggaugaacugguuggccgagcccgugugagucagggugcgggguggucucucagagagaccgcuugcuugggaaaaagcuacgcccagauguggcaacugauguauuuccaucgccgggaccuuaggcuggcagccaacgcuaucuguuccgccgucccuguggauuggguacccacaucaagaacuaccuggagcauucacgcacaucaccaguggaugacaacugaagacaugcucucuguuuggaaucgcguguggaucgaggaaaacccauggauggaggauaagacccauauuuccaguugggaggacguccccuacuuaggcaaacgggaagaccaguggugcggcagccugaucggguugacggcuagggccacaugggcgaccaauauacaaguggcuaucaaccagguucgaagacugauuggaaaugagaacuaccucgauuauaugaucucgaugaagcgguuuaaaaaugaauccgacccugagggugcccuuugguga

SEQ ID NO: 13558 - RNA, 9879 nt, Artificial Sequence
  derived and/or modified CDS sequence (opt3) from DENV-1__EU660418__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucguguggcauuucuggcagaaaaagaagcagcggucuggcgugcucugggacacuccuucacccccagaagucgggagagccgugcuggaugacggaauauacaggaucaugcagcguggucuuuuaggccgcagccagguugggguaggaguguuucaagagaacgucuuccacaccauguggcacgugacacggggcgcgguucugauguaucaggguaaaagacucgaaccgaguugggcuagcgugaagaaagacuugauuuccuacgggggaggcuggaggcugcagggcucuuggaauaccggggaggagguccaggugaucgccguagaaccuggaaagaaccccaaaaauguccaaacagcaccagguacuuuuaagacccccgagggcgaagugggggccauugcucucgauuucaagccuggaacgucgggcagcccaaucguuaaccgagaggguaaaauaguggggcuguacggaaauggcgucgugacaacuucaggcaccuauguuuccgccaucgcacaggcuaaggccagucaggaagggccccuuccugagauugaggacgaaguguuucggaaacgcaaccugacaaucauggauuugcauccgggaucugguaagaccagaagguaccuaccagcgauuguccgggaggccaucaaacgaaagcugagaacucucauauuagcacccacccgcgugguagcuagcgaaauggccgaggcucugaagggcaugccuauuagguaucaaacaacggcagugaaauccgaacacacugggaaggagaucguugaccuuaugugccaugccaccuucacaaugcgucugcucucaccaguccgggugcccaauuacaacaugaucauuauggaugaggcccacuuuaccgacccuucuagcaucgcugcgagaggauauauaaguacuagggugggcaugggugaagcagccgcuauuuucaugacagccaccccgcccggguccgucgaggcauuuccacagagcaaugccguaauccaggaugaggaacgcgacauuccugaacgaucuuggaacucaggauacgaguggaucacggauuuccccggcaaaacugugugguuuguuccauccauaaagaguggcaaugacauugcuaacuguuugaggaaaaaugggaagcgggugauccagcugagcaggaagacauucgauaccgaguaucagaaaaccaagaacaacgacugggacuacgucgugacuacagauaucucggaaaugggagcgaauuuccgcgccgaccguguuauugauccuagacggugccucaaacccgugauccugaaggacgguccagagagggucauucuugcaggcccgaugccugugaccguagcuucugccgcacagcgccgagggagaauaggacggaaccauaauaaagaaggcgaucaguacaucuauaugggucagccccuaaacaaugacgaggaucacgcccacuggacagaggcuaagaugcuguuggacaacauuaauacuccagaagggaucauccccgccuuauuugagccugaaagggagaaguccgcggcaauugauggcgaauaccgccugagaggagaggccaggaaaacguucguggagcucaugcggcguggcgaccugccaguuuggcuuagcuauaaggucgcuucagaaggguuucaauacagugaucgccgauggugcuucgacggagagagaaacaaucaggugcuggaagagaacauggauguggaaauauggaccaaagagggugagaggaagaaacuccggccccgcugguuggacgccagaacauauucugacccucuggcucuaagggaauuuaaggaguucgcagccggccggcgauccgucagcggggaucugauccucgaaauuggaaaacuuccgcagcaucugacucagagagcucaaaaugccuuagacaacuugguuaugcugcacaauucagagcagggcggucgcgcauacaggcaugcgauggaggaacucccagauaccaucgagacacugaugcuucuggcccucauugcuguguugaccgggggcguaacucuguuuuucuuaaguggacggggccuagggaagacgagcaucggacugcucugugugauggccuccucuguccuucuguggauggcaagcguggaaccccacuggauagcugccuccaucauuuuggaguuuuuccugaugguucuccugaucccugaacccgaccgucagagaaccccacaggauaaccaacuugcauauguggucauuggucuccuguuuaugaucuugacaguagccgcuaaugagaugggccuguuagagacuaccaagaaagaccuagggauaggacacguggcgguugaaaaccaucaccaugccgcaaugcuggauguggaccuccacccugcuucagccuggacacuuuacgccgucgcaaccacuauuaucacacccaugaugaggcauacgauugagaacaccacugcuaauaucucucugacagccauagcgaaccaggcugccaucuugaugggccuggauaaggguuggccaauuaguaaaauggacaucggggugccucuccuggcacuuggcugcuacucgcaggucaauccguuaacccugaccgccgcugugcucauguugguugcacacuaugccauuaucggacccggccugcaagcgaaggcuacacgcgaagcccagaaacggacugcagccgggauaaugaagaacccaacgguggauggaauuguagcuaucgaccuagauccuguggucuacgacgccaaguucgagaaacagcugggccagaucaugcuccuuauucuguguaccagccaaaucuugcugaugcgaacaacuugggcacucugcgaauccauaacccuggcuacaggucccuuaaccacucuuugggaggggucuccaggaaaguuuuggaauacgacaauugccguuucaauggcgaacaucuucagaggcagcuaucuggccggugcaggccucgcuuucucccuaaugaaaagucuagggggaggcaggcgcgggaccggagcccagggcgagacuuugggugaaaaguggaaacggcagcugaaucagcucucuaagagcgaguuuaacaccuacaagagaucagggauuauggaaguggaccguuccgaggcaaaagaaggacuuaagaggggcgagacaacuaaacacgcugucagucgggguaccgccaagcugcgcugguucguggagcgaaauuugguaaaaccugaaggcaaggugaucgaucugggguguggaagaggcggguggagcuauuacugcgccggacucaagaaaguuacagaggugaagggcuauacgaaaggugggcccggacaugaggagccgauaccaauggcgaccuacggcuggaacuuagucaagcugcacucuggcaaagacguguuuuucaucccucccgaaaagugugauacucuucugugcgacauuggggaguccucaccaaaucccacaaucgaggaaggaaggacccuacggguccucaaaaugguggagccuuggcugcgcgguaaccaauuuuguauuaagaucuugaauccguacaugcccagcguuguagaaacucuggagcagaugcagagaaagcauggcgggaugcucgugaggaacccacuuucgcgaaauucuacacacgagauguauugggucaguugcggaaccggcaacauuguguccgcuguuaauaugacgagccggaugcuguuaaaccguuucaccauggcacacagaaaaccuacauacgaacgcgauguggaccugggugccgggacuaggcaugucgcuguggagcccgaaguagccaacuuggauaucauaggacagcggauugagaauaucaagcacgaacauaaaucaaccuggcacuaugacgaggauaacccuuacaagacaugggcauaucauggcuccuacgaggugaaaccaucuggcagcgccaguuccaugguuaauggggucgugaagcuccugacuaagcccugggacgugaucccuauggucacccaaauugcuaugacagauaccacuccauuuggacagcagagaguuuucaaagaaaagguggacacgcgcacacccaaagcgaagagggguaccgcccaaauaauggagguaacugcaaaauggcuauggggcuuucuuagccgaaacaagaagccgcggaucuguaccagagaagaguucacaaggaaagugcgcucuaaugcugccauuggggcagucuuuguggacgaaaaccaguggaacucagccaaggaggcuguugaggaugaacguuucugggaccuggugcaccgggagagagaacuccacaaacagggaaagugcgccacgugcgucuauaacaugaugggcaaaagggagaagaagcugggugaauuugggaaagcgaagggaagucgcgcaaucugguacaugugguugggcgcccgauuccuggaguucgaggcucucggcuuuaugaaugaagaucauugguucucccgggagaacagccuuucugggguggaaggagagggucugcacaaauuaggcuacauucugagagacaucucgaauauaccugggggaaacauguaugccgaugacaccgcaggcugggauacuaggaucacagaggacgauuugcagaaugaagcucgcauuaccgacaucauggagccagaacaugcccuccuggcuaagucaauuuuuaaacuaacuuaccaaaacaagguaguuagagugcagcggcccgccaaaaaugguacagucauggaugugaucagcaggcgugaccagcgaggguccggacaggugggcaccuauggccuuaacacauucacuaacauggaggcacaacugauacgccagauggaaagugaggggauauuuucuccuagcgagcucgaaaccccaaaucuggcggagagagucuuggauugguuagaaaaguacggaguugagcggcugaagaggauggccaucuccggugacgacugugugguaaaacccaucgaugaccgcuucgcuacggcccucaccgcacuuaacgauaugggcaaggugagaaaagacauuccgcagugggaaccuucaaagggguggaaugauuggcagcaaguccccuuuugcagucaccacuuccaucagcugauaaugaaagacggacgggagaucgugguuccauguaggaaccaggaugagcuagugggccgagcucgugucucucagggugccggguggagccugagagaaacagcaugccucggaaaguccuaugcccaaauguggcaguugauguacuuucaccgccgggaccugaggcuugcggcuaaugccauuuguucagcagugccuguagauuggauccccacuagcagaaccacauggucuauucaugcccaccaucaguggaugacuaccgaggacaugcuguccguuuggaaccgcguguggaucgaagagaauccauggauggaagauaagacgcacauaaguagcuggggcgacguccccuaucucggcaaacgggaggaccaauggugcgggucguuaaucggacugacagcuagggccaccugggcaacuaacauucagguggcuaucaaucagguucgaagauugauugguaacgagaauuaccuggauuacaugacauccaugaagcgguucaaaaacgaaucugacccugagggcgcccucugguga

SEQ ID NO: 13559 - RNA, 9879 nt, Artificial Sequence
  derived and/or modified CDS sequence (opt3) from DENV-1__EU677151__SS-prME
agcgugaccaugcugcucaugcuuauccccacagcccuggcuuuccacuugacuacgagaggcggggagccucauaugauugucuccaagcaggaaaggggaaaaucuuuacuguuuaagaccucagcagguguuaacaugugcacacuaauagccauggaccucggcgagcugugugaagauacuaugaccuacaaaugcccacggaucacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauucagaagguugaaacuugggcccucaggcacccuggauucaccgugaucgcucuguuucuggcacaugccauuggcacaucgaucacccagaagggcauaaucuucauucucuuaaugcuggucacgccaucaauggcuaugcggugcguggggaucggaagccgcgauuuuguagagggucuuaguggcgccacuuggguugacguggucuuggagcacggguccugugugacaaccauggcgaaagauaagcccacucuggacauugaacuacucaaaacagaggugaccaacccugcaguccugagaaagcuuugcaucgaagccaaaauaucuaauacgaccacagauagcagguguccaacucaaggagaggcuacccugguugaagagcaggacgccaacuucgugugccggcgcacauuuguagaucgaggcugggguaauggguguggauuguucggcaagggcucccucauuacuugcgcaaaguuuaaaugcgugaccaagcuggaggggaaaaucguccaguacgaaaacuuaaaguauucagugauuguuacagugcacaccggagaccagcaucaagucgguaaugagaguacugaacacggcacgacagcuaccaucacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauucagacguccggaaccacaacuauauuugcaggccauuuaaagugccggcugaaaauggauaagcuaacccucaaagggaugagcuaugucauguguacaggaucguucaagcuggagaaggaaguggccgagacucagcacgguaccguucuugugcagaucaaauacgagggcacggacgcuccuugcaagauuccauucucuacacaagaugaaaaagggguaacccagaacggacguuugaucacugcgaaucccauagucacagacaaggagaaaccugugaacauugaagcagagccacccuuuggcgaguccuauaucguuaucggugccggggaaaaggcucugaagcucucaugguucaaaaagggcaguagcauuggaaaaauguuugaggccaccgcacgcggcgccagaaggauggcuauccugggggauacugccugggacuucggauccauugguggcguguuuaccucugucgggaagcuugugcaucagauauucggaacagcauacggcguacuguuuagcggugugucauggacgaugaaaaucgggauuggcguuuugcucaccuggcugggauuaaauagucgguccacuagccugucuaugacauguaucgcggucggccuagugacccucuaccugggggugaugguccaggcugauucaggaugcguuaucaacuggaagggccgagaacuuaagugugguagugggauuuucgugacaaaugaggugcacacuuggaccgaacaauauaaauuucaggccgacagcccgaagcgcuuguccgcagccauaggaaaagcuugggaggagggcguaugcgguaucagaucugccacgaggcuggaaaacauuauguggcggcagaucucgaacgagcucaaucauauucuguuagaaaacgacaugaaguucacagucgugguuggcgauguggucgggauccuggcacagggaaaaaagaugauacgcccucaacccauggagcacaaauacagcuggaaguccuggggcaaggcuaaaaucauuggggccgacgugcagaauaccacuuuuaucauugauggaccaaacaccccugaaugucccgacgaucagagagcguggaauaucugggagguugaggacuauggcuucgguauauuuacaacuaacauuuggcuuaaguugagggauucauacacccaggugugcgaccaccgucucaugagugccgcuaucaaagauucuaaggcaguacaugccgacaugggguauuggauugaaagcgagaaaaaugaaacauggaagcuggcucgggccuccuucaucgaggucaagacguguauauggccaaaaucacacacccuauggagcaacggagugcuggaaucugagaugaucauucccaagaucuacggcgguccuauuucccaacauaauuaucgaccaggcuacuucacucagacagcagggccguggcaccucggaaaacuggagcuugauuuugacuugugcgaaggcaccacuguggucguugaugagcacugcgggaacagaggagcgagucugaggacaaccacggugacuggcaagaucauacaugaaugguguugccgcagcuguaccuuacccccucuccgguucaaaggugaggacgggugcugguacggaauggagauuagaccaguaaaggaaaaggaggaaaaucuggugaaaucuauggucuccgccggcucaggugagguggacaguuuuagccuuggccuguuguguaucucgaucaugauugaagagguuaugaggucccgcuggucucgaaagaugcucaugacagggacccuggcuguguucuuucuacugaucaugggacagcucacuuggaacgaucugauucggagcugcauaauggucggcgccaaugcaucagaccguauggggaugggaacaaccuaucuugcuuugauggccacauucaaaaugagacccaugguggcaguuggccuguuauuuaggcgccucacuagucgggaggugcugcuucugaccaucggucuaucccucgucgccucuguagaacugccuaacagcuuggaggaacugggggauggauuagcuaugggcauuaugauccucaagcugcuuacggacuuccaauccuaccagcugugggcgacauugcucucacugaccuuuauuaaaacuaccuucagccuacacuaugccuggaagacaauggcaauggugcugaguaucguuucucuucucccacuguguuuguccacuaccagccagaagacgacauggcugcccguguuacucggcucgcuggggugcaaaccgcuuaccauguuucugauagcugagaauaagaucuggggaagaaaaucauggccuuugaacgaagguauuauggccgucggcaucgugucuauucuccugaguucccuacugaagaacgauguaccacuugccgggccccucaucgcuggaggcaugcugauagcauguuacgugauuagcgguucuagcgccgacuuguccuuagagaaagcggcugaggucucaugggaagaggaagccgagcauaguggggcaagccacaauauccugguugaagugcaggaugacggaacuaugaagaucaaagaugaggagagggacgauacacucaccauucugcuuaaggccacucuguuggcugugucuggcgucuauccucuauccauacccgcaacacuguucgugugguacuuuuggcaaaagaaaaagcagcgaucaggcguucucugggacaccccaaguccucccgaaguagagcgcgccgugcuggaugacgggaucuaucggauuaugcagagaggacuuuuagguaggagccaggucggcguggggguuuuccaagaaaacguguuccauacgauguggcacgucacucguggagcggugcugauguaccagggcaaacgccucgagccauccugggcuucuguaaagaaagacuugaucucguacggugggggauggcggcugcagggcagcuggaauaccggcgaggaaguccaggugauugccguugagccggggaagaacccuaagaaugugcaaacagcacccggaaccuuuaaaacaccagaaggugaggucggcgccaucgcucucgauuucaagcccgggacuucaggauccccuauagugaacagagaaggcaaaaucguuggucuguaugggaauggaguggucaccacgaguggcacauacgugucugccauugcacaggcuaaggccagccaggagggcccacuucccgagaucgaagacgagguauuuaggaaacgaaaccugacuauuauggauuugcacccuggguccggaaagacccggcgcuaucuaccggcgaucgugagagaagccauaaagaggaaacugcggacacucauuuuagcaccaacccgaguugucgcuucagagauggccgaagcucugaaggguaugcccaucagauaccaaacuaccgcagugaaaucugagcauacaggccgcgagaucguggaccuuaugugccacgccacguucacuaugaggcugcucagcccuguccguguaccaaauuauaacaugauuaucauggaugaagcccauuuuaccgaccccaguuccauagcugcgcggggguacauuagcacaagagugggaaugggcgaggcagccgcuaucuucaugaccgccacuccuccggguucuguugaagcauuuccccagucaaaugccgugauucaggaugaggaaagggacaucccagagcgcuccuggaacaguggguaugaguggauaacagauuucccuggaaagaccgucugguuugugcccagcauuaaaucgggcaaugacaucgcuaacuguuugcgaaagaauggcaagagaguuauccagcugucucggaaaacguucgauacugaauaccaaaagacaaaaaacaacgacugggacuacguggucaccaccgauauuuccgagaugggggcgaauuuuagggccgaccgcgugaucgauccacguagaugccucaagccuguaauucugaaagacggacccgaacgggugauacuugcagguccaaugccgguuacugucgcuagcgccgcacagaggcgcggccgaaucgggagaaaccacaauaaggagggagaucaguauauuuacaugggccagccucuaaacaaugacgaggaucaugcccacuggacagaagcuaagaugcuguuggacaacaucaauacccccgaggguaucauuccagccuuauucgaacccgagcgggaaaaaucagcggcaauagauggggaguauaggcugcgcggcgaggccagaaagacauucguggaacucaugaggcggggagaccugccuguguggcuuaguuacaaagucgcuucugagggcuuucaauauuccgaucgucgcuggugcuucgacggggaacgaaacaaucagguucuggaggaaaacauggauguggagaucuggacuaaggagggagaaagaaaaaagcucaggccacggugguuggacgcccgcacguacagcgacccccuggcucuaagagaguuuaaagaauucgcagccgguaggcggucaguaaguggcgaucugauucucgagaucgggaagcuuccucagcaccugacccagcgagcucaaaaugccuuagacaacuuggugaugcugcauaauagcgaacagggaggcagagcauaucgccacgcgauggaggagcucccggauacaauugaaacucugaugcuucuggcccucaucgcugucuugaccgguggggugacacuguuuuucuuauccggcaggggacuaggcaagaccucuauagggcugcucuguguuauggccagcuccgcacuucuguggauggcuucaguggagccacauuggaucgccgcaucuauuaucuuggaauuuuuccugaugguccuccugauucccgagccugaccggcagcguacuccccaggauaaccaacuugccuacguagugaucggacuccuguuuaugauauugacgguugcugcgaaugagaugggucuguuagaaaccacaaaaaaggaccuaggcauugggcacguggccgucgagaaccaccaucacgcaacuaugcuggauguggaccuccauccagcuagugccuggacccuuuacgccgucgcaacaaccaucauuacuccuaugaugagacacacaaucgaaaacacgaccgcuaauauaucgcugacugccaucgcgaaccaggcugccauuuugaugggacuggauaaaggcuggcccaucagcaagauggacauuggugugccacuccuggcacuugggugcuauucccagguuaauccuuuaacacugaccgccgcugugcucauguugguagcacauuacgccaucauaggcccgggacugcaagcgaaagcuaccagggaggcccagaagcgcacagcagccggcauuaugaagaaccccacuguggaugggaucgucgcuaucgaccuagauccaguuguguaugacgccaaauucgaaaagcagcugggacagauuaugcuccuuauccuguguacgucucaaauauugcugaugcggaccacaugggcacucugcgagucaauuacucuggcuaccggcccuuuaacaacccuuugggaggguagccccgggaaauuuuggaauacuacgaucgccgucuccauggcgaacauuuuccgaggaaguuaccuggccggcgcaggucucgcuuuuucucuaaugaagagccugggcgggggaagaaggggcacaggggcccagggagaaaccuugggcgagaaauggaagcgccagcugaaucagcucucaaaguccgaauucaacacuuauaaacggagugguaucauggagguggacagaagcgaagcaaaggaggggcuucguaggggagagaccacaaaacacgcuguaucucggggcacugccaagcugcgcugguucguggaacgaaauuugguuaaaccagaggguaaggugauagaucugggcugugggagaggaggcugguccuacuauugcgccgggcucaagaaagucaccgaagugaagggauacacaaaaggcgguccugggcacgaggaacccaucccgauggcgacguacggauggaacuuagucaagcugcauucaggcaaagacguguuuuucauuccaccugagaagugugauacccuucugugcgacaucggcgagagcucgcccaauccaacuauugaagaggggaggacacuacggguucucaaaaugguagaacccuggcugcgcggaaaccaauuuuguaucaagauuuugaauccuuauaugccgucuguggucgagacccuggagcagaugcagagaaagcacgguggcaugcucgugaggaacccccuuagucgaaauuccacucaugaaauguacuggguuagcugcgggacaggaaacaucgugucagcugucaauaugaccucccggaugcuguuaaaccguuucacgauggcacacagaaaaccaaccuaugagcgcgauguggaccugggcgccgguacaaggcacguagcuguggaaccugagguugccaacuuggauauaauugggcagcggaucgaaaauaucaagcaugagcacaaaucuacuuggcauuacgacgaggauaaccccuauaagaccugggcauaccacggaagcuaugaagucaaaccuaguggcuccgccagcucuauggugaauggcguggucaagcuccugacaaagccaugggacguuauucccauggugacucaaauagcuaugaccgauacaaccccuuuugggcagcagagaguauucaaagagaagguggacacucgcacgccaaaagcgaagaggggaacagcccaaaucauggaagucaccgcacgauggcuaugggguuuucuuucacggaacaaaaagcccagaauuuguacuagggaggaauucacccgcaaggugcguaguaaugcugccaucggcgcaguuuuuguggacgagaaccaguggaauuccgccaaagaggcugucgaagaugagcgguucugggaccuggugcauagagaaagggagcuccacaagcaggggaaaugcgccacaugcguauacaacaugaugggaaagcgcgaaaaaaagcugggcgaguuugguaaggcgaaagggagccgagcaauuugguacaugugguugggagcccgguuccuggaguuugaagcucucggcuucaugaaugaggaucacugguucucuagagaaaacucgcuuucaggcguugagggggagggacugcauaaguuagguuauauccugagggacauaagcaaaaucccgggcgggaauauguacgccgaugacacggcaggaugggauacccgcauuacugaagacgauuugcagaacgaggcuaagaucacagacauuauggaaccugagcacgcccuccuggcuaccuccaucuuuaaacuaacuuaucaaaauaagguggucagagugcagcggccagccaggaacggcacagugauggaugucauaagucgucgagaccagcgcgguucugggcagguuggaaccuacggccuuaauacauucacuaacauggaagcacaacugauuagacagauggagagcgagggcaucuuuucccccucagaacucgagaccccuaaccuggcggaacggguguuggauugguuagagaaacaugggguagaaaggcugaagcgcauggccaucaguggagacgacuguguggucaagccaauugaugacagauucgcuacggcccucucugcacuuaaugauauggguaaagugcggaaggacauaccccagugggagccgagcaaaggcuggaacgauuggcagcaaguuccuuuuugcucccaccacuuccaucagcugaucaugaaggacgggagggagauugugguccccugucgaaaucaggaugaacuagugggacgugcuagaguaucacagggcgccgguuggagccugcgcgagaccgcaugccucgggaaaucuuaugcccaaauguggcaguugauguacuuucaccggagggaccugagacuugcggcuaacgccaucuguuccgcaguuccaguggauugggucccuacaagucgcacuaccuggagcauucaugcccaccaucaguggaugacaacugaagacaugcugucgguguggaaucggguuuggaucgaggaaaaccccuggauggaggauaagacccacauauccucuuggggagacgugccauaucucggcaagagggaggaccaauggugcggcucauuaaucgggcugacggcucgagccacaugggcaaccaauauucaggucgcuaucaaccaggugagacgguugauuggaaaugaaaacuaccuggauuacaugacuagcaugaaaagguucaagaaugagagugaccccgaaggugcccucugguga

SEQ ID NO: 13560 - RNA, 9879 nt, Artificial Sequence
  derived and/or modified CDS sequence (opt3) from DENV-1__EU677152__SS-prME
agcgugaccaugcugcuaaugcuuaugcccaccgcacuggcuuuccacuugacuacgagaggcggggaaccucauaugaucgucuccaagcaggaaagggggaagucuuuacuguuuaagaccucagccgguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggauuuaucggauaaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuaugggaauggagucgugacgacaaguggcacuuacguuucugcaauagcucaagccaaagcgagccaggagggcccacugcccgagaucgaagacgagguguucaggaagcgaaaccuuaccauuauggaucugcacccuggguccggaaagacacggcgcuauuugccggccaucgucagagaagcaauuaaaaggaagcuacggacccugauccucgcuccaacucgagugguagccucagagauggcugaagcauuaaaagguaugcccauaagauaccagaccacagccgugaagucugagcauacgggcaaagagauuguugaccugaugugccacgccacuuuuaccaugcgccuucugagcccugucagggugccaaauuauaacaugaucaucauggaugaagcucauuucacagaccccaguuccauugcggcacguggguacaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguaugaguggauuaccgauuuuccuggaaagacggugugguucguucccagcaucaagucgggcaaugacauagcgaacugucuccgcaaaaauggcaagcgagugauucaguugucuagaaaaacuuucgauacagaauaccagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccacaauaaagagggagaucaguauauauacaugggccagccucuuaacaaugacgaggaucaugcucacuggaccgaagccaagaugcuacuggacaacaucaauacacccgaggguauuaucccagcguuguucgaacccgagagagaaaaaucagcagccaucgauggggaguaucgguuaaggggcgaggcucgcaagacuuuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauuuggacgaaggagggagaacgaaagaaacugagaccaagguggcucgacgcucggaccuacagcgaccccuuggcacugcgcgaguucaaagaauuugccgcugguagaaggucagucaguggcgaucuaauacuggagaucgggaaacucccucagcaccuuacacagcgggcccagaaugcacuggacaacuuaguuauguugcauaauagcgaacaaggaggccgagcguauagacacgccauggaggagcugccggauacuauugaaacccucaugcugcuugcucugaucgccgugcucacaggugggguaaccuuguucuuucuguccggccgcggauuaggcaagacuucuauugggcuacugugugugauggcaagcuccguccuccuuuggauggcuucaguggagccacauuggaucgccgcaucuauaauccuggaguucuuuuugaugguucugcucauucccgagccugacaggcagcggacgccccaggauaaccagcuggccuacguggucaucggacuucucuucaugauucugaccguagcugcgaaugagauggguuugcuggaaacaacuaaaaaggacuuaggcaucgggcacgccgcaguggagaaccaccaucacgcugccaugcuagauguugaccugcauccagccagugcauggacccucuacgcuguggccacaaccauaauuacuccuaugaugcgucacacaaucgaaaacacgaccgcgaauauuucgcuuacugcuaucgccaaccaagcagccauacugaugggauuggauaaaggcuggcccaucagcaagauggacauuggugucccacugcucgcucuggggugcuauucccaggugaauccucuuacauuaaccgcagccguccugaugcucguggcgcauuacgcuaucauuggcccgggauugcaggccaaggcaaccagagaggcccagaagaggacagcugccggcaucaugaagaaccccacuguugaugggauaguggcaauugaccuggauccaguaguguaugacgcuaaauuugaaaagcagcuaggacagaucaugcugcucauccuuuguacgucucagauucuguugaugcgcaccacaugggcccugugcgagucaaucacucucgcgaccggcccucugacaaccuuaugggaggguagccccgggaaauucuggaauacuacgauagccgucuccauggcaaacauuuuccggggaaguuaccuugcuggcgccggucuggcauuuucucucaugaaaagccuaggcgggggacgaagaggcacaggggcucaaggagaaacccugggcgagaaguggaaaaggcaguugaaucagcugucaaaguccgaguucaacacuuauaaacgcagugguaucauggagguugaccggagcgaagccaaggaggggcucaaaagaggagagaccacaaagcacgccgugucucguggcacugcgaaacuuaggugguuugucgaacggaaucuggugaaaccagaggguaagguaauugauuugggcugugggcgcggaggcugguccuacuauugcgcugggcugaaaaaggugaccgaaguuaaaggauacacaaagggcgguccugggcacgaggaacccaucccgauggcaacguacggauggaaccucgugaaauuacauucaggcaaggacgucuucuuuauaccaccugagaagugugauacccugcuuugcgacaucggcgagagcucgcccaauccaacuauugaagaggggcgaacacugagagugcuaaaaauggucgaacccuggcucaggggaaaccaguucuguaucaagauucugaauccuuauaugccgucugugguugagaccuuggagcaaaugcagcggaaacacgguggcaugcugguacgcaacccccucaguagaaauuccacucaugaaauguacugggugagcugcgggacaggaaacaucgucucagccgugaauaugaccuccaggaugcuucugaaccgauuuacgauggcucaccggaagccaaccuaugagcgugauguugacuuaggcgccgguacaagacacguggcagucgaaccugagguggccaaccuggauauuaucgggcagcgcauagaaaauauuaaacaugagcacaagucuacuuggcauuacgacgaggauaaccccuauaagaccugggcuuaccacggaagcuaugaaguaaaaccuaguggcuccgcgagcucuauggugaauggcguugucaaguugcucacaaaaccaugggacgugauccccauggugacucagaucgccaugaccgauacaaccccuuucgggcaacagagggucuuuaaggagaaaguugacacucggacgccaaaggcaaagagaggaacagcucagauuauggaagugaccgccaaauggcugugggguuuccuaucacgcaacaagaaacccaggauauguacucgagaggaauuuacccggaagguaagaaguaaugcagccaucggcgcuguguucgucgacgagaaccaauggaacuccgccaaagaggcgguggaagaugagagguuuugggaccuuguucaucgcgaacgugagcugcacaagcaggggaagugcgcaacaugcguguacaacaugaugggaaaacgggaaaagaaacucggcgaguucgguaaggccaaagggagcagagcuauuugguacauguggcugggagccagguucuuggaguuugaagcacugggcuucaugaaugaggaucacugguuuucucgcgaaaacucgcucucaggcgucgagggggagggacuucauaagcuggguuauaucuuacgagacauuagcaaaaucccgggcgggaauauguacgcugaugacacggccggaugggauacccggauaacugaagacgaucugcagaacgaggcuaagaucacagacauuauggaaccugagcacgccuugcucgcaaaguccaucuucaaacugaccuaucagaauaaggugguaagaguucaaaggccagcgaaaaacggcacugugauggaugucauuagucgcagagaccagcgggguucuggacaggugggaacauacggccuaaauaccuuuacaaacauggaagcccagcuuaucaggcaaauggagagcgagggcauauucucccccucagaacuggagacuccuaaccucgcugggcgugugcuggauugguuggaaaagcauggagucgagcgauuaaaacgcauggccauuaguggugacgacuguguugugaagccaaucgaugacagauuugcaaccgcucugacggcccucaaugauaugggcaagguacggaaagacaucccccagugggaaccgucuaagggguggaacgauuggcaacaggugccuuucugcagccaccacuuucaucaacuuauuaugaaagacggaagggagauagucgugcccugucgcaaucaggaugagcugguuggcagagcacgggugucccagggugccggguggucacuaagggaaaccgcgugccugggaaagagcuaugcucagauguggcaacucauguacuuccaccgacgugacuugagacuggccgcaaacgccaucuguucugcugucccaguggauuggguaccuacaucccgcacuaccuggaguauucaugcccaccaucaguggaugacaacugaggacaugcuuagcguuuggaaucggguguggaucgaagagaaccccuggauggaagauaaaacccacauuucguccuggggcgacgucccauaucugggcaagagggaggaccaguggugcgggucucucaucggauuaacggcaagagcuacaugggccaccaauauacaaguggcgaucaaccagguucgccggcugauugguaaugagaacuacuuggauuacaugacuucaaugaagagguuuaaaaaugaaagcgaccccgagggcgcucugugguga

SEQ ID NO: 13561 - RNA, 9879 nt, Artificial Sequence
  derived and/or modified CDS sequence (opt3) from DENV-1__EU677155__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccgggaccucacacaauauucugguagaagugcaggaugacggaacuaugaagaucaaagaugaggagcgcgacgauacacucaccauccugcuuaaggcaacgcuguuggccgucaguggcguuuauccccuaagcauuccagcuacucuguucgugugguacuucuggcagaaaaagaagcagcggucuggcgugcucugggacaccccuucacccccagaagucgagagagcagugcuggaugacgggauauauaggaucaugcagcguggacuuuuaggucgcagccagguuggcguagggguguuucaagaaaacgucuuccauacaauguggcacgugacccggggagccguucugauguaccagggcaaaagacucgagccgaguugggcgagcgugaagaaagacuugauuuccuacggugggggauggaggcugcagggcucuuggaauacaggcgaggaaguccaggugaucgcuguagagccugggaagaaccccaaaaauguccaaacugccccaggaaccuuuaagacgcccgaaggugaggugggcgcaauugcccucgauuucaagccugggacaucgggaagcccaaucguuaaccgagaaggcaaaauagugggucuguaugggaauggagucgugacuaccucaggcacauacguuuccgcuaucgcccaggcaaaggcuagucaggagggcccccuuccugagauugaagacgagguguuucggaaacgcaaccugaccaucauggauuugcacccggggucuggaaagacuagaagguaucuaccagccauuguccgggaagcgaucaaacgaaagcugagaacccucauauuagcccccacacgcgugguagcaagcgagauggcugaagcccugaaggguaugccuauuagguaccaaacgacugcugugaaauccgagcauaccggcaaggagaucguugaccuuaugugccacgcaacauucaccaugcgucugcucucaccaguccgggugcccaauuauaacaugaucauuauggaugaagcccauuuuacugacccuucuagcaucgccgcuagaggguacauaaguacaagggugggaaugggcgaggcggcagccauuuucaugaccgcuacgccgcccgguuccgucgaagccuuuccacagagcaaugcaguaauccaggaugaggaacgcgacauuccugagcgaucuuggaacucaggguaugaguggaucacugauuuccccggaaaaacagugugguuuguuccauccauaaagaguggcaaugacauugccaacuguuugaggaaaaauggcaagcgggugauccagcugagcaggaagaccuucgauaccgaauaccagaaaacuaagaacaacgacugggacuacgucgugacaaccgauaucucggagaugggggcuaauuuccgcgcggaccguguuauugauccuagacggugccucaaacccgugauccugaaggacggaccagaaagggucauucuugccgguccgaugccugugacaguagcaucugcugcccagcgccgaggcagaauagggcggaaccacaauaaagagggagaucaguauaucuacaugggccagccccuaaacaaugacgaggaucaugcacacuggacugaagccaagaugcuguuggacaacauuaauacgccagaggguaucauccccgcuuuauuugaaccugagagggaaaaguccgccgcgauugauggggaguaucgccugagaggcgaggcaaggaaaaccuucguggaacucaugcggcguggagaccugccaguuuggcuuagcuacaaggucgccucagagggcuuucaauauagugaucgccgauggugcuucgacggggaaagaaacaaucaggugcuggaggaaaacauggauguggagauauggacaaaagagggagaaaggaagaaacuccggccccgcugguuggacgcuagaacuuacucugacccucuggcccuaagggaguuuaaggaguucgcugcaggucggcgauccgucagcggcgaucugauccucgagauugggaaacuuccgcagcaccugacccagagagcccaaaaugcuuuagacaacuugguuaugcugcauaauucagaacagggaggccgcgccuauaggcacgcaauggaggagcucccagauacaaucgaaacccugaugcuucuggcgcucauugccguguugacuggugggguaacgcuguuuuucuuaaguggccggggacuaggcaagaccagcaucgggcugcucugugugauggcuuccucuguccuucuguggauggccagcguggagccccauuggauagcagcuuccaucauuuuggaauuuuuccugaugguucuccugaucccugagcccgaccgucagagaacaccacaggauaaccaacuugccuacguggucauuggacuccuguuuaugaucuugacuguagcagccaaugagaugggucuguuagaaaccacaaagaaagaccuaggcauagggcacguggcuguugagaaccaccaucacgcggccaugcuggauguggaccuccauccugcaucagcuuggacccuuuacgccgucgccacuacaauuaucacgcccaugaugaggcacaccauugaaaacacuacagcaaauaucucucugaccgcuauagccaaccaggcggcuaucuugaugggacuggauaagggcuggccaauuaguaaaauggacaucggugugccucuccuggcccuugggugcuauucgcaggucaauccguuaacccugacagcagccgugcucauguugguugcucauuacgcaauuaucggccccggacugcaagccaaggcgacucgcgaggcucagaaacggacggccgcaggcauaaugaagaacccaaccguggaugggauuguagccaucgaccuagauccuguggucuaugacgcuaaguucgaaaaacagcugggacagaucaugcuccuuauucuguguacaagccaaaucuugcugaugcgaacuaccugggcccucugcgaguccauaacacuggcaaccggccccuuaacuacgcuuugggaggguucuccagggaaguuuuggaauacaaccauugcuguuucaauggccaacaucuucagaggaagcuaccuggcgggcgccggucucgcauucucccuaaugaaaagucugggcgggggaaggcgcggcacuggggcucagggagaaaccuugggcgagaaguggaaacggcagcugaaucagcucucuaagagcgaauuuaacacauauaagagaucagguauuauggagguggaccguuccgaagccaaagaggggcuuaagaggggagagacuaccaaacacgcagucagucggggcacagcuaagcugcgcugguucguggaacgaaauuugguaaaaccugaggguaaggugaucgaucugggcugugggagaggaggcuggagcuacuauugcgccgggcucaagaaaguuacggaagugaagggauacaccaaaggcggucccgggcacgaggaaccgauaccaauggccacuuacggauggaacuuagucaagcugcauucuggcaaagacguguuuuucaucccucccgagaagugugauacacuucugugcgacauuggcgaguccucaccaaaucccaccaucgaagaggggaggacucuacggguccucaaaaugguggaaccuuggcugcgcggaaaccaauuuuguauuaagaucuugaauccguauaugcccagcguuguagagacacuggagcagaugcagagaaagcacgguggcaugcucgugaggaacccacuuucgcgaaauucuacccaugaaauguacugggucaguugcgggacgggaaacauuguguccgcgguuaauaugaccagccggaugcuguuaaaccguuucacaauggcucacagaaaaccuacuuaugagcgcgauguggaccugggcgcagguaccaggcacgucgccguggaacccgagguagcuaacuuggauaucauagggcagcggauugaaaauaucaagcaugagcacaaaucaacauggcauuacgacgaggauaacccuuauaagacuugggccuaccacggauccuaugaagugaaaccaucuggcagcgcaaguuccaugguuaauggcgucgugaagcuccugaccaagcccugggacgugaucccuauggucacacaaauugccaugaccgauacuacgccauuugggcagcagagaguuuucaaagagaagguggacacacgcacccccaaagcuaagaggggaacugcgcaaauaauggaaguaaccgccaaauggcuaugggguuuucuuagccgaaacaagaagccgcggaucuguacaagagaggaguucacgaggaaagugcgcucuaaugcagcuauuggcgccgucuuuguggacgagaaccaguggaacucagcaaaggaggccguugaagaugagcguuucugggaccuggugcaucgggaaagagagcuccacaaacaggggaagugcgcuaccugcgucuacaacaugaugggaaaaagggaaaagaagcugggcgaguuugguaaagccaaggggagucgcgcgaucugguacaugugguugggagcacgauuccuggaguucgaagcccucggcuuuaugaaugaggaucacugguucucccgggaaaacagccuuucuggcguggagggggagggacugcauaaauuagguuauauucugagagacaucucgaagauaccuggcgggaauauguacgcugaugacacugccggaugggauacaaggaucaccgaagacgauuugcagaacgaggcacgcauuacugacaucauggaaccagagcacgcucuccuggccggcucaauuuuuaaacuaacauaucaaaauaagguaguuagagugcagcggcccgcuaaaaacgguaccgucauggaugugaucagcaggcgugaccagcgaggguccggacaggugggcacauacggccuuaauacuuucaccaacauggaagcccaacugauacgccagauggagagugaggggauauuuucuccuagcgaacucgagacgccaaaccuggcagaaagagucuuggauugguuagagaaguauggaguugaacggcugaagaggauggcgaucuccggugacgacugugugguaaaacccaucgaugaccgcuucgccaccgcucucacagcccuuaaugauaugggcaaggugagaaaagacauuccgcagugggagccuucaaagggguggaacgauuggcagcaaguccccuuuugcagucaucacuuccaccagcugauaaugaaagacggacgggagaucgugguuccauguaggaaucaggaugagcuagugggccgagcacgugucucucagggugcuggguggagccugagagagacugccugccucggaaaguccuacgcacaaauguggcaguugauguauuuucaucgccgggaccugaggcuugccgcgaacgcuauuuguucagccgugccuguagauuggauccccaccagcagaacaacuuggucuauucacgcacaucaccaguggaugaccacggaagacaugcuguccguuuggaaucgcguguggaucgaggaaaacccauggauggaggauaagacacauauaaguagcuggggcgacguccccuaccucggcaaacgggaggaccaauggugcgggucguuaaucggacugaccgccagggcuacuugggccacaaauauucagguggcaaucaaccagguucgaagauugauugguaaugaaaacuaccuggauuauaugaccuccaugaagcgguucaaaaaugagucugacccugaaggcgcucucugguga

SEQ ID NO: 13562 - RNA, 9879 nt, Artificial Sequence
  derived and/or modified CDS sequence (opt3) from DENV-1__EU677157__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuugguggauagaggcugggguaauggguguggacucuuuggcaaaggcucccugauaaccugcgcaaaguucaagugcguaacaaaauuagaggggaagauugugcaguacgaaaaccugaaauauucagucaucgugaccguucacacuggagaccagcaucaaguggguaaugagaguacggaacacggcacaaccgcuacuauuacaccccaagccccuaccaccgagauccagcucacugacuacggggcgcuuacacuggauuguagcccaaggacgggauuggacuuuaacgaaaugguccuacugaccaugaaggagaaaucuuggcucgugcauaagcagugguuccuggaucuuccgcugcccuggacuuccggcgccucaacaagccaagagaccuggaaucggcaggacuugcucguaacauuuaaaacugcacacgcuaagaagcaggaaguugugguccuggguagucaagagggggccaugcacaccgcuuuaacgggcgccaccgaaauccagacaucuggaacuaccacaauuuucgcaggccaucugaaaugccgucuaaagauggauaaacucacucugaaggggauguccuaugugauguguaccgggucguuuaaacuugagaaggaauuggccgagacgcagcacgguacaguccuggugcagauaaaguacgagggcaccgacgcuccuugcaaaaucccauucucgacucaagaugaaaaggggguuacacagaacggacgccucauuaccgcgaaucccaucgugacugacaaagagaagccuguaaacauagaagcagagccacccuucggcgagucuuauauugucaucggugccggggaaaaagcucugaaacuuuccugguuuaagaaaggcucaaguaucggaaagauguucgaggccaccgcaagaggcgccaggcggauggcuauucugggggauacagccugggacuuuggaagcaucgguggcguguucacguccguugggaaauuggugcaucagauuuuuggaaccgcauacggcguccucuucucuggugugagcuggacuaugaagauagggaucggcguacuguuaacauggcugggacuaaauucacgaaguaccucccucagcaugacauguauugcggugggccugguuacucuuuacuugggggucauggugcaggcugauucuggaugcgugaucaacuggaaaggccgcgaacugaagugugguucagggaucuuugucaccaaugagguucacacguggacagaacaauauaaguuccaggccgacaguccgaaaagacucagcgcagccauuggaaaggcuugggaggagggcgugugcgguauaagguccgccacccggcuggaaaacaucauguggaaacagauuucuaacgaguuaaaucauauccugcuugaaaacgacaugaaguuuacugugguagucggcgauguggcagggauuuuggcucagggcaagaagaugauccgcccucaacccauggaguacaaauauucguggaaaagcuggggcaaggccaagauaaucggggcggacguucagaauaccacauucauuaucgauggaccaaacacuccugaaugucccgacgaucagagagccuggaauauuugggagguggaggacuacggcuuugguaucuucaccacaaacauauggcucaagcugagggauuccuauacgcaggucugcgaccaccgucuaaugucagcugcaauuaaagauaguaaggccgugcacgcugacaugggguacuggaucgaaucugagaaaaaugaaaccuggaagcuggcccgggcauccuuuauugagguuaagacuuguaucuggccaaaaucccauacacucuggucaaacggagugcuggaaagcgagaugauaauccccaagauuuauggcgguccuaucucucaacacaauuaccgaccaggcuacuucacccagacugcggggccguggcaucuuggaaaauuggagcuggauuucgacuuaugcgaaggcacaaccguagucguggaugagcacugcgggaacagaggacccucccucaggacgacuaccgugacaggcaagauuauccacgaaugguguugccgcaguuguacccugccuccacuucgguuuagaggugaggacgggugcugguauggaauggagauaaggcccgucaaagaaaaggaggaaaaucugguuaagagcauggugucugccggcuccggugagguagacucauucaguuugggccuccuguguauuagcaucaugaucgaagaggugaugcgcucgcgauggucccggaaaaugcuaaugacugggacacuggcugucuuuuuccuccugauuaugggacagcuuaccuggaacgauuugauccgucugugcauuauggugggcgccaaugcaucugacagaauggggaugggaacaacuuacuuagcucucauggccaccuuuaagaugaggccuauguucgcaguuggccugcuuuuucgccggcugacgagcagagaggugcuacuccugacaauagguuugucacuggucgccaguguggaauuaccaaacucccucgaggaacugggggauggacuugcuaugggcaucaugauucugaaauugcucaccgacuuccaaucucaucagcugugggcgacucuacugagccuuaccuuuaucaagacaacuuucucccuccacuaugccuggaaaaccauggcaaugguucugucaauugugagcuuguuuccccuguguuuaaguacgacaucucagaagaccacuuggcucccgguccugcuuggcucccuggggugcaagccuuugacaauguuccucaucgcugagaauaaaauauggggaaggcgaagcuggccacugaacgaagguaucauggccguaggcauugugucgauccuacugucaucucuucucaagaacgauguuccccuggccgggccuuugauugcuggaggcauguuaaucgcauguuacgugauaagugguuccagcgccgaccugucucucgagaaagcggcugaggucagcugggaagaggaagccgagcauuccggggcaucacacaauauucugguggaaguacaggaugacggaaccaugaagaucaaagaugaggagcgcgacgauacucuuacaauccuguugaaggccacccuacuggcugugaguggcgucuauccccucagcauuccagcaacgcuguuuguuugguacuucuggcagaaaaagaagcagcggucuggcgugcuuugggacacuccuucacccccagaaguggagagagccgucuuagaugacgggauauauaggaucaugcagcguggacugcucggucgcagccaggugggcguugggguauuccaagaaaacguguuucauaccauguggcacgucacacggggagcgguguugauguaccagggcaaaagacuggagccgaguugggcuagcguuaagaaagaccucauuuccuacggugggggauggaggcugcagggcucuuggaauaccggcgaggaagugcaggucaucgccguggagccugggaagaaccccaaaaauguacaaacagcaccaggaacuuucaagacccccgaaggugaggucggcgccauugcucuugauuuuaagccugggacgucgggaagcccaaucgugaaccgagaaggcaaaauaguuggucuguaugggaauggaguggucacaacuucaggcaccuacguguccgccaucgcacaggcuaaggccagucaggagggccccuugccugagauugaagacgagguuuuccggaaacgcaaccuaacaaucauggaucugcacccggggucuggaaagaccagaagguaucucccagcgauugugcgggaagccaucaaacgaaaguuaagaacucugauacuugcacccacccgcgucguggcuagcgagauggccgaagcucugaaggguaugccuauuagguaccaaacaacggcaguaaaauccgagcauacuggcaaggagaucguggaccucaugugccacgccaccuuuacaaugcguuugcugucaccaguucggguccccaauuauaacaugaucauuauggaugaagcccauuucaccgacccuucuagcaucgcugcgagaggguacauaaguacuagggugggaaugggcgaggcagccgcuauuuuuaugacagccaccccgcccgguuccguggaagcauucccacagagcaaugccgucauccaggaugaggaacgcgacauuccugagcgaucuuggaacucaggguaugaguggaucacggauuuucccggaaaaacuguaugguucgugccauccauaaagaguggcaaugacauugcuaacugucucaggaaaaauggcaagcggguuauccagcugagcaggaagacauuugauaccgaauaccagaaaaccaagaacaacgacugggacuacguggucacuacagauaucucggagaugggggcgaauuuccgcgccgaccgugugauugauccuagacggugccuuaaacccguuauccuaaaggacggaccagaaagggugauucuggcagguccgaugccugucaccguggcuucugccgcacagcgccgaggcagaauagggcggaaccacaauaaagagggagaucaguauaucuacaugggccagcccuugaacaaugacgaggaucaugcccacuggacagaagcuaagauguuacuggacaacauuaauacuccagaggguaucauccccgcccucuucgaaccugagagggaaaaguccgcggcaauugauggggaguaucgccugagaggcgaggccaggaaaacguuuguagaacuuaugcggcguggagaccugccaguguggcucagcuacaagguugcuucagagggcuuccaauauagugaucgccgauggugcuuugacggggaaagaaacaaucaggucuuggaggaaaacauggauguggagauauggaccaaagagggagaaaggaagaaacugcggccccgcuggcuagacgccagaacauacucugacccucuggcucucagggaguucaaggaauuugcagccggucggcgauccgugagcggcgaucuuauccuggagauugggaaauuaccgcagcacuugacucagagagcucaaaaugcccuggacaaccucgucaugcugcauaauucagaacagggaggccgcgcauauaggcacgcgauggaggagcuuccagauaccaucgaaacacugaugcucuuggcccugauugcuguuuuaaccgguggggugacucuauucuuucugaguggccggggacucggcaagacgagcaucgggcuucuguguguaauggccuccucuguguugcuguggauggcaagcgucgagccccauuggauagcugccuccaucauucucgaguucuuucugauggugcuucucaucccugagcccgaccgucagagaaccccacaggauaaccaacuggcauacguugugauuggauugcuguucaugaucuuaacagucgccgcuaaugagaugggucuacuggaaacuaccaagaaagaccucggcauagggcacguagcgguggagaaccaccaucacgccgcaaugcuugauguugaccugcauccugcuucagccuggacauuguacgccguggcaaccacuauuaucacacccaugaugaggcacacgauugaaaacaccacugcuaauaucucucugacagccauagcgaaccaggcugccauccucaugggacuggauaagggcuggccaauuaguaaaauggacaucggugucccucuuuuagcacuggggugcuauagccaggugaauccgcucaccuugaccgccgcuguccugaugcuaguggcacauuacgccauuaucggccccggacugcaagcgaaggcuacacgcgaggcccagaaacggacugcagccggcauaaugaagaacccaacgguugaugggauuguggcuaucgaccucgauccuguaguguaugacgccaaguuugaaaaacagcuuggacagaucaugcuguugauucuguguaccagccaaauccuccugaugcgaacaacuugggcauuaugcgaguccauaacccuugcuacaggcccccugaccacucucugggaggguucuccagggaaguucuggaauacgacaauugccgucucaauggcgaacaucuuuagaggaagcuaccuagccggcgcaggucuggcuuucuccuugaugaaaagucugggcgggggaaggcgcggcaccggggcccagggagaaacucucggcgagaaguggaaacggcagcuuaaucagcugucuaagagcgaguucaacaccuauaagagaucagguauuauggagguugaccguuccgaagcaaaagagggguugaagaggggagagacaacuaaacacgcugugagucggggcaccgccaagcugcgcugguuugucgaacgaaaucucgugaaaccugaggguaagguaaucgauuuaggcugugggagaggaggcuggagcuacuauugcgccgggcugaagaaagugacagaaguuaagggauacacgaaaggcggucccgggcacgaggaaccgauaccaauggcgaccuacggauggaaccuugugaagcugcauucuggcaaagacgucuucuuuaucccucccgagaagugugauacucuacucugcgacauuggcgaguccucaccaaaucccacaaucgaagaggggaggacccugcggguguugaaaauggucgaaccuuggcugcgcggaaaccaauucuguauuaagauccucaauccguauaugcccagcgugguugagacucuugagcagaugcagagaaagcacgguggcaugcugguaaggaacccauuaucgcgaaauucuacacaugaaauguacugggugaguugcgggaccggaaacauugucuccgcugugaauaugacgagccggaugcuguugaaccguuuuaccauggcacacagaaaaccuacauaugagcgcgauguugaccucggcgccgguacuaggcacguggcugucgaacccgagguggccaaccuggauaucauagggcagcggauugaaaauaucaagcaugagcacaaaucaaccuggcauuacgacgaggauaacccuuauaagacaugggcauaccacggauccuaugaaguaaaaccaucuggcagcgccaguuccauggugaauggcguugucaagcuacuuacuaagcccugggacgugaucccuauggugacccaaauugcuaugacagauaccacuccauucgggcagcagagagucuuuaaagagaagguugacacgcgcacacccaaagcgaagaggggaaccgcccaaauaauggaagugacugcaaaauggcugugggguuuccucagccgaaacaagaagccgcggaucuguaccagagaggaauuuacaaggaaaguacgcucuaaugcugccauuggcgcaguguucgucgacgagaaccaguggaacucagccaaggaggcuguggaagaugagcguuuuugggaccugguucaucgggaaagagaguugcacaaacaggggaagugcgccacgugcguguacaacaugaugggaaaaagggaaaagaagcugggcgaguucgguaaagcgaaggggagucgcgcaaucugguacauguggcucggagcccgauuucuugaguucgaagcucugggcuucaugaaugaggaucacugguuuucccgggaaaacagcuuaucuggcgucgagggggagggacugcauaaauuggguuauauucucagagacaucucgaagauaccuggcgggaauauguacgccgaugacaccgcaggaugggauacuaggaucacagaagacgaucugcagaacgaggcucgcauuaccgacaucauggaaccagagcacgcccuacuugcuaaaucaauuuucaagcugacuuaucaaaauaaagugguaagaguucagcggcccgccaagaacggcacagugauggaugucaucagcaggcgugaccagcgagguuccggacaggugggaaccuacggccucaauacauuuacuaacauggaagcacaacugauacgccagauggagagugagggcauuuucucuccuagcgaauuggagaccccaaacuuagcgaagagagugcuggauuggcucgaaaaauauggggucgagcggcuuaagaggauggccaucuccggagacgacuguguugugaaacccaucgaugaccgcuuugcuacggcccugaccgcacuaaaugauauggguaagguaagaaaagacauuccgcagugggaaccuucaaagggcuggaacgauuggcagcaagugcccuucugcagucaucacuuucaccagcugauaaugaaggacgggcgggagaucgucgugccauguaggaaucaggaugagcucguuggacgagcucgugugucucagggcgccgguuggagcuugagagaaacagcaugccuggggaaauccuacgcccaaauguggcagcuuauguauuuccaucgccgggaccugaggcucgcggcuaacgccauuuguucagcagucccuguggauuggauccccacuagcagaaccacauggucuauucacgcccaucaccaguggaugacuaccgaggacauguuauccguauggaaucgcguuuggaucgaagagaacccauggauggaagauaagacgcauauaaguagcuggggagacgugcccuaccugggcaaacgggaggaccaauggugcggcucguugaucgggcugacagcuagggccaccugggcaacuaauauucaggucgcuaucaaccaggugcgaagacucauuggaaaugagaacuaccuugauuauaugacauccaugaagcgguuuaaaaaugaaucugacccugagggugcccugugguga

SEQ ID NO: 13563 - RNA, 9879 nt, Artificial Sequence
  derived and/or modified CDS sequence (opt3) from DENV-1__EU677158__SS-prME
agcgugaccaugcugcucaugcuuaugcccacagcccuggcuuuccacuugacuacgagaggaggggaaccucauaugaucgucuccaagcaggaaagagggaaaucuuuacuguuuaagaccucagccgguguuaauaugugcacacuaauugccauggaccucggagagcugugugaagauacuaugaccuacaaaugcccacggauaacagagaccgaaccggacgauguggacuguuggugcaaugcgacugauacauggguaaccuaugggacguguagucaaacuggggagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcguugggaaacuggugcaucagauauucggaaccgcauacggcgucuuguuuuccggugugucuuggacuaugaagaucgggauuggcguacuccugacaugguuaggacugaauagccgaucaaccagucuauccaugacauguaucgcggugggccucguuacucuguaccuuggggucauggugcaggcugauagcggaugcgugaucaacuggaaaggccgcgaauugaagugugguucugggauuuucgucaccaaugagguucacacguggacagaacaauauaaguuucaggccgacucaccgaaaagacugagugcagccauaggaaaggcuugggaggagggcgugugcgguaucaggagcgccacccggcucgaaaacauuauguggaaacagaucuccaacgagcugaaucauauuuuacuggaaaacgacaugaaguucacugugguagucggcgauguggcagggauccuugcucagggcaagaagaugauacgcccucaacccauggaguacaaauauucuuggaagucguggggcaaggccaaaaucauuggggcggacguucagaauaccacauuuaucauugauggaccaaacacuccugaaugucccgacgaucagagagccuggaauaucugggagguggaggacuacggcuucgguauauuuaccacaaacauuugguugaagcucagggauagcuauacgcaggucugcgaccaccgucugauguccgcugcaaucaaagauucaaaggccgugcacgcugacaugggguacuggauugaaagugagaaaaaugaaaccuggaagcuagcccgggcaucuuucaucgagguuaagacuuguauauggccaaaaagccauacacugugguccaacggagugcucgaaucagagaugaucauucccaagaucuauggcgguccuauuagccaacacaauuaccgaccaggcuacuucacccagacugcggggccguggcaucugggaaaacuugaguuggauuuugaccugugcgaaggcacaaccguagucguggaugagcacugcgggaacagaggacccucuuuaaggacgacuaccgugacaggcaagaucauacacgaaugguguugccgcuccuguacccucccuccacugcgguucagaggugaggacgggugcugguauggaauggagauuaggcccgucaaagaaaaggaggaaaaucuuguuaagaguauggugagcgccggcucuggugagguagacuccuuuucacugggcuugcucuguaucaguaucauuaucgaagaggugaugcgcagccgauggucgcggaaaaugcugaugacugggacacuagcugucuucgugcugcucauuaugggacagcugaccuggaacgaucuuauacguuugugcaucaugguuggcgccaaugcauccgacagaauggggaugggaacaacuuaccuggcuuuaauggccaccuuuaagaugaggccuauguucgcagugggccuccuguuucgccggcuuacgucuagagagguccugcuacucacaauuggucugagcuugguggccucaguugaacugccaaacaguuuagaggaacucggggauggacuggcuaugggcaucaugauucuuaaacuguugaccgacuuccaaucccaucagcucugggcgacucugcuaucucugaccuuuaucaagacaacuuucagccuucacuaugccuggaaaaccauggcaauggugcucuccauagucucacuguuucccuugugucugagcacgacaagucagaagaccacuugguuaccgguacuccugggcucucuugggugcaagccucugacaauguucuugaucgcugagaauaaaauuuggggaaggcgauccuggccacucaacgaagguaucauggccgugggcauuguuagcauccugcuaucgucacugcuuaagaacgaugugccccucgccgggccucugauagcuggaggcauguugauugcauguuacgucaucucugguaguuccgccgacuuaagccuggagaaagcggcugaggugucuugggaagaggaagccgagcauagcggggcaucccacaauauccucguagaagugcaggaugacggaaccaugaagauuaaagaugaggagcgcgacgauacucugacaauacuucugaaggccaccuugcuagcugucucaggcguuuauccccugaguaucccagcaacgcucuuugugugguacuucuggcagaagaagaagcagcggagcggcgugcugugggacacuccuucucccccagaagucgagagagccgugcuugaugacgggauuuauaggaucaugcagcguggauuacugggucgcucccagguuggcguagggguguuccaagaaaacgucuuucauaccauguggcacgugacacggggagcgguucucauguaccagggcaaaagauuggagccgucaugggcuagugugaagaaagaccugauuagcuacggugggggauggaggcuccagggcuccuggaauaccggcgaggaaguccaggugaucgccguagagccugggaagaaccccaaaaauguccaaacagcaccaggaacuuucaagacccccgaaggugaggugggcgccauagcucuggauuuuaagccugggacgucuggaucgccaaucguuaaccgagaaggcaaaauugugggucuuuaugggaauggagucgugacaacuagcggcaccuacguuucagccaucgcacaggcuaaggccucccaggagggcccccugccugagauugaagacgagguguuccggaaacgcaacuugacaaucauggaucuacacccggggaguggaaagaccagaagguaucugccagcgauaguccgggaagccauuaaacgaaagcucagaacuuuaauccuggcacccacccgcgugguagcuucugagauggccgaagcucuuaaggguaugccuaucagguaccaaacaacggcagugaaaagcgagcauacuggcaaggagauuguugaccugaugugccacgccaccuuuacaaugcgucucuuguccccaguccgggugcccaauuauaacaugaucauaauggaugaagcccauuucaccgacccuucaucuauugcugcgagaggguacaucagcacuagggugggaaugggcgaggcagccgcuauuuuuaugacagccaccccgcccgguagugucgaagcauucccacaguccaaugccguaauccaggaugaggaacgcgacauaccugagcgaagcuggaacucuggguaugaguggauuacggauuuucccggaaaaacugugugguucguuccaucaaucaaguccggcaaugacaucgcuaacugucugaggaaaaauggcaagcgggugauucagcucaguaggaagacauuugauaccgaauaccagaaaaccaagaacaacgacugggacuacgucgugacuacagauaucagcgagaugggggcgaauuuccgcgccgaccguguuauugauccuagacggugccugaaacccgugauacuuaaggacggaccagaaagggucauccuagcagguccgaugccugugaccguagcuucggccgcacagcgccgaggcagaauugggcggaaccacaauaaagagggagaucaguauaucuacaugggccagccccugaacaaugacgaggaucaugcccacuggacagaagcuaagauguuguuagacaacaucaauacuccagaggguauuauacccgcccuguucgaaccugagagggaaaagucugcggcaaucgauggggaguaucgccucagaggcgaggccaggaaaacguuuguggaacugaugcggcguggagaccuuccaguuuggcuguccuacaaggucgcuagcgagggcuuccaauauucagaucgccgauggugcuuugacggggaaagaaacaaucaggugcucgaggaaaacauggauguggagauuuggaccaaagagggagaaaggaagaaauugcggccccgcuggcuggacgccagaacauacagugacccucuagcucugagggaguucaaggaauuugcagccggucggcgaucugucuccggcgaucucauccuugagauugggaaacugccgcagcacuuaacucagagagcucaaaaugccuuggacaaccugguuaugcuccauaauagcgaacagggaggccgcgcauauaggcacgcgauggaggagcugccagauaccaucgaaacacuuaugcugcucgccuugauagcugugcugaccggugggguaacuuuauucuuucuaucaggccggggacugggcaagacgaguaucgggcuccuuugugugauggccagcuccguccuguuguggauggcaucuguggagccccauuggauugcugccagcaucauucuggaguucuuucucaugguucugcuuaucccugagcccgaccgucagagaaccccacaggauaaccaacucgcauacguggucauaggacuguuguucaugauucugacaguagccgcuaaugagauggguuuacuagaaacuaccaagaaagaccugggcaucgggcacguggcgguugagaaccaccaucacgccgcaaugcucgauguggaccuucauccugcuuccgccuggacacuguacgccgucgcaaccacuauuaucacacccaugaugaggcacacgauagaaaacaccacugcuaauaucucauugacagccauugcgaaccaggcugccauccugaugggacucgauaagggcuggccaauuucuaaaauggacaucggugugccucugcuugcauuagggugcuauagucaggucaauccgcugacccucaccgccgcuguguugaugcugguugcacauuacgccauaauuggccccggacuacaagcgaaggcuacacgcgaggcccagaaacggacugcagccggcaucaugaagaacccaacgguggaugggaucguagcuauugaccuggauccuguggucuaugacgccaaguuugaaaaacagcucggacagaucaugcuucugauauuguguaccucgcaaauucugcucaugcgaacaacuugggcacugugcgagagcaucaccuuagcuacaggcccccuuaccacucugugggaggguuccccagggaaguucuggaauacgacaauugccguuucuauggcgaacaucuuuagaggaucauaccucgccggcgcaggucuagcuuucagccugaugaaauccuugggcgggggaaggcgcggcaccggggcccagggagaaacucugggcgagaaguggaaacggcagcucaaucagcuuaguaagucugaguucaacaccuauaagagaagcgguauaauggagguggaccguucagaagcaaaagaggggcugaagaggggagagacaacuaaacacgcugucucccggggcaccgccaaguugcgcugguuuguggaacgaaaucugguaaaaccugaggguaaggugaucgaucucggcugugggagaggaggcuggaguuacuauugcgccggguuaaagaaaguuacagaagugaagggauacacgaaaggcggucccgggcacgaggaaccgauuccaauggcgaccuacggauggaaccuggucaaacuucauagcggcaaagacguguucuuuaucccucccgagaagugugauacucugcuaugcgacauuggcgagucuuccccaaaucccacaaucgaagaggggaggacccuccggguccugaaaaugguggaaccuugguugcgcggaaaccaauucuguauuaagauccugaauccguauaugcccucaguuguagagacucucgagcagaugcagagaaagcacgguggcaugcuugugaggaacccacugagccgaaauucgacacaugaaauguacugggucucuugcgggaccggaaacauagugagugcuguuaauaugacgucccggauguuacugaaccguuuuaccauggcacacagaaaaccuacauaugagcgcgauguggacuugggcgccgguacuaggcacgucgcuguggaacccgagguagccaaccucgauauuaucgggcagcggaucgaaaauauuaagcaugagcacaaaagcaccuggcauuacgacgaggauaacccuuauaagacaugggcauaccacggaucauaugaagugaaaccauccggcucugccagcaguaugguuaauggcgucgugaagcugcuaacuaagcccugggacgugauaccuauggucacccaaaucgcuaugacagauaccacuccauucgggcagcagagaguuuuuaaagagaagguggacacgcgcacacccaaagcgaagaggggaaccgcccaaauuauggaaguaacugcaaaauggcuuugggguuuccugucccgaaacaagaagccgcggaucuguaccagagaggaauuuacaaggaaagugcgcagcaaugcugccauuggcgcagucuucguggacgagaaccaguggaacucugccaaggaggcuguugaagaugagcguuuuugggaccucgugcaucgggaaagagagcugcacaaacaggggaagugcgccacgugcgucuacaacaugaugggaaaaagggaaaagaaguugggcgaguucgguaaagcgaaggggucacgcgcaaucugguacauguggcugggagcccgauuucucgaguucgaagcucuuggcuucaugaaugaggaucacugguuuagucgggaaaacucccugagcggcguggagggggagggauuacauaaacuggguuauauauugagagacaucucuaagauuccuggcgggaauauguacgccgaugacaccgcaggaugggauacuaggaucacagaagacgaucuccagaacgaggcucgcauuaccgacaucauggaaccagagcacgcccugcuagcuaaaucgauauucaaacuuacuuaucaaaauaaaguaguuagagugcagcggcccgccaagaacggcacagucauggaugugauuucaaggcgugaccagcgagguagcggacaggugggaaccuacggccugaauacauuuacuaacauggaagcacaacucauccgccagauggaguccgagggcaucuucaguccuucugaacuggagaccccaaacuuggcggaaagagucuuagauuggcuggagaaguaugggguugaacggcucaaaaggauggccauuagcggagacgacugugugguaaagcccauagaugaccgcuuugcuacggcccuuaccgcacugaaugauauggguaaagugagaaaggacaucccgcagugggagccuuccaaaggcuggaacgauuggcagcaaguccccuucugcucacaucacuuucaccagcuaauuaugaaggacgggcgggagaucgugguuccauguaggaaucaggaugaacuggugggacgagcucgugucagucagggcgccgguuggucucucagagagacagcaugcuugggaaagagcuacgcccaaauguggcagcugauguauuuccaucgccgggaccuuaggcuggcggcuaacgccauuuguuccgcagugccuguagauuggauccccacuucaagaaccacauggagcauacacgcccaucaccaguggaugacuaccgaagacaugcucucuguuuggaaucgcguguggaucgaggaaaacccauggauggaggauaaaacgcauauuuccaguuggggagacguccccuacuuaggcaagcgggaggaccaauggugcggcagccugaucggguugacagcuagggccaccugggcaacuaauauucagguggcuaucaaccagguucgaagacugauuggaaaugaaaacuaccucgauuauaugacaucgaugaaacgguuuaagaaugagggugacccugaaggcgcccuuugguga

SEQ ID NO: 13564 - RNA, 9879 nt, Artificial Sequence
  derived and/or modified CDS sequence (opt3) from DENV-1__EU677159__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacacugauugccauggaccucggcgagcugugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuuggacagggcaaaaagaugauccgcccucaacccauggaguacaaauauucguggaaaagcugggggaaggccaagauaaucggagcggacgcccagaauacuaccuucauuaucgauggcccaaacacaccugaaugucccgacgaucagagagcuuggaauauuugggagguggaggacuacgguuuugggaucuucacuaccaacauaugguugaagcucagggauuccuauacacaggucugcgaccaccgucugaugucagcagccauuaaagauaguaaggcugugcacgccgacaugggauacuggaucgaaucugagaaaaaugaaacguggaagcuagcacgggcgagcuuuauugagguuaagaccuguaucuggccaaaaucccauacucuguggucaaacggcgugcucgaaagcgagaugauaauccccaagauuuaugguggcccuaucucucaacacaauuaccgaccaggguacuucacacagaccgccggaccguggcaucugggcaaacuugaguuggauuucgaccugugcgaagggacuacaguagucguggaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgucaaagaaaaggaggaaaaucuuguuaagagcauggugucugcugguuccggcgagguagacucauucagucugggguugcucuguauuagcaucaugaucgaagaggugaugcgcucgcgauggucccggaaaaugcugaugaccggaacucuagccgucuuuuuccugcucauuaugggccagcugacauggaacgaucuuauccguuugugcauuauggugggggcaaaugcuucugacagaaugggaaugggcaccacauaccuggccuuaauggcaacuuuuaagaugaggccuauguucgccguuggucuccuguuucgccggcuuaccagcagagaggugcugcuacucacgauagggcugucauuggucgcuaguguggaacugccaaacuccuuagaggaacucggagauggccuggcgaugggcaucaugauucuuaaacuguugacagacuuccaaucucaucagcucugggccacccugcuaagccugacuuuuaucaagaccacauucucccuucacuaugcauggaaaacuauggcuaugguucucucaauugugagccuguuucccuugugucugaguaccacgucucagaagacaaccugguuaccgguccuccuggggucccuuggaugcaagccucugacuauguucuugaucgccgagaauaaaauaugggguaggaaguccuggccacucaacgaaggcaucauggccguagggauugugucgauccugcuaucaucucugcuuaaaaacgauguuccccucgcuggaccucugauugcaggcgguauguugaucgccuguuacgugauaaguggguccagcgcggacuuaucucuggagaaggcugccgaggucagcugggaagaggaagcagagcauuccggagccucacacaauauucucguggaaguacaggaugacggcacaaugaaaaucaaggaugaggagcgagacgauacccugacuauccuucugaaagcuacauugcuagcagugaguggcgucuaucccauuagcauaccagccacccuguuuguuugguacuucuggcaaaagaagaaacagcgcucuggggugcucugggacacgccuucacccccagaaguggagcgggcgguccuggaugacggaaucuauagaauuaugcagaggggucuuuuaggccguagccagguggggguuggaguauuccaagaaaacguguuucauacuauguggcacgucacccgcggcgcugugcugauguaccaggguaagcggcucgagccgaguugggccagcguuaaaaaggacuugaucuccuacgggggaggcuggagacugaggggcucuuggaauacaggggaggaagugcaggucauugcaguggagccuggcaagaaucccaagaauguacagaccgccccagguacauucaagacucccgaaggcgaggucggggcuaucgcccucgauuuuaaaccuggaaccucgggcagcccaauagugaaccgagaagguaagaucguugggcuguauggaaauggcguggucacgacaucaggcacuuacguguccgcaauugcucaagccaaagcgagucaggaggggccccuuccugagaucgaagacgagguuuuccggaagcgcaaccugaccauuauggauuugcacccgggaucugguaaaacaagaagguaucuaccagccaucgugcgggaagcaauaaagcgaaagcugagaacccucauuuuagcucccacucgcgucguggccagcgagauggcugaagcacugaaaggcaugccuaucagguaccagaccacagccguaaaguccgagcauacggggaaagagaucguggaccuuaugugccacgccacuuuuaccaugcgucugcucucaccaguucggguccccaauuauaacaugauuaucauggaugaagcucauuucacagacccuucuagcauagcggcaagaggauacauuaguaccagggugggcaugggugaggccgcugccaucuuuaugacugcaacaccgcccggguccguggaagccuucccacaaagcaaugcugucauucaggaugaggaacgcgacaucccugagcgaucuuggaacucaggauaugaguggauaaccgauuuucccggcaagacgguaugguucgugccauccauuaaaaguggcaaugacaucgcgaacuguuugagaaagaaugggaagcggguuauccagcugagcaggaaaacuuuugauacagaauaccagaagaccaaaaacaacgacugggacuacguggucaccacugauauuucggagaugggagccaauuuccgcgcagaccgugugaucgauccuagacggugccucaagcccguuauucugaaagacgguccagaaagggugauacuugcuggcccgaugccugucacaguggccucugcagcccaacgccgagggagaaucggacggaaccacaauaaggagggcgaucaguauauuuacaugggucagccccuaaacaaugacgaggaucaugcucacuggaccgaagccaagaugcuguuggacaacaucaauacaccagaggggaucauucccgcguuauucgaaccugagagggaaaaauccgcagccguagauggcgaguaucgccugagaggagaggcuaggaagacuuuuguggaacucaugcggcguggcgaccugccaguuuggcuuagcuacaaagucgccucagagggguuccaguauagugaucgccgauggugcuuugacggagaaagaaacaaucaagugcuggaggaaaacauggauguggagauauggacgaaggagggugaaaggaaaaagcuccggccccgcugguuggacgcuagaaccuacucugacccucuggcacuaagggaguucaaagaauuugccgcuggccggcgauccgucagcggggaucugauccucgagauuggaaaacuuccgcagcaccugacacagagagcccagaaugcauuagacaacuugguuaugcugcauaauucagaacaaggcggucgcgcguauaggcacgccauggaggagcucccagauacuaucgaaacccugaugcuucuggcucucauugccguguugacagggggcguaacccuguucuuuuuaaguggacggggccuagggaagacuagcaucggacugcucugugugauggcauccucuguccuucuguggauggcuagcguggagccccauuggauagccgcauccaucauuuuggaguucuuucugaugguucuccugaucccugagcccgaccgucagagaacgccacaggauaaccagcuugccuacguggucauuggucuccuguucaugaucuugaccguagcugcgaaugagaugggccuguuagaaacaacuaaaaaggaccuagggauaggacacguggccguugagaaccaccaucacgcagcuaugcuggauguggaccuccauccugccucagccuggacccuuuacgcagucgcuacaaccauuaucacucccaugaugaggcacacaauugaaaacacgaccgccaauaucucucugacugcgauagcuaaccaagccgcaaucuugaugggccuggauaaagguuggccaauuaguaagauggacaucggggugccucuccuggcccuuggcugcuauucgcaggucaauccguuaacacugaccgcugcagugcucauguugguugcccauuacgcgauuaucggacccggccugcaggcuaaagccacccgcgaggcacaaaagcggacagccgcugggauaaugaagaacccaacuguggauggaauuguagccaucgaccuagauccuguggucuaugacgcaaaauuugaaaagcagcugggccagaucaugcuccuuauucuguguacgagccagaucuugcugaugcgaaccacaugggcucucugcgaguccauaacucuggccaccggucccuuaacaacccuuugggaggggucuccaggaaaauucuggaauacuacgauugcgguuucaauggccaacaucuuuagaggcagcuaccuggcaggagcuggccucgccuucucccuaaugaagagucuagggggaggcaggcgcgggacaggagcacaaggcgaaaccuugggugagaaauggaagcggcagcugaaucagcucucuaagagcgaguucaacacuuauaaaagaucagggauuauggagguggaccguuccgaagcuaaggagggacuuaaaaggggcgagaccacaaagcacgccgucagucgggguacugccaaacugcgcugguuuguggaacgaaauuugguaaagccugagggcaaggugaucgaucugggguguggaagaggcggguggagcuacuauugcgcgggacucaaaaagguuaccgaagugaaaggcuacacaaagggugggcccggacacgaggaaccgauaccaauggcuacguacggcuggaacuuagucaaacugcauucuggcaaggacguguucuuuaucccucccgagaaaugugauacccuucugugcgacauuggggaguccucaccaaaucccacuaucgaagagggaaggacacuacggguccucaagaugguggaaccuuggcugcgcgguaaccaguucuguauuaagaucuugaauccguauaugcccagcguuguagaggcacuggagcaaaugcagagaaaacacggcgggaugcucgugaggaacccacuuucgcgaaauucuacccaugaaauguacugggucaguugcggaacuggcaacauuguguccgccguuaauaugacaagccggaugcuguuaaaccguuuuaccauggcucacagaaagccuacguaugagcgcgauguggaccuggguaccgggacaaggcacgucgccguggaacccgagguagcaaacuuggauaucauaggacagcggauugaaaauaucaaacaugagcacaagucaacuuggcauuacgacgaggauaacccuuauaaaaccugggccuaccacggcuccuaugaagugaagccaucuggcagcgcuaguuccaugguuaauggggucgugaagcuccugacaaaacccugggacgugaucccuauggucacucagauugcgaugaccgauacaaccccauucggacaacagagaguuuuuaaggagaaaguggacacucgcacgcccaaggccaaaagggguacagcacagauaauggaaguaaccgcucgauggcuauggggcuuccuuagccggaacaagaagccgagaaucuguacuagggaggaauuuacccgcaaagugcguucuaaugccgcaauuggggccgucuucguggacgagaaccaauggaacucagcuaaggaggccguugaagaugagcgguuuugggaccuggugcauagagaaagggagcuccacaaacagggaaagugcgcgacaugcgucuacaacaugaugggcaaacgcgaaaagaagcugggugaguucgggaaagcaaagggaagucgagccaucugguacaugugguugggcgcucgguuucuggaguucgaagcccucggcuucaugaaugaggaucacugguuuuccagagaaaacagccuuucugggguggagggagagggucugcauaaauuaggcuauauucugagggacaucucgaagauaccugggggaaauauguacgcagaugacacggcuggcugggauacccgcaucacugaagacgauuugcagaacgaggccaaaauuacagacaucauggaaccagagcacgcucuccuggccaaggcaauuuucaaacuaaccuaucagaauaagguaguuagagugcaacggcccgcgaagaacgguacugucauggaugugaucucaaggcgugaccagcgagggagcggacaggugggcacauacggccuuaauaccuuuacaaacauggaagcccagcugauacgccaaauggaguccgaggggauuuucaguccuucugaacucgagacuccaaaccuggcugaaagagccuuggauugguuaggaaaauauggugucgagcggcugaagaggauggcaaucagcggcgacgacuguguugugaaacccaucgaugaccgcuuugcuaccgcccucacggcacuuaaugauauggggaagguaagaaaagacauuccgcagugggaaccuuccaagggauggaacgauuggcaacaggugcccuucugcucacaucacuuucaccaacugauaaugaaggacggccgggagaucgucgugccauguaggaaucaggaugagcuaguuggucgagcccgugugagucagggggcgggauggucucugagagaaaccgcuugccucggcaaaagcuacgcccagauguggcaauugauguauuuccaucgccgggaccugaggcuugcagccaacgcuauuuguuccgccgucccuguggauuggguacccacaucaagaacuaccuggagcauccacgcacaucaccaguggaugacaacugaggacaugcugucuguuuggaaucgcguguggauugaagagaacccauggauggaagauaagacccauaucuccaguugggaggacguccccuaccucggcaaacgggaggaccaguggugcgggagcuuaauaggacugacggcuagggccacaugggcgaccaauauccaaguggcuauuaaccagguucgaagauugaucgguaaugaaaacuaccuggauuauaugauuucgaugaagcgguuuaaaaaugaguccgacccugaaggcgcccucugguga

SEQ ID NO: 13565 - RNA, 9879 nt, Artificial Sequence
  derived and/or modified CDS sequence (opt3) from DENV-1__EU677160__SS-prME
agcgugaccaugcugcucaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucguguuagucacgccaucaauggccaugcgcugcguggggauuggaagcagagauuucguugagggucugaguggcgcgacuuggguugacgugguccuugagcacggguccugugugacaaccauggcaaaggauaaacccacuuuggacaucgaacugcuaaagacagaggugaccaacccugccguccucaggaaacugugcauugaagcuaagaucucuaauacgaccacagauagccgguguccaacucaaggagaggccacccuuguugaagaacaggacgcaaacuuugugugccgccgaacauucguagauagaggcugggguaauggguguggacuguuuggcaaaggcuccuugauaacuugcgcuaaguucaagugcgugaccaaacucgaggggaagacaguccaguacgaaaaccugaaauauucagugauuguuaccgugcacacuggagaccagcaucaagucgguaaugagaguacggaacacggcacaaccgccacuaucacaccccaggcgccuagcacagagauucaguuaaccgacuacggggcccugacucucgauuguucuccaaggacaggacuugacuuuaacgaaauggugcuguugacgaugaaggagaaauccuggcuaguacauaagcagugguuccuggaucucccgcugcccuggaccucaggcgcaagcacaagucaagagacauggaaucggaaagaccuucugguuaccuuuaagacagcucacgccaagaaacaggaaguggucguguuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugucauguguacuggaucguucaagcucgagaaggaaguggcugagacccagcacgguacgguucuggugcagauuaaauacgagggcacagacgcgccuugcaagauaccauuuucuacccaggaugaaaaagggguaacucaaaacggacgccuuaucacagcaaaucccauugucaccgacaaggagaaaccugugaacaucgaagccgagccacccuucggcgaguccuauauaguuauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguguucacaucugucgggaagcuggugcaucagaucuuuggaacggcguacggcguacuuuucagcggugugucauggaccaugaaaauugggauaggcguucuguugacuuggcucggacugaauagucgauccacuagcuuaucuaugaccuguaucgcugucggccuggugacacuauaccucggggugaugguccaggccgauucaggaugcguuauuaacuggaagggccgcgaacugaagugugguagugggaucuuugugacuaaugaggugcacaccuggacggaacaguauaaauuccaagcagacagcccgaagagacuuuccgccgcuaucggaaaagccugggaggagggcguaugcgguauuaggucugcaacacgguuggaaaacauaauguggaagcagaucucgaacgagcugaaucauauucuccuggaaaacgacaugaaauuuaccgucgugguuggcgauguggcugggaucuuagcccagggaaagaaaaugauucgcccucagcccauggaguacaaguauagcuggaaguccuggggcaaagcgaagaucauaggggccgacguccaaaauacuaccuucaucauugauggaccaaacacaccugaaugucccgacgaucagagagcuuggaauaucugggagguggaggacuacggcuuugguauuuucacuaccaacaucuggcugaaacuuagggauucauauacacagguuugcgaccaccguuugaugagugcagccauaaaggauucuaaagcugugcacgccgacaugggguacuggauugaaagcgagaagaaugaaacguggaagcucgcacgggcguccuucaucgagguaaaaaccuguauuuggccaaagucacauacucuguggagcaacggaguccuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagugguggucgaugagcacugcgggaacagaggacccaguuugaggaccacgacuguuaccggcaaaaucauucacgaaugguguugccgcagcuguacacugccuccauuacgguuuaagggugaggacgggugcugguauggaauggagaucagacccgugaaggaaaaagaggaaaaucucguaaagucucugguguccgcuggcucaggugaggucgacaguuucagccuuggccuguuguguauaucgauuaugaucgaagaggugaugaggucccgcuggucucgaaaaaugcucaugaccgggacucuggccguauuuuuccuacugaucaugggacagcucacauggaacgaucugauucggcuuugcaucauggugggcgcaaaugcuagcgaccguauggggaugggaaccacauacuuggcccugauggcaacuuuuaagaugagaccuauguucgccgucggcuuacucuuuaggcgccugaccucacgggaggugcuucugcuaacgauuggucucagucugguugcuuccguggaauugccaaacucucuggaggaauuaggggauggacucgcgaugggcauaaugauccugaaacuucugacagacuuccagagccaucaauugugggccacccuccugucccuaacuuuuauuaagaccacauucucacugcacuaugcauggaagacuauggcuaugguccuuagcaucguaagucucuuuccccuguguuugucuaccacgucccagaaaacaaccuggcugccgguguuacucggcagccuggggugcaagccucuuacuauguuccugauugccgagaauaaaaucuggggaagaaagucguggccauugaacgaagguauaauggccguuggcaucgugucaauucuccugucuagucuacugaaaaacgaugucccccuugcugggccucucaucgcaggaggcaugcugauugccuguuacgugaucuccgguagcucugcggacuugagcuuagagaaggcugccgagguauccugggaagaggaagcagagcauucaggggccagucacaauauacugguggaaguccaggaugacggaacaaugaaaauuaaggaugaggagagggacgauacccucacuauccugcuuaaggcuacacuguuggcaguuagcggcguguauccccuaucuaucccagccacccuguucgugugguacuuuuggcagaaaaagaaacaacgauccggcguccucugggacacgccuucacccccagaaguggagcgcgcgguucuggaugacgggauuuaucggauaaugcagagaggacuuuuagguaggagucagguaggcgugggggucuuccaggaaaacguguuucauacuauguggcacguuacccguggagcugugcugauguaccaaggcaagcgccucgagccgagcugggccuccgucaaaaaggacuugaucucuuacggugggggauggcggcugcagggcucguggaauacaggcgaggaagugcagguaauugcagucgagccugggaagaaccccaaaaaugugcagaccgccccaggaacauucaagacuagcgaaggugagguuggcgcuaucgcccucgauuuuaaacccgggaccucaggauccccuauugugaacagagaaggcaagaucgucggucuguaugggaauggagugguuacgacaaguggcacuuacgugucugcaauagcucaagccaaagcgagccaggagggcccacuucccgagaucgaagacgaggucuucaggaagcgaaaccugaccauuauggauuugcacccuggguccggaaagacacggcgcuaucuaccggccaucgugagagaagcaauuaaaaggaagcugcggacccucaucuuagcuccaacucgaguaguggccucagagauggcugaagcacugaaagguaugcccauaagauaccagaccacagccguuaagucugagcauacgggcaaagagauugucgaccuuaugugccacgccacuuuuaccaugcgccugcucagcccugugagggugccaaauuauaacaugaucaucauggaugaagcucauuucacagaccccaguuccauugcggcacguggguacaucagcacccgggucggaaugggcgaggccgcugccauauuuaugacugcaacaccuccggguucuguagaagccuucccccaaucaaaugcugugauucaggaugaggaaagagacaucccagagagguccuggaacaguggguaugaguggauuaccgauuuuccuggaaagacgguuugguucgugcccagcaucaagucgggcaaugacauagcgaacuguuugcgcaaaaauggcaagcgagucauucagcugucuagaaaaacuuucgauacagaauaccagaagaccaaaaacaacgacugggacuacgugguuaccacugauaucuccgagaugggggccaauuuucgggcagacagggugaucgauccacgccguugccucaagccugucauucugaaggacggacccgaaagagugauccuugcugguccaaugccgguaacaguggccagcgcagcccaacggaggggccgcauugggcgaaaccacaauaaagagggagaucaguauauauacaugggccagccucuaaacaaugacgaggaucaugcucacuggaccgaagccaagaugcuguuggacaacaucaauacacccgaggguauuaucccagcguuauucgaacccgagagagaaaaaucagcagccaucgauggggaguaucggcugaggggcgaggcucgcaagacuuuuguugaacucaugagaaggggagaccugccugucuggcuuaguuacaaaguggccucugagggcuuccaguauuccgaucggcguuggugcuuugacggggaacgcaacaaucaagugcuggaggaaaacauggaugucgagauuuggacgaaggagggagaacgaaagaaacucagaccaaggugguuggacgcucggaccuacagcgacccccuggcacuacgcgaguucaaagaauuugccgcugguagaaggucaguuaguggcgaucugauacucgagaucgggaaacuuccucagcaccugacacagcgggcccagaaugcauuagacaacuuggugaugcugcauaauagcgaacaaggaggccgagcguauagacacgccauggaggagcucccggauacuauugaaacccugaugcuucuggcucucaucgccguauugacagguggggugacccuguucuuuuuauccggccgcggacuaggcaagacuucuauugggcugcucugugucauggcaagcuccgugcuucuguggauggcuucaguugagccacauuggaucgccgcaucuauaaucuuggaguucuuucugauggugcuccugauucccgagccugacaggcagcggacgccccaggauaaccagcuugccuacgucguaaucggacuccuguucaugauuuugaccguggcugcgaaugagaugggucuguuagaaacaacuaaaaaggaccuaggcaucgggcacguugccguggagaaccaccaucacgcagcuaugcuggaugucgaccuccauccagccagugccuggacccuuuacgcaguggcuacaaccauaauuacuccuaugaugcgucacacaaucgaaaacacgaccgccaauauuucgcugacugcgaucgcuaaccaagccgcaauauugaugggacuggauaaaggcuggcccaucagcaagauggacauuggugucccacuccuggcccuugggugcuauucccaggugaauccuuuaacacugaccgcugcaguucucauguugguggcccauuacgcgaucauuggcccgggacugcaggcuaaggccaccagagaggcacagaagaggacagccgcuggcaucaugaagaaccccacuguagaugggauaguggccauugaccuagauccagucguuuaugacgcaaaauuugaaaagcagcugggacagaucaugcuccuuauccuguguacgucucagauuuugcugaugcgcaccacaugggcucucugcgagucaaucacucuggccaccggcccuuuaacaacccuuugggaggguagccccgggaaauucuggaauacuacgauagcgguguccauggccaacauuuuccggggaaguuaccuggcaggcgcuggucucgccuuuucucuaaugaaaagccugggcgggggacgaagaggcacaggggcacaaggagaaaccuugggcgagaaguggaaaaggcagcugaaucagcucucaaaguccgaguucaacacuuauaaacgcagugguaucauggaggucgaccggagcgaagcuaaggaggggcuuaaaagaggagagaccacaaagcacgccgugucucguggcacugccaagcugaggugguuuguagaacggaauuuggugaaaccagaggguaagguuauugaucugggcugugggcgcggaggcugguccuacuauugcgcggggcucaaaaaggugaccgaagucaaaggauacacaaagggcgguccugggcacgaggaacccaucccgauggcuacguacggauggaacuuagugaaacugcauucaggcaaggacgucuucuuuauaccaccugagaagugugauacccuucugugcgacaucggcgagagcucgcccaauccaacuauugaagaggggcgaacacuaagagugcucaaaaugguugaacccuggcugaggggaaaccaguucuguaucaagauuuugaauccuuauaugccgucuguaguggagacccuggagcaaaugcagcggaaacacgguggcaugcucguccgcaacccccuuaguagaaauuccacucaugaaauguacugggugagcugcgggacaggaaacaucguuucagcagugaauaugaccuccaggaugcuguuaaaccgauuuacgauggcccaccggaagccaaccuaugagcgugaugucgaccugggcgcugguacaagacacguggccguagaaccugagguggcaaacuuggauauuaucgggcagcgcauagaaaauauuaaacaugagcacaagucuacuuggcauuacgacgaggauaaccccuauaagaccugggccuaccacggaagcuaugaaguuaaaccuaguggcuccgcuagcucuauggucaauggcguggugaagcuccugacaaaaccaugggacgucauccccaugguuacucagaucgcgaugaccgauacaaccccuuucgggcaacagaggguguuuaaggagaaaguagacacucggacgccaaaggccaagagaggaacagcacagauuauggaagugaccgcuaaauggcuaugggguuuccuuucacgcaacaagaaacccaggauauguacucgagaggaauuuacccggaaggucagaaguaaugccgcaaucggcgccguguucguugacgagaaccaauggaacuccgcuaaagaggccguggaagaugagagguuuugggaccugguccaucgcgaacgugagcuccacaagcaggggaagugcgcgacaugcguguacaacaugaugggaaaacgggaaaagaaacugggcgaguucgguaaggcaaaagggagcagagccauuugguacaugugguugggagcuagguuccuggaguuugaagcccucggcuucaugaaugaggaucacugguuuucucgcgaaaacucgcuuucaggcguagagggggagggacugcauaaguuagguuauauccugcgagacauuagcaaaaucccgggcgggaauauguacgcagaugacacggcuggaugggauacccggauaacugaagacgauuugcagaacgaggccaagaucacagacauuauggaaccugagcacgcucuccuggccaaguccaucuucaaacuaaccuaucagaauaagguugugagaguccaaaggccagccaagaauggcacugugauggaugugauuagucgcagagaccagcgggguucugggcaggucggaacauacggccuuaauaccuuuacaaacauggaagcgcagcugaucaggcaaauggagagcgagggcauauucucccccucagaacucgagacuccuaaccuggcccgucgaguuuuggauugguuagaaaagcaugggguggagcgccugaaaagaauggcuauuaguggagacgacuguguagugaagccaaucgaugaccgguuugccaccgcacucacggcucuuaaugauauggguaaggucaggaaagacaucccccagugggaaccgucuaagggcuggaacgauuggcaacaggugccuuucugcagccaccacuuucaucaacugauuaugaaagacgggcgcgagauaguugugcccuguagaaaucaggaugagcuagucggacgggccagggugucccagggcgcagguuggucacugcgagaaaccgccugccucggaaagagcuaugcgcagauguggcaauugauguacuuccaccguagagaccugcgccuugcugccaacgcaaucuguucugccguaccaguugauugggugccuacaucccggacuaccuggaguauucaugcucaccaucaguggaugacaacugaggacaugcugagcgucuggaauaggguguggaucgaagagaaccccuggauggaagauaaaacccacauuucguccuggggagacguuccauaucucggcaagagagaggaccaguggugcggcucuuuaaucgggcugacggcccgcgcaacaugggcuaccaauauacaaguggccaucaaccagguccggagguugauuggaaaugagaacuaccuggauuacaugacuucaaugaagcgauuuaaaaaugaaagcgaccccgagggugcgcucugguga

SEQ ID NO: 13566 - RNA, 9879 nt, Artificial Sequence
  derived and/or modified CDS sequence (opt3) from DENV-1__EU677162__SS-prME
agcgugaccaugcugcucaugcuuaugcccacagcacuggcuuuccacuugacuacgaggggaggggaaccucauaugaucgucuccaagcaggaaagggggaaaucuuuacuguuuaagaccucagccgguguuaauaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaagaauguucgaggcaaccgccaggggcgcucggcgaauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgcuccacuagcuuaucuaugacauguauugcuguuggccuggucacccuauaccucggggugauggugcaggccgauucaggaugcgucaucaacuggaaaggcagagaacugaagugugguagugggaucuuuguuacaaaugaggugcacacuuggaccgaacaguauaaguuccaagcagacagcccgaaaaggcuuuccgccgcuauuggaaaggccugggaggagggcgugugcgguauacggucugcaacgcgcuuggaaaacaucauguggaaacagauuucgaacgagcugaaucauauccuccuggaaaacgacaugaaguuuacaguagucgugggcgauguugcugggauuuuagcccagggcaagaagaugaucagaccucagcccauggaguacaaauauagcuggaaguccuggggcaaggcgaaaauaaucggggccgacgugcaaaauaccacuuucauuaucgauggaccaaacaccccugaaugucccgacgaucagagggcuuggaauauuugggaggucgaggacuacggcuuugguaucuucacaacuaacauauggcugaaacuucgugauucauauacccaggugugcgaccaccgguugaugagugcagccauuaaagauucuaaggcuguucacgccgacaugggguacuggaucgaaagcgagaaaaaugaaacauggaagcucgcacgagcguccuucauugaggugaagacguguaucuggccaaaaucacauacccuguggagcaacggaguacuagaaucugagaugauaauccccaagauuuauggcgguccuaucucccagcacaauuacagaccaggcuacuuuacucaaacagccgggccguggcaucugggaaaacucgagcuggauuucgaccuuugcgaaggcaccacugucgugguggaugagcacugcgggaacaggggacccaguuugcgcacaaccacggucacuggcaagauuauccacgaaugguguugccggagcuguacccugccuccauuaagauuuaaaggugaggacgggugcugguauggaauggagauaaggcccguuaaggaaaaggaggaaaaucucgugaaaucuaugguauccgcuggcucaggugagguggacaguuucagccugggccuucuguguauuucgaucaugaucgaagaggucaugcgcucccgauggucucggaagauguugaugacagggacccucgccguguuuuuccugcuaauuaugggacagcugacuuggaacgaucucauccgucugugcauuaugguuggcgcaaaugcuagcgacagaauggggaugggaacaaccuaccuugccuugauggcaacauuuaaaaugaggccuauguucgccgugggccuguuauuucgccggcucacuucaagagagguccugcuucugaccauaggucuaagucucguggcuuccguugaacugccaaacucuuuggaggaacugggggauggauuagcgaugggcaucaugauucucaagcugcuuacggacuuccagagccaucaacugugggccacauugcucucccugaccuuuaucaaaacuaccuucucacuacacuaugcauggaagacaauggcuauggugcugagcauugucagucuuuuuccccucugucugucuacuaccucccagaagacgacaugguugccgguacuguuaggcagccucgggugcaaaccucugaccauguuccuuaucgccgagaauaagauauggggaaggaaaucguggccacugaacgaagguaucauggccgugggcauuguuucaaucuugcucucuagucugcuaaagaacgaugugccccuggcugggccucuuauugcaggaggcaugcucaucgccuguuacgucauauccgguagcucugcggaccugagcuuggagaaagcugccgagguguccugggaagaggaagcagagcauucaggggccagucacaauauuuuaguagaagugcaggaugacggaacuaugaagaucaaagaugaggagcgagacgauacacugaccauccuccugaaggcuacucuucuggcagucagcggcguuuaucccuugucuauuccagccacacuauucgugugguacuuuuggcagaagaaaaagcaacgcuccggcgugcugugggacaccccuucacccccagaagucgagcgggcggugcucgaugacgggauauauagaaucaugcagaggggacugcuuggucguagucagguuggcguagggguguuccaggaaaacgucuuucauacgauguggcacgugacucgcggagcuguuuuaauguaccaaggcaaacggcuggagccgagcugggccuccgugaagaaagaccucauuucuuacggugggggauggagauugcagggcucguggaauaccggcgaggaaguccaggugaucgcaguagagccugggaagaaccccaagaauguccagacagccccaggaaccuucaaaacaagcgaaggugaggugggcgcuauugcccuggauuuuaagcccgggacuucaggauccccuaucguuaacagggaaggcaaaauagugggucucuaugggaauggagucgugaccacgaguggcacauacguuucugcaaucgcucaagccaaggcgagccaggagggcccacugcccgagauugaagacgagguguuccgaaaacggaaccuuacuaucauggaucugcacccuggguccggaaagacccgcagauauuugccggccauugucagggaagcaaucaagcggaaacuacgaacacugauacucgcuccaaccagagugguagccucagagauggcugaagcauuaaaggguaugcccauucgcuaccagacuaccgccgugaaaucugagcauacaggcaaggagaucguugaccugaugugccacgccacguuuacuaugaggcuucugagcccuguccgugugccaaauuauaacaugaucauuauggaugaagcucauuucaccgaccccaguuccaucgcggcacggggguacauaagcacaagagugggaaugggcgaggccgcugccauuuuuaugaccgcaacuccuccggguucugucgaagccuucccccaaucaaaugcuguaauccaggaugaggaaagggacauuccagagcgcuccuggaacaguggguaugaguggaucacagauuuuccuggaaaaaccgugugguucguucccagcauaaagucgggcaaugacauugcgaacugucuccgaaagaauggcaaaagagugauccaguugucucggaagacguucgauacugaauaccagaaaacaaagaacaacgacugggacuacgucgugaccaccgauaucuccgagaugggggccaauuuuagggcagaccgcguuauugauccacguagaugccugaaaccugugauccucaaggacggacccgaacgggucauucuggcugguccaaugccggugacuguagccagcgcagcccaaaggcgcggccgaauagggagaaaccacaauaaggagggagaucaguauaucuacaugggccagccucuuaacaaugacgaggaucaugcucacuggacagaagccaaaaugcuacuggacaacauuaauacccccgaggguaucaucccagcguuguucgaacccgagcgggaaaagucagcagccauugauggggaguauagguuacgcggcgaggcuagaaaaacauuuguggaacugaugaggcggggagaccucccuguuuggcugaguuacaaggucgccucugagggcuuccaguauuccgaucgucgcuggugcuuugacggggaacgaaacaaucaagugcuugaggaaaacauggauguggagauauggacuaaagagggagaaagaaagaaacugaggccacgguggcucgacgcucgcacguacagcgaccccuuggcacugagagaguucaaggaauuugccgcugguaggcggucagucaguggcgaucuaauccuggagauugggaagcucccucagcaccuuacccagcgagcccagaaugcacuggacaacuuaguuauguugcauaauagcgaacaaggaggcagagcguaucgccacgccauggaggagcugccggauacaaucgaaacucucaugcugcuugcucugauugccgugcucaccggugggguaacauuguucuuucuguccggcaggggauuaggcaaaaccucuaucgggcuacugugugugauggcaagcuccguccuccuuuggauggcuucaguggagccacauuggauagccgcaucuaucauucuggaguucuuuuugaugguucugcucauccccgagccugaccggcagcguacuccccaggauaaccagcuggccuacguggucauuggacuucucuucaugauccugacgguagcugcgaaugagauggguuugcuggaaaccacaaagaaagacuuaggcauagggcacguggccguugagaaccaccaucacgcagcuaugcuagauguggaccugcauccagccagugccuggacucucuacgcagucgcuaccacaauuaucaccccuaugaugagacacacuauugaaaacacaacggccaauaucucgcuuaccgcgauagcuaaccaagccgcaauccugaugggauuggauaagggcuggcccauuagcaaaauggacaucggugugccacugcucgcccuggggugcuauucccaggucaauccucuuacuuuaacagcugcagugcugaugcucguugcccauuacgcgauuaucggcccgggauugcaggcuaaggccaccagggaggcacaaaagcgcaccgccgcuggcauaaugaaaaaccccacaguggaugggauuguagccaucgaccuggauccaguggucuaugacgcaaaguuugaaaaacagcuaggacagaucaugcugcucauucuuuguacuucucagauccuguugaugcggacgaccugggcucugugcgagucaauaacacucgccacuggcccucugaccacauuaugggaggguagccccgggaaguucuggaauaccacuauugcgguuuccauggccaacaucuuccgaggaaguuaccuugcaggcgcuggucuggccuuuucucucaugaaaagccuaggcgggggaagaaggggcacgggggcacaaggagaaacacugggcgagaaguggaagcgccaguugaaucagcugucaaaauccgaguucaacaccuauaagcggagugguauuauggagguggacagaagcgaagcuaaagaggggcucaagcguggagagacuaccaaacacgccgucucuaggggcacagccaaacuucggugguuuguggaacgcaaucugguaaagccagaggguaaagugaucgauuugggcugugggcgaggaggcugguccuacuauugcgcggggcugaagaaaguuacugaagugaagggauacaccaaaggcgguccugggcacgaggaacccauaccgauggcuacauacggauggaaccucgucaaguuacauucaggcaaagacguguucuuuaucccaccugagaagugugauacgcugcuuugcgacauuggcgagagcucgcccaauccaaccaucgaagaggggagaacucugaggguccuaaagaugguggaacccuggcuccggggaaaccaguucuguauuaaaauccugaauccuuauaugccgucuguuguagagacauuggagcaaaugcagcgcaagcacgguggcaugcuggugagaaacccccucaguagaaauuccacccaugaaauguacugggucagcugcgggacuggaaacauugugucagcaguuaauaugacaucccgaaugcuucugaaccgguuuaccauggcccaccguaaaccaacguaugagagagauguggacuuaggcgcugguacccgccacgucgccguggaaccugagguagcaaaccuggauaucauagggcagaggauugaaaauaucaagcaugagcacaaaucuacauggcauuacgacgaggauaaccccuauaagacuugggccuaccacggaagcuaugaagugaagccuaguggcuccgcuagcucuaugguuaauggcgucgugaaauugcucaccaagccaugggacgugauccccauggucacacagauugcgaugacugauaccacaccuuucgggcaacagcggguuuuuaaagagaagguggacaccagaacuccaaaagccaagcgcggaacggcacagauaauggaaguaacagcuaaguggcugugggguuuccuaucaaggaacaaaaagccccgaaucuguacccgggaggaauuuacuagaaaagugaggaguaaugccgcaauuggcgccgucuucguggacgagaaccaauggaacuccgcuaaggaggccguugaagaugagcgcuuuugggaccuugugcaucgugaacgggagcugcacaaacaggggaagugcgcgaccugcgucuacaacaugaugggaaagagagagaagaagcucggcgaguucgguaaagcaaaggggagcagggccaucugguacauguggcugggagcucgcuucuuggaguuugaagcccugggcuucaugaaugaggaucacugguuuucucgagaaaacucgcucucaggcguggagggggagggacuucauaaacuggguuauauuuuacgggacaucagcaagauaccgggcgggaauauguacgcagaugacacagcuggaugggauacgagaaucaccgaagacgaucugcagaacgaggccaaaauuacugacaucauggaaccugagcacgcuuugcucgccaaguccauuuucaagcugacauaucagaauaaaguaguuagggugcaacgcccagcaaagaacggcaccgucauggaugugaucaguagacgggaccagagggguucuggacaggugggaacuuacggccuaaauacauuuaccaacauggaagcgcagcuuauacgucaaauggagagcgagggcauuuucucccccucagaacuggagacaccuaaccucgccgggcgaguccuggauugguuggaaaaacauggaguugagcgcuuaaagagaauggcuaucaguggugacgacugugugguaaaaccaaucgaugaccgguuugccacugcacugaccgcucucaaugauaugggcaaggugaggaaggacauuccccagugggaaccgucuaaaggguggaacgauuggcagcaggucccuuucugcagccaccacuuucaucaacuuauaaugaaggacggacgcgagaucgugguucccuguagaaaucaggaugagcuggugggccgggccagggucucccagggugcaggguggucacuacgagaaacggccugccugggaaaaagcuaugcgcagauguggcaacucauguacuuccaccguagagacuugcgccuggcugccaacgcaauuuguucugccgugccaguagauuggguuccuaccucccggacaacuuggaguauccaugcucaccaucaguggaugaccacagaggacaugcuuagcguguggaauagggucuggauugaagagaaccccuggauggaagauaagacucacaucucguccuggggcgacgugccauaucugggcaaaagagaggaccaguggugcgggucucucauaggauuaaccgcccgcgcaacgugggcuacaaauauccaaguugccauuaaccaggugcggaggcugaucgguaaugagaacuacuuggauuacaugaccucaaugaagcgauuuaagaaugaaagcgaccccgagggcgcgcugugguga

SEQ ID NO: 13567 - RNA, 9879 nt, Artificial Sequence
  derived and/or modified CDS sequence (opt3) from DENV-1__EU677164__SS-prME
agcgugaccaugcugcucaugcuuaugcccacugcacuggcuuuccacuugacuacgagaggcggggaaccucauaugaucgucuccaagcaggaaagggggaaaucuuuacuguuuaagaccucagccgguguuaacaugugcacccuaauugcaauggaccucggcgaguucugugaagauacuaugaccuacaaaugcccacggauaaccgaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggaucgccauucucggggauaccgcaugggacuuuggauccaucgguggcguuuucacaucuguggggaagcugguccaucagauuuuuggaacggcguacggcgugcuuuucagcgguguaucauggaccaugaaaauagggaucggcgugcuguugacuuggcucggacugaauagucgauccacuagcuuaucuaugaccuguauugcuguuggccuggucacacuauaccucggggugauggugcaggccgauucaggaugcgucaucaacuggaagggccgcgaacugaagugugguagugggaucuuuguuacuaaugaggugcacaccuggacggaacaguauaaauuccaagcagacagcccgaagagacuuuccgccgcuauuggaaaagccugggaggagggcgugugcgguauaaggucugcaacacgguuggaaaacaucauguggaagcagauuucgaacgagcugaaucauauccuccuggaaaacgacaugaaauuuaccguagucgugggcgauguugcugggauuuuagcccagggaaagaaaaugauccgcccucagcccauggaguacaaguauagcuggaaguccuggggcaaagcgaagauaaucggggccgacgugcaaaauacuaccuucauuaucgauggaccaaacacaccugaaugucccgacgaucagagagcuuggaauauuugggaggucgaggacuacggcuuugguaucuucacuaccaacauauggcugaaacuuagggauucauauacacaggugugcgaccaccguuugaugagugcagccauuaaggauucuaaagcuguucacgccgacaugggguacuggaucgaaagcgagaagaaugaaacguggaagcucgcacgggcguccuucauugaggugaaaaccuguaucuggccaaagucacauacucuguggagcaacggaguacuagaaucugagaugauaauccccaaaaauuauggcgguccuauuucccagcacaacuaccgaccaggcuacuuuacacaaaccgccgggccguggcaucugggaaagcucgagcuggauuucgaccuuugcgaaggcacuacagucgugguggaugagcacugcgggaauagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaccucgugaagucuaugguauccgcuggcucaggugagguggacaguuucagccugggccuucuguguauaucgauuaugaucgaagaggucaugaggucccgcuggucucgaaaaauguugaugaccgggacucucgccgugcuguuucuacugaucaugggacagcucacauggaaugaucugauucggcuuugcaucaugguuggcgcaaacgcuagcgaccguauggggaugggaaccacauacuuggcccugauggcaacuuucaagaugagaccuauguuugccgugggcuuacucuucaggcgccugaccucacgggagguccuucugcuaacgauuggucucagucugguggcuuccguugaauugccaaauucucuggaggaauuaggggauggacucgcgaugggcauaaugauccugaaacuucugacagacuuucagagccaucaauugugggccacccuccugucccuaacuuucauuaagaccacauuuucacugcacuaugcauggaagacuauggcuauggugcuuagcaucgucagucucuucccccuguguuugucuaccacgucccagaaaacaaccuggcugccgguauuacucggcagccuggggugcaagccucuuacuauguuucugauugccgagaacaaaaucuggggaagaaagucguggccauugaacgaagguauaauggccgugggcaucguuucaauucuccugucuagucuacugaaaaaugaugugccccuugcugggccucucaucgcaggaggcaugcugauugccuguuacgucaucuccgguagcucugcggacuugagcuuagagaaggcugccgagguguccugggaagaggaagcagagcauucaggggccagucacaacauacugguagaagugcaggaugacggaacaaugaaaauuaaggaugaggagagggacgauacccucacuacacugcuuaaggcuacccuguuggcagucagcggcguuuauccccuaucuaucccagccacgcuguucgugugguacuucuggcagaaaaagaaacaacgauccggcgugcucugggacacuccuucacccccagaagucgagcgcgcggugcuggaugacgggaucuaucggauuaugcagagaggacuuuuagguaggagucagguuggcguagggguguuucaggaaaaugucuuccauaccauguggcacgugacacguggagcuguucugauguaccaaggcaagcgccucgagccgagcugggccuccgugaaaaaggacuugauaucuuacggugggggauggcggcugcagggcucguggaacaccggcgaggaaguccaggugaucgcaguagagccugggaagaaucccaaaaacguccagacagccccaggaacuuuuaagaccagcgaaggugaggugggcgcuauugcccucgauuucaaacccgggacgucaggauccccuaucguuaauagagaaggcaagauugugggucuguaugggaacggagucgugacaacaaguggcaccuacguuucugcaaucgcucaagccaaagcgagccaggagggcccacuucccgagauagaagacgagguguuuaggaagcgaaaucugacaaucauggauuugcacccuggguccggaaagacccggcgcuaucuaccggccauugucagagaagcaaucaaaaggaagcugcggacucucauuuuagcuccaacccgagugguagccucagagauggcugaagcacugaaagguaugcccaucagauaccagacaacggccgugaagucugagcauacuggcaaagagauaguugaccuuaugugccacgccaccuucacaaugcgccugcucagcccugucagggugccaaacuauaauaugauuaucauggaugaagcucauuuuaccgaccccaguuccaucgcggcacguggguacauuagcacucgggugggaaugggcgaggccgcugccaucuucaugacagcaaccccuccggguucugucgaagccuuuccccaaucaaacgcuguaauacaggaugaggaaagagacauuccagagagguccuggaauaguggguaugaguggaucacggauuucccuggaaagacugugugguuuguucccagcauuaagucgggcaacgacaucgcgaauuguuugcgcaaaaacggcaagcgagugauacagcugucuagaaaaacauucgauaccgaauaccagaagaccaaaaacaaugacugggacuacgucgugacuacagauauuuccgagaugggggccaacuuccgggcagacaggguuaucgauccacgccguugccucaagccugugauccugaaggacggacccgaaagagucauucuugcugguccaaugccggugaccguagccagcgcagcccaacggaggggccgcaucgggcgaaaucacaacaaagagggagaucaguauauuuacaugggccagccucuaaauaacgacgaggaucaugcucacuggacagaagccaagaugcuguuggacaauauaaacacucccgaggguaucauuccagcguuauuugaacccgagagagaaaaaucagcagccaucgauggggaguaucggcugaggggcgaggcucgcaagacguucguggaacucaugagaaggggagaccugccuguuuggcuuaguuacaaagucgccucugagggcuuucaguauuccgaucggcguuggugcuucgacggggaacgcaauaaccaagugcuggaggaaaauauggauguggagaucuggaccaaggagggagaacgaaagaaacucagaccaaggugguuggacgcucggacauacagcgacccccuggcacuacgcgaguuuaaagaguucgccgcugguagaaggucagucaguggcgaucugauucucgagauagggaaacuuccucagcaccugacucagcgggcccagaacgcauuagacaauuugguuaugcugcauaacagcgaacaaggaggccgagcguauagacacgccauggaggagcucccggauaccaucgaaacacugaugcuucuggcucucauugccguguugaccggugggguaacucuguuuuucuuauccggccgcggacuaggcaagacgucuaucgggcugcucugugugauggcaagcuccguccuucuguggauggcuucaguggagccacauuggauugccgcaucuaucauauuggaauuuuuccugaugguucuccugauccccgagccugacaggcagcggacaccccaggauaaucagcuugccuacguggucauuggacuccuguuuaugaucuugacaguagcugcgaacgagaugggucuguuagaaacuaccaaaaaggaccuaggcauugggcacguggccguugagaaccaccaucacgcagcuaugcuggauguggaccuccauccagccagugccuggacacuuuacgcagucgcuaccacuaucauaacaccuaugaugcgucacacgauugaaaauaccacugccaacaucucgcugacagcgauugcuaaucaagccgcaaucuugaugggacuggauaaaggcuggcccauaagcaagauggacaucggugugccacuccuggcccuugggugcuauucccaggucaacccuuuaacccugaccgcugcagugcucauguugguugcccauuacgcgauuaucggcccgggacugcaggcuaaggccacaagagaggcacaaaagaggacugccgcuggcauuaugaagaaucccacgguggaugggaucguagccauagaccuagauccaguggucuaugacgcaaaauucgaaaagcagcugggacagauuaugcuccuuauccuguguaccucucagaucuugcugaugcgcacaacuugggcucucugcgagucaauuacccuggccacaggcccuuuaaccacucuuugggaggguagccccgggaaauuuuggaacacgacaaucgcgguuuccauggccaauauauuccggggaaguuaccuggcaggcgcuggucucgccuucucucuaaugaaaagccugggcgggggacgaagaggcaccggggcacaaggagaaacuuugggcgagaaguggaaaaggcagcugaaccagcucucaaaguccgaauuuaauaccuauaaacgcagugguauuauggagguggaccggagcgaagcuaaggaggggcuuaaaagaggagagacaacuaagcacgccgucucucguggcaccgccaagcugaggugguucguggaacggaacuugguaaaaccagaggguaaggugaucgaucugggcugugggcgcggaggcugguccuacuauugcgcggggcucaaaaagguuacagaagugaaaggauacacgaagggcgguccugggcacgaggaacccauuccgauggcuaccuacggauggaauuuagucaaacugcauucaggcaaggacguguuuuucaucccaccugagaagugugauacucuucugugcgacauaggcgagagcucgcccaacccaacaaucgaagaggggcgaacccuaagaguccucaaaaugguggaacccuggcugaggggaaaucaguuuuguauuaagaucuugaacccuuauaugccgucuguuguagagacucuggagcaaaugcagcggaaacacgguggcaugcucgugcgcaauccccuuaguagaaacuccacacaugaaauguacugggucagcugcgggaccggaaauauugugucagcaguuaacaugacguccaggaugcuguuaaaccgauucaccauggcccaccggaagccaacauaugagcgugauguggaccugggcgcugguacuagacacgucgccguggaaccugagguagcaaauuuggauaucauugggcagcgcaucgaaaacauaaaacaugagcacaagucuaccuggcauuacgacgaggauaaucccuauaagacaugggccuaccacggaagcuaugaagugaaaccuaguggcuccgcuagcucuaugguuaacggcgucgugaagcuccugacuaaaccaugggacgugauucccauggucacccagaucgcgaugacagauaccacuccuuuugggcaacagaggguuuucaaggagaaaguggacacgcggacaccaaaggccaagagaggaaccgcacagaucauggaaguaacugcuaaauggcuaugggguuuucuuucacgcaauaagaaacccaggauuuguacccgagaggaguucacacggaaggugagaaguaacgccgcaauaggcgccgucuuuguggacgagaaucaauggaacuccgcuaaagaggccguugaagaugagagguucugggaccuggugcaucgcgaacgugagcuccacaagcaggggaagugcgcgacgugcgucuacaauaugaugggaaaacgggaaaagaaacugggcgaguuugguaaggcaaaagggagcagagccaucugguacaugugguugggagcuagguuccuggaguucgaagcccucggcuuuaugaacgaggaucacugguucucucgcgaaaauucgcuuucaggcguggagggggagggacugcauaaguuagguuauauucugcgagacaucagcaaaauuccgggcgggaacauguacgcagaugacaccgcuggaugggauacucggaucacagaagacgauuugcagaaugaggccaagauaaccgacaucauggaaccugagcacgcucuccuggccaaguccauuuuuaaacuaacuuaucagaacaagguaguuagagugcaaaggccagccaagaauggcacagucauggaugugaucagucgcagagaccagcgggguucuggacaggugggaaccuacggccuuaacacauucacuaacauggaagcgcagcugauuaggcaaauggagagcgagggcaucuuuucccccucagaacucgagaccccuaaucuggccgggcgugucuuggauugguuagaaaagcauggaguugagcgacugaaacgcauggcuauaaguggugacgacugugugguaaagccaauugaugacagauucgccacggcacucaccgcucuuaacgauaugggcaaggugcggaaagacaucccccagugggaaccgucuaagggguggaaugauuggcagcaggucccuuuuugcagccaccacuuccaucaacugaucaugaaagacggaagggagauugugguucccugucgcaaccaggaugagcuagugggcagagcccgggucucccagggugcaggguggucacugagggaaacagccugccucggaaagagcuaugcgcagauguggcaauugauguacuuucaccgacgugaccugagacuugcugccaaugcaauauguucugccgugccaguagauuggguuccuacuucccgcaccacauggaguauccaugcucaccaucaguggaugacuaccgaggacaugcugagcguguggaaccgggucuggauugaagagaaucccuggauggaagauaaaacgcacaucucguccuggggcgacgugccauaucucggcaagagggaggaccaguggugcgggucuuuaauuggacugacagccagagcaaccugggcuacuaacauccaaguugccauaaaucaggugcgccgguugaucgguaacgagaauuaccuggauuacaugacaucaaugaagagguucaaaaacgaaagcgaccccgagggcgcgcucugguga

SEQ ID NO: 13568 - RNA, 9879 nt, Artificial Sequence
  derived and/or modified CDS sequence (opt3) from DENV-1__EU677165__SS-prME
agcgugaccaugcugcucaugcuuaugcccaccgcccuggcuuuccacuugacuacgcggggcggggaaccucauaugaucgucuccaagcaggaaaggggaaagucuuuacuguuuaagaccucagccgguguuaauaugugcacacuaauugccauggaccucggcgaacugugugaagauacuauaaccuacaagugcccacggaucacagaaaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauucagaggguggaaaccugggcccuccggcacccuggauucacaguuaucgcucuguuucuggcacaugccauuggcaccucgaucacgcagaagggcauaaucuucauucucuuaaugcuggcuacuccaucaauggccaugcgcugcguggggaucggaagcagagauuuugucgagggucuuaguggcgcgacauggguggacguaguuuuggagcacggguccugugugaccacuauggcaaaggauaaacccacacuggacauugaacuacucaagaccgaggucacgaacccugccgugcugaggaaacuuugcaucgaagcuaagauaucuaauaccacaacugauagccgguguccaacccaaggagaggccacacugguggaagaacaggacgcaaacuucgucugccgccgaacuuuuguugauagaggcugggguaauggguguggauuguucggcaaaggcucccucauuaccugcgcuaaguuuaagugcgugacaaaacuggaggggaagaucguacaguacgaaaacuuaaaauauucagugauugucaccgugcacacuggagaccagcaucaaguugguaaugagaguacggaacacggcacaaccgccacuaucacaccccaggcgccuacaaccgagauccagcugacugacuacggggcccucacacuugauuguagcccaaggacgggacuggacuucaacgaaaugguguugcuaaccaugaaggagaaaucuuggcugguccauaagcagugguuucucgaucugccgcuucccuggacuuccggcgcaucaacaagccaagagaccuggaaucggcaggaccuguuggugacauucaaaacugcucacgccaagaagcaggaaguaguugugcucgguagucaagagggggcuaugcacaccgcccugacgggcgcaaccgaaauucagacaucuggaacuaccacaauauuugccggccauuuaaaaugccgucugaagauggauaaacuaacucuccgcgggauguccuaugucauguguaccgggucguucaagcuggagaaagaaguggcugagacgcagcacgguacaguccuugugcagaucaaguacgagggcaccgacgcgccuugcaagauuccauucucgacucaagaugaaaaagggguuacacagaacggaagauugaucaccgcaaaucccauagugacugacaaggagaaaccuguaaacauugaagccgagccacccuuuggcgagucuuauaucgucaucggugcuggggaaaaggcccugaaacucuccugguucaagaagggcucaaguauuggaaaaauguuugaggcaaccgccaggggcgcucggcgaauggccauccugggggauacagcaugggacuucggaagcauugguggcguguuuacguccguugggaaacuugugcaucagauauucggaaccgcguacggcguccuguuuucuggugugagcuggacuaugaaaaucgggauuggcguauugcucacauggcugggauuaaauucacgcaguaccucccugagcaugacauguaucgcugugggccuaguuacucucuaccugggggucauggugcaggccgauucuggaugcgugaucaacuggaagggcagagaacuuaaaugugguucagggauuuucgucaccaaugagguucacacguggacagaacaauauaaguuucaggcagacaguccgaagagguugagcgccgcuauaggaaaagccugggaggagggcgugugcgguauccgguccgcaacccgccuggaaaacauuauguggaagcagaucucuaacgagcucaaucauauucuguuagaaaacgacaugaaauucacugugguagucggcgauguggcugggauccuggcccagggaaagaaaaugauaagaccucaacccauggagcacaaguacucguggaaaagcuggggcaaggcgaagaucauuggggccgacguucagaauaccacauuuaucauugauggaccaaacacuccugaaugucccgacgaucagagggcuuggaauaucugggagguggaggacuauggcuucgguauauuuaccacaaacauuuggcuuaaauugcgugauuccuacacgcaggucugcgaccaccggcucaugucagcagccaucaaggauaguaaagcugugcaugccgacaugggguauuggauugaaucugagaagaaugaaaccuggaaacuggcacgagcgagcuucaucgagguuaagacuuguauauggccaaagucccacacacuauggucaaacggagugcuggaaagcgagaugaucauucccaaaaucuacggcgguccuauuucucaacauaauuauagaccaggcuacuucacccagacugccgggccguggcaccucggaaagcuggagcuugauuuugacuugugcgaaggcacaaccguagucguggaugagcacugcgggaacaggggacccucccugcgcacgacuaccgugacaggcaaaaucauacaugaaugguguugccggaguuguaccuuaccuccacucagauucaggggugaggacgggugcugguacggaauggagauucgccccgucaaggaaaaagaggaaaaucugguuaagagcauggugucugcuggcuccggugagguagacucauuuagucuuggccuguuguguaucagcaucaugauugaagaggugaugcgaucgcgguggucccguaagaugcucaugacugggacacuggccgucuucuuucuacugaucaugggacagcucaccuggaacgaucugauuagacuuugcauaauggugggcgcaaaugcuucugacaggauggggaugggaacaacuuauuuggcccugauggcaaccuucaaaaugcgcccuauguuugccguuggcuuacucuuccggagacugacgagcagggaggugcuucugcuaacaaucggucucucacuggucgcuaguguggaauugccaaacucccuggaggaauuaggggauggacucgcgaugggcauuaugauccugaaacuucugaccgacuuucaaucucaccaguugugggccacucuccugagccuaaccuucauuaaaacaacuuuuucccugcauuacgcauggaagaccauggcuaugguucuuucaaucgugagccucuucccccuguguuugaguacgacaucucagaaaaccacuuggcugccggucuuacucggcucccuggggugcaagccucuuacaauguuucugauagccgagaauaagaucuggggacgacgcagcuggccauugaacgaagguauuauggccguaggcaucgugucgauucuccugucaucucuacugaaaaacgauguuccccuugcugggccucucaucgcaggaggcaugcugauagccuguuaugugauuagugguuccagcgcggacuugucuuuagagaaggcugccgaggucagcugggaagaggaagcagagcacuccggggccucacauaauauccugguggaaguacaggaugacggaaccaugaaaaucaaggaugaggagcgggacgauacucucacaauucugcuuaaagcuacccuguuggcagugaguggcgucuacccccuaagcauaccagccacgcuguucguuugguauuucuggcaaaagaaaaagcagagaucuggcgugcucugggacacuccuucacccccagaaguggagagggcgguccuggaugacgggaucuaccguauuaugcagcgcggacuuuuaggucggagccaggugggcguugggguauuucaagaaaacguguuccacaccauguggcacgucacaagaggagcugugcugauguaucagggcaagaggcucgagccgaguugggccagcguuaaaaaggacuugaucuccuacggugggggauggcgacugcagggcucuuggaauaccggcgaggaagugcaggucauugcaguggagccugggaaaaaccccaagaauguacaaacagccccaggaacuuuuaaaacccccgaaggugaggucggcgcuaucgcccucgauuucaagccugggacgucgggaagcccaauagugaaccgggaaggcaagaucguuggucuguacgggaauggaguggucacaacuucaggcaccuauguguccgcaauugcucaggccaaagcgagucaggagggcccccuuccugagaucgaagacgagguuuuucgcaagagaaaccugacaauuauggauuugcauccggggucuggaaaaaccaggcgguaccuaccagccaucgugcgagaagcaauaaagagaaaacugcgcacucucauuuuagcucccaccagggucguggccagcgagauggcugaagcacugaaggguaugccuauccguuaucaaacaacggccguaaaguccgagcacacuggcaaagagaucguggaccuuaugugccaugccaccuucacaaugcggcugcucucaccaguuagaguccccaauuacaacaugauuaucauggaugaagcucacuuuaccgacccuucuagcauagcggcaaggggguauauuaguacucgcgugggaaugggcgaggccgcugccaucuucaugacagcaaccccgcccgguuccguggaagccuuuccacagagcaaugcugucauucaggaugaggaacgagacaucccugagagaucuuggaacucaggguacgaguggauaacggauuuccccggaaagacuguaugguuugugccauccauuaaaaguggcaaugacaucgcgaacuguuugcggaagaauggcaaaaggguuauccagcugagccgcaagacauucgauaccgaauaucaaaagaccaaaaacaacgacugggacuacguggucacuacagauauuucggagaugggggccaauuuccgugcagacagagugaucgauccucggaggugccucaagcccguuauucugaaagacggaccagaacgcgugauacuugcugguccgaugccugucaccguggccucugcagcccagcgaagaggccggaucgggaggaaccauaauaaggagggagaucaguacauuuauaugggccagccccuaaacaaugacgaggaucacgcucacuggacagaagccaaaaugcuguuggacaacaucaauacuccagaggguaucauucccgcguuauuugaaccugagcgcgaaaaguccgcagccauagauggggaguacagacugaggggcgaggcucggaagacguucguagaacucaugcgucgcggagaccugccaguguggcuuagcuauaaaguugccucagagggcuuucaauacagugaucgaagauggugcuucgacggggaaaggaacaaucagguccuggaggaaaacauggauguggagaucuggaccaaggagggagaacggaaaaagcuccgccccagaugguuggacgcuaggacauauucugacccucuggcacuacgggaguuuaaagaguucgccgcuggucgaagauccgugagcggcgaucugauucucgagaucgggaaacuuccgcagcaucugacucagcgcgcccaaaaugcauuagacaacuuggucaugcugcacaauucagaacagggaggcagggcguaccggcaugccauggaggagcucccagauaccauugaaacacugaugcuucuggcucucaucgccguuuugaccgguggggugacucuguuuuucuuaaguggccguggacuaggcaaaacgagcauagggcugcucuguguaauggcauccucugugcuucuguggauggcuagcgucgagccccacuggaucgccgcauccauuaucuuggaauuuuuccugauggugcuccugauuccugagcccgacagacagaggaccccacaggauaaccaacuugccuauguugugaucggacuccuguuuaugauauugacagucgcugcgaaugagaugggucuguuagaaacuaccaagaaggaccuaggcauugggcacguagccguggagaaccaucaccaugcagcuaugcuggauguugaccuccacccugccucagccuggacacuuuacgcaguggcuaccacuaucauuacacccaugaugcgccauacgaucgaaaacaccacugccaauauaucucugacagcgaucgcuaaccaggccgcaauuuugaugggacuggauaaaggcuggccaaucaguaagauggacauuggugucccucuccuggcccuugggugcuacagccaggugaauccguuaacccugaccgcugcaguccucauguugguggcccacuaugcgaucauaggccccggacugcaagcuaaagccacacgggaggcacagaagcgaacugccgcuggcauuaugaaaaacccaacgguugaugggaucguggccaucgaccuagauccuguaguguacgacgcaaaguucgaaaagcagcugggacagauuaugcuccuuauccuguguaccagccaaauauugcugaugagaacaacuugggcucucugcgaguccauuacccuggccacaggccccuuaaccacucuuugggaggguucuccagggaaauuuuggaauacgacaaucgcggucucaauggccaacauuuucaggggaagcuaucuggcaggcgcuggucucgccuucucccuaaugaagagucugggcgggggacgccggggcaccggggcacagggagaaacuuugggcgagaaauggaagagacagcugaaucagcucucuaaaagcgaauuuaacaccuacaagcguucagguaucauggagguugacagguccgaagcuaaggaggggcuuaaacggggagagacaacuaagcacgccgugagucgcggcaccgccaaacugcgaugguucgucgaaagaaauuuggugaagccugaggguaaaguaauagaucugggcugugggaggggaggcuggagcuauuacugcgcggggcucaagaaggugacagaaguuaaaggauauacgaagggcggucccgggcaugaggaaccgaucccaauggcuaccuacggauggaacuuagugaaacugcacucuggcaaggacgucuuuuucauuccucccgagaaaugugauacucuucugugcgacaucggcgaguccucaccaaaucccacaauugaagaggggcggacccuacgcgugcucaagauggucgaaccuuggcugagaggaaaccaauuuuguaucaaaauuuugaauccguacaugcccagcgugguugagacucuggagcagaugcagaggaagcaugguggcaugcucguacgaaacccacuuucgagaaauucuacacacgaaauguauugggugaguugcgggaccggaaacaucgucuccgcagugaauaugacgagccguaugcuguuaaacagauucaccauggcccaccgcaagccuacauacgagagggauguugaccugggcgcugguacucggcauguggccgucgaacccgagguggcaaacuuggauauaauugggcagagaaucgaaaauaucaaacacgagcauaagucaaccuggcacuaugacgaggauaacccuuacaaaacaugggccuaucauggauccuacgaaguaaagccaucuggcagcgcuaguuccauggugaauggcguugucaaacuccugacuaagcccugggacgugauuccuauggugacccaaauagcgaugacagauaccacuccauuugggcagcagcgcgucuucaaggagaaaguugacacgaggacacccaaggccaaacgaggaaccgcacaaaucauggaagugacugcuaaguggcuaugggguuuucuugcccggaacaaaaagccgagaauuuguaccagggaggaguucacacgcaagguacguagcaaugcagccaucggcgcuguguuugucgacgagaaccaguggaacucugccaaagaggcgguggaagaugagcgguucugggaccugguucacagagaaagggagcuccacaagcaggggaaaugcgcaacgugcguguauaacaugaugggaaagcgcgagaagaagcugggcgaguuugguaaggccaaagggucacgagcuauuugguacaugugguugggagcccgguuccuggaguucgaagcacucggcuuuaugaaugaggaucauugguucaguagagaaaacucccuuagcggcgucgagggggagggacugcacaaguuagguuacauccugagggacauaucuaaaaucccuggcgggaauauguaugcugaugacaccgccggaugggauacucgcauuacagaagacgauuugcagaacgaggcuagaaucaccgacauuauggaaccagagcaugcccuccuggcaaagucgaucuuuaaacuaacuuaccaaaauaaggugguacggguucagaggcccgcgaaaaacggcacagugauggaugucauaucacgucgagaccagcgcgguagcggacaggugggaaccuauggccuuaauacauucacuaacauggaagcccaacugauuagacagauggaguccgagggcaucuuuaguccuucugaacucgagaccccaaaccuggcugaacggguguuggauugguuagagaaguacggggucgaaaggcugaagcgcauggccaucagcggagacgacuguguugugaaacccauugaugacagauucgcaacggcucucaccgcccuuaaugauauggguaagguacggaaagacauaccgcagugggagccuuccaagggcuggaacgauuggcagcaagugcccuuuugcucacaccacuuccaucagcugaucaugaaagacgggagggagauugucgugccaugucgaaaucaggaugagcuaguuggacgugcaagagugagucagggcgccgguuggucucugcgcgagacagcgugccucgggaaguccuaugcucaaauguggcaguugauguacuuucaccggagggaccugagacuugccgcaaacgccaucuguuccgcugucccuguggauuggauucccacuucacgcaccacauggagcauccaugcccaccaucaguggaugacuaccgaagacaugcugucuguauggaaucggguuuggauagaggaaaacccauggauggaggauaagacgcacaucuccaguuggggagacgugcccuaucucggcaaaagggaggaccaauggugcggcagcuuaauugggcugacagcacgagcuaccugggccacuaauauccaggucgcgauuaaccaggugagacgguugaucggaaaugaaaacuaccuggauuacaugacaucgaugaagagguucaaaaaugaguccgacccugaaggugcucucugguga

SEQ ID NO: 13569 - RNA, 9879 nt, Artificial Sequence
  derived and/or modified CDS sequence (opt3) from DENV-1__EU677140__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauuaucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaaaaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauucccacacgcaggucugcgaccaccgucucaugucagcugcaaucaaagauaguaaggccgugcaugcugacaugggguauuggauugaaucugagaaaaaugaaaccuggaagcuggcccgggcauccuucaucgagguuaagacuuguauauggccaaaaucccacacacuauggucaaacggagugcuggaaagcgagaugaucauucccaagaucuacggcgguccuauuucucaacauaauuaucgaccaggcuacuucacccagacugcggggccguggcaccucggaaaacuggagcuugauuuugacuugugcgaaggcacaaccguagucguggaugagcacugcgggaacagaggacccucccugaggacgacuaccgugacaggcaagaucauacaugaaugguguugccgcaguuguaccuuaccuccacuccgguucagaggugaggacgggugcugguacggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuucuuucuacugaucaugggacagcucaccuggaacgaucugauucgucuuugcauaauggugggcgccaaugcaucugacagaauggggaugggaacaacuuauuuggcucugauggccaccuucaagaugaggccuauguuugcaguuggcuuacucuuccgccggcugacgagcagagaggugcuucugcuaacaaucggucucucacuggucgccaguguggaauugccaaacucccuggaggaauuaggggauggacucgcuaugggcauuaugauccugaaacuucugaccgacuuucaaucucaccaguugugggcgacucuccugagccuaaccuucauuaagacaacuuuuucccugcauuacgccuggaaaaccauggcaaugguucuuucaaucgugagccucuucccccuguguuugaguacgacaucucagaagaccacuuggcugccggucuuacucggcucccuggggugcaagccucuuacaauguuucugauagcugagaauaaaaucuggggaaggcgaagcuggccauugaacgaagguauuauggccguaggcaucgugucgauucuccugucaucucuacugaagaacgauguuccccuugccgggccucucaucgcuggaggcaugcugauagcauguuaugugauuagugguuccagcgccgacuugucuuuagagaaagcggcugaggucagcugggaagaggaagccgagcacuccggggcaucacauaauauccugguggaaguacaggaugacggaaccaugaagaucaaagaugaggagcgcgacgauacucucacaauucugcuuaaggccacccuguuggcugugaguggcgucuacccccuaagcauaccagcaacgcuguucguuugguauuucuggcagaaaaagaagcagcggucuggcgugcucugggacacuccuucacccccagaaguggagagagccguccuggaugacgggaucuacaggauuaugcagcguggacuuuuaggucgcagccaggugggcguugggguauuucaagaaaacguguuccacaccauguggcacgucacacggggagcggugcugauguaucagggcaaaagacucgagccgaguugggcuagcguuaagaaagacuugaucuccuacggugggggauggaggcugcagggcucuuggaauaccggcgaggaagugcaggucauugccguggagccugggaagaaccccaaaaauguacaaacagcaccaggaacuuuuaagacccccgaaggugaggucggcgccaucgcucucgauuucaagccugggacgucgggaagcccaauagugaaccgagaaggcaaaaucguuggucuguacgggaauggaguggucacaacuucaggcaccuauguguccgccauugcacaggcuaaggccagucaggagggcccccuuccugagaucgaagacgagguuuuucggaaacgcaaccugacaauuauggauuugcauccggggucuggaaagaccagaagguaccuaccagcgaucgugcgggaagccauaaaacgaaagcugagaacucucauuuuagcacccacccgcgucguggcuagcgagauggccgaagcucugaaggguaugccuaucagguaucaaacaacggcaguaaaauccgagcacacuggcaaggagaucguggaccuuaugugccaugccaccuucacaaugcgucugcucucaccaguucggguccccaauuacaacaugauuaucauggaugaagcccacuuuaccgacccuucuagcauagcugcgagaggguauauuaguacuagggugggaaugggcgaggcagccgcuaucuucaugacagccaccccgcccgguuccguggaagcauuuccacagagcaaugccgucauucaggaugaggaacgcgacaucccugagcgaucuuggaacucaggguacgaguggauaacggauuuccccggaaaaacuguaugguuugugccauccauuaagaguggcaaugacaucgcuaacuguuugaggaaaaauggcaagcggguuauccagcugagcaggaagacauucgauaccgaauaucagaaaaccaagaacaacgacugggacuacguggucacuacagauauuucggagaugggggcgaauuuccgcgccgaccgugugaucgauccuagacggugccucaaacccguuauucugaaggacggaccagaaagggugauacuugcagguccgaugccugucaccguggcuucugccgcacagcgccgaggcagaaucgggcggaaccauaauaaagagggagaucaguacauuuauaugggccagccccuaaacaaugacgaggaucacgcccacuggacagaagcuaagaugcuguuggacaacaucaauacuccagaggguaucauucccgccuuauuugaaccugagagggaaaaguccgcggcaauagauggggaguaccgccugagaggcgaggccaggaaaacguucguagaacucaugcggcguggagaccugccaguguggcuuagcuauaagguugcuucagagggcuuucaauacagugaucgccgauggugcuucgacggggaaagaaacaaucagguccuggaggaaaacauggauguggagaucuggaccaaagagggagaaaggaagaaacuccggccccgcugguuggacgccagaacauauucugacccucuggcucuaagggaguuuaaggaguucgcagccggucggcgauccgugagcggcgaucugauucucgagaucgggaaacuuccgcagcaucugacucagagagcucaaaaugccuuagacaacuuggucaugcugcacaauucagaacagggaggccgcgcauacaggcaugcgauggaggagcucccagauaccauugaaacacugaugcuucuggcccucaucgcuguuuugaccgguggggugacucuguuuuucuuaaguggccggggacuaggcaagacgagcauagggcugcucuguguaauggccuccucugugcuucuguggauggcaagcgucgagccccacuggaucgcugccuccauuaucuuggaauuuuuccugauggugcuccugauuccugagcccgaccgucagagaaccccacaggauaaccaacuugcauauguugugaucggacuccuguuuaugauauugacagucgccgcuaaugagaugggucuguuagaaacuaccaagaaagaccuaggcauugggcacguagcgguggagaaccaucaccaugccgcaaugcuggauguugaccuccacccugcuucagccuggacacuuuacgccguggcaaccacuaucauuacacccaugaugaggcauacgaucgaaaacaccacugcuaauauaucucugacagccaucgcgaaccaggcugccauuuugaugggacuggauaagggcuggccaaucaguaaaauggacauuggugucccucuccuggcacuugggugcuacagccaggugaauccguuaacccugaccgccgcuguccucauguugguggcacacuaugccaucauaggccccggacugcaagcgaaggcuacacgcgaggcccagaaacggacugcagccggcauuaugaagaacccaacgguugaugggaucguggcuaucgaccuagauccuguaguguacgacgccaaguucgaaaaacagcugggacagauuaugcuccuuauccuguguaccagccaaauauugcugaugcgaacaacuugggcacucugcgaguccauuacccuggcuacaggccccuuaaccacucuuugggaggguucuccagggaaguuuuggaauacgacaaucgccgucucaauggcgaacauuuucagaggaagcuaucuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuacaagagaucagguaucauggagguugaccguuccgaagcaaaagaggggcuuaagaggggagagacaacuaaacacgcugugagucggggcaccgccaagcugcgcugguucgucgaacgaaauuuggugaaaccugaggguaagguaauagaucugggcugugggagaggaggcuggagcuauuacugcgccgggcucaagaaagugacagaaguuaagggauauacgaaaggcggucccgggcaugaggaaccgaucccaauggcgaccuacggauggaacuuagugaagcugcacucuggcaaagacgucuuuuucauuccucccgagaagugugauacucuucugugcgacaucggcgaguccucaccaaaucccacaauugaagaggggaggacccuacgggugcucaaaauggucgaaccuuggcugcgcggaaaccaauuuuguaucaagauuuugaauccguacaugcccagcgugguugagacucuggagcagaugcagagaaagcaugguggcaugcucguaaggaacccacuuucgcgaaauucuacacacgaaauguauugggugaguugcgggaccggaaacaucgucuccgcugugaauaugacgagccggaugcuguuaaaccguuucaccauggcacacagaaaaccuacauacgagcgcgauguugaccugggcgccgguacuaggcauguggcugucgaacccgagguggccaacuuggauauaauugggcagcggaucgaaaauaucaagcacgagcauaaaucaaccuggcacuaugacgaggauaacccuuacaagacaugggcauaucauggauccuacgaaguaaaaccaucuggcagcgccaguuccauggugaauggcguugucaagcuccugacuaagcccugggacgugauuccuauggugacccaaauagcuaugacagauaccacuccauuugggcagcagagagucuucaaagagaagguugacacgcgcacacccaaagcgaagaggggaaccgcccaaaucauggaagugacugcaaaauggcuaugggguuuucuuagccgaaacaagaagccgcggauuuguaccagagaggaguucacaaggaaaguacgcucuaaugcugccaucggcgcaguguuugucgacgagaaccaguggaacucagccaaggaggcuguggaagaugagcguuucugggaccugguucaccgggaaagagagcuccacaaacaggggaagugcgccacgugcguguauaacaugaugggaaaaagggaaaagaagcugggcgaguuugguaaagcgaaggggagucgcgcaauuugguacaugugguugggagcccgauuccuggaguucgaagcucucggcuuuaugaaugaggaucauugguucucccgggaaaacagccuuucuggcgucgagggggagggacugcacaaauuagguuacauccugagagacauaucgaagaucccuggcgggaauauguaugccgaugacaccgcaggaugggauacuaggauuacagaagacgauuugcagaacgaggcucgcaucaccgacauuauggaaccagagcaugcccuccuggcuaaaucaaucuuuaagcuaacuuaccaaaauaaagugguaagaguucagcggcccgccaagaacggcacagugauggaugucauaagcaggcgugaccagcgagguuccggacaggugggaaccuauggccuuaauacauucacuaacauggaagcacaacugauucgccagauggagagugagggcaucuuuucuccuagcgaacucgagaccccaaaccuggcggaaagaguguuggauugguuaaagaaauacggggucgagcggcugaagaggauggccaucuccggagacgacuguguugugaaacccauugaugaccgcuucgcuacggcccucaccgcacuuaaugauauggguaagguaagaaaagacauaccgcagugggaaccuucaaagggcuggaacgauuggcagcaagugcccuuuugcagucaccacuuccaucagcugaucaugaaggacgggcgggagauugucgugccauguaggaaucaggaugagcuaguuggacgagcucgugugucucagggcgccgguuggagccugagagaaacagcaugccucgggaaauccuaugcccaaauguggcaguugauguacuuucaccgccgggaccugaggcuugcggcuaacgccaucuguucagcagucccuguggauuggauucccacuagcagaaccacauggucuauccaugcccaccaucaguggaugacuaccgaggacaugcuguccguauggaaucgcguuuggauagaagagaacccauggauggaagauaagacgcacaucaguagcuggggagacgugcccuaucucggcaaacgggaggaccaauggugcggcucguuaauugggcugacagcuagggccaccugggcaacuaauauccaggucgcuauuaaccaggugcgaagauugaucggaaaugagaacuaccuggauuacaugacauccaugaagcgguucaaaaaugaaggugacccugagggcgcccucugguga

SEQ ID NO: 13570 - RNA, 9879 nt, Artificial Sequence
  derived and/or modified CDS sequence (opt3) from DENV-1__EU677166__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgagagagccgugcuggaugacgggauauauaggaucaugcagcguggacuuuuaggucgcagccagguuggcguagggguguuucaagaaaacgucuuccauaccauguggcacgugacacggggagcgguucugauguaccagggcaaaagacucgagccgaguugggcuagcgugaagaaagacuugauuuccuacggugggggauggaggcugcagggcucuuggaauaccggcgaggaaguccaggugaucgccguagagccugggaagaaccccaaaaauguccaaacagcaccaggaacuuuuaagacccccgaaggugaggugggcgccauugcucucgauuucaagccugggacgucgggaagcccaaucguuaaccgagaaggcaaaauagugggucuguaugggaauggagucgugacaacuucaggcaccuacguuuccgccaucgcacaggcuaaggccagucaggagggcccccuuccugagauugaagacgagguguuucggaaacgcaaccugacaaucauggauuugcacccggggucuggaaagaccagaagguaucuaccagcgauuguccgggaagccaucaaacgaaagcugagaacucucauauuagcacccacccgcgugguagcuagcgagauggccgaagcucugaaggguaugccuauuagguaccaaacaacggcagugaaauccgagcauacuggcaaggagaucguugaccuuaugugccacgccaccuucacaaugcgucugcucucaccaguccgggugcccaauuauaacaugaucauuauggaugaagcccauuuuaccgacccuucuagcaucgcugcgagaggguacauaaguacuagggugggaaugggcgaggcagccgcuauuuucaugacagccaccccgcccgguuccgucgaagcauuuccacagagcaaugccguaauccaggaugaggaacgcgacauuccugagcgaucuuggaacucaggguaugaguggaucacggauuuccccggaaaaacugugugguuuguuccauccauaaagaguggcaaugacauugcuaacuguuugaggaaaaauggcaagcgggugauccagcugagcaggaagacauucgauaccgaauaccagaaaaccaagaacaacgacugggacuacgucgugacuacagauaucucggagaugggggcgaauuuccgcgccgaccguguuauugauccuagacggugccucaaacccgugauccugaaggacggaccagaaagggucauucuugcagguccgaugccugugaccguagcuucugccgcacagcgccgaggcagaauagggcggaaccacaauaaagagggagaucaguauaucuacaugggccagccccuaaacaaugacgaggaucaugcccacuggacagaagcuaagaugcuguuggacaacauuaauacuccagaggguaucauccccgccuuauuugaaccugagagggaaaaguccgcggcaauugauggggaguaucgccugagaggcgaggccaggaaaacguucguggaacucaugcggcguggagaccugccaguuuggcuuagcuacaaggucgcuucagagggcuuucaauauagugaucgccgauggugcuucgacggggaaagaaacaaucaggugcuggaggaaaacauggauguggagauauggaccaaagagggagaaaggaagaaacuccggccccgcugguuggacgccagaacauacucugacccucuggcucuaagggaguuuaaggaguucgcagccggucggcgauccgucagcggcgaucugauccucgagauugggaaacuuccgcagcaccugacucagagagcucaaaaugccuuagacaacuugguuaugcugcauaauucagaacagggaggccgcgcauauaggcacgcgauggaggagcucccagauaccaucgaaacacugaugcuucuggcccucauugcuguguugaccggugggguaacucuguuuuucuuaaguggccggggacuaggcaagacgagcaucgggcugcucugugugauggccuccucuguccuucuguggauggcaagcguggagccccauuggauagcugccuccaucauuuuggaauuuuuccugaugguucuccugaucccugagcccgaccgucagagaaccccacaggauaaccaacuugcauacguggucauuggacuccuguuuaugaucuugacaguagccgcuaaugagaugggucuguuagaaacuaccaagaaagaccuaggcauagggcacguggcgguugagaaccaccaucacgccgcaaugcuggauguggaccuccauccugcuucagccuggacacuuuacgccgucgcaaccacuauuaucacacccaugaugaggcacacgauugaaaacaccacugcuaauaucucucugacagccauagcgaaccaggcugccaucuugaugggacuggauaagggcuggccaauuaguaaaauggacaucggugugccucuccuggcacuugggugcuauucgcaggucaauccguuaacccugaccgccgcugugcucauguugguugcacauuacgccauuaucggccccggacugcaagcgaaggcuacacgcgaggcccagaaacggacugcagccggcauaaugaagaacccaacgguggaugggauuguagcuaucgaccuagauccuguggucuaugacgccaaguucgaaaaacagcugggacagaucaugcuccuuauucuguguaccagccaaaucuugcugaugcgaacaacuugggcacucugcgaguccauaacccuggcuacaggccccuuaaccacucuuugggaggguucuccagggaaguuuuggaauacgacaauugccguuucaauggcgaacaucuucagaggaagcuaccuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuauaagagaucagguauuauggagguggaccguuccgaagcaaaagaggggcuuaagaggggagagacaacuaaacacgcugucagucggggcaccgccaagcugcgcugguucguggaacgaaauuugguaaaaccugaggguaaggugaucgaucugggcugugggagaggaggcuggagcuacuauugcgccgggcucaagaaaguuacagaagugaagggauacacgaaaggcggucccgggcacgaggaaccgauaccaauggcgaccuacggauggaacuuagucaagcugcauucuggcaaagacguguuuuucaucccucccgagaagugugauacucuucugugcgacauuggcgaguccucaccaaaucccacaaucgaagaggggaggacccuacggguccucaaaaugguggaaccuuggcugcgcggaaaccaauuuuguauuaagaucuugaauccguauaugcccagcguuguagagacucuggagcagaugcagagaaagcacgguggcaugcucgugaggaacccacuuucgcgaaauucuacacaugaaauguacugggucaguugcgggaccggaaacauuguguccgcuguuaauaugacgagccggaugcuguuaaaccguuucaccauggcacacagaaaaccuacauaugagcgcgauguggaccugggcgccgguacuaggcacgucgcuguggaacccgagguagccaacuuggauaucauagggcagcggauugaaaauaucaagcaugagcacaaaucaaccuggcauuacgacgaggauaacccuuauaagacaugggcauaccacggauccuaugaagugaaaccaucuggcagcgccaguuccaugguuaauggcgucgugaagcuccugacuaagcccugggacgugaucccuauggucacccaaauugcuaugacagauaccacuccauuugggcagcagagaguuuucaaagagaagguggacacgcgcacacccaaagcgaagaggggaaccgcccaaauaauggaaguaacugcaaaauggcuaugggguuuucuuagccgaaacaagaagccgcggaucuguaccagagaggaguucacaaggaaagugcgcucuaaugcugccauuggcgcagucuuuguggacgagaaccaguggaacucagccaaggaggcuguugaagaugagcguuucugggaccuggugcaucgggaaagagagcuccacaaacaggggaagugcgccacgugcgucuacaacaugaugggaaaaagggaaaagaagcugggcgaguuugguaaagcgaaggggagucgcgcaaucugguacaugugguugggagcccgauuccuggaguucgaagcucucggcuuuaugaaugaggaucacugguucucccgggaaaacagccuuucuggcguggagggggagggacugcauaaauuagguuauauucugagagacaucucgaagauaccuggcgggaauauguacgccgaugacaccgcaggaugggauacuaggaucacagaagacgauuugcagaacgaggcucgcauuaccgacaucauggaaccagagcacgcccuccuggcuagaucaauuuuuaaacuaacuuaucaaaauaagguaguucgggugcagaggcccgccaaaaacggcacagucauggaugugaucagccgucgagaccagcgcgguuccggacaggugggaaccuacggccuuaauacauucacuaacauggaagcacaacugauaagacagauggagagugagggcauauuuucuccuagcgaacucgagaccccaaaccuggcggaacgggucuuggauugguuagagaaguaugggguugaaaggcugaagcgcauggccaucuccggagacgacugugugguaaaacccaucgaugacagauucgcuacggcccucaccgcacuuaaugauauggguaaggugcggaaagacauuccgcagugggagccuucaaagggcuggaacgauuggcagcaaguccccuuuugcagucaucacuuccaccagcugauaaugaaagacgggagggagaucgugguuccaugucgaaaucaggaugagcuagugggacgugcuagagucucucagggcgccgguuggagccugcgcgagacagcaugccucgggaaguccuacgcccaaauguggcaguugauguauuuucaucggagggaccugagacuugcggcuaacgccauuuguucagcagugccuguaaauuggauccccacuagccgcaccacauggucuauucacgcccaucaccaguggaugacuaccgaagauaugcuguccguuuggaaccggguguggaucgaggaaaauccauggauggaggacaagacgcauauaaguagcuggggagauguccccuaccucggcaaaagggaggaccaauggugcggcucguuaaucgggcugacagcucgagccaccugggcaacuaacauucagguggcuaucaaucagguuagacgguugauuggaaacgaaaauuaccuggacuauaugacauccaugaagagguucaaaaacgagucugauccugaaggugcccucugguga

SEQ ID NO: 13571 - RNA, 9879 nt, Artificial Sequence
  derived and/or modified CDS sequence (opt3) from DENV-1__EU677170__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggaugaaacuuagggauuccuauacacaggugugcgaccaccguuugaugucagcugcaauuaaagauaguaaggccguucacgcugacaugggguacuggaucgaaucugagaaaaaugaaaccuggaagcucgcccgggcauccuucauugaggugaagacuuguaucuggccaaaaucccauacacuguggucaaacggaguacuagaaagcgagaugauaauccccaagauuuauggcgguccuaucucucaacacaauuaccgaccaggcuacuucacccagacugcggggccguggcaucugggaaaacucgagcuggauuuugaccuuugcgaaggcacaaccgucgugguggaugagcacugcgggaacagaggacccuccuugaggacgacuaccgucacaggcaagauuauccacgaaugguguugccgcaguuguacccugccuccauuacgguucagaggugaggacgggugcugguauggaauggagauaaggcccguuaaagaaaaggaggaaaaucucguaaagagcaugguaucugccggcuccggugagguggacucauuuagucugggccuucuguguauuagcaucaugaucgaagaggucaugcgcucgcgauggucccggaaaauguugaugacugggacacucgcuguguucuuucugcuaauuaugggacagcugaccuggaacgaucucauccgucugugcauuaugguuggcgccaaugcaucugacagaauggggaugggaacaacuuaccuugcuuugauggccaccuucaagaugaggccuauguuugcagugggccuguuauuccgccggcucacgagcagagagguccugcuucugacaauaggucuaucacucguggccaguguugaacugccaaacuccuuggaggaacugggggauggauuagcuaugggcaucaugauucucaaacugcuuaccgacuuucaaucucaucagcugugggcgacuuugcucagccugaccuucaucaagacaacuuuuucccuacacuaugccuggaaaaccauggcaauggugcugucaauugucagccuuuucccccucugucugaguacgacaucucagaagaccacuugguugccgguacuguuaggcucccucgggugcaagccucugacaauguuucuuaucgcugagaauaaaauauggggaaggcgaagcuggccacugaacgaagguaucauggccgugggcauuguuucgaucuugcucucaucucugcuaaagaacgaugugccccuggccgggccucuuauugcuggaggcaugcucaucgcauguuacgucauaagugguuccagcgccgaccugucuuuggagaaagcggcugaggugagcugggaagaggaagccgagcauuccggggcaucacacaauauuuuaguagaagugcaggaugacggaaccaugaagaucaaagaugaggagcgcgacgauacucugacaauccuccugaaggccacccuucuggcugucaguggcguuuaucccuugagcauuccagcaacgcuauucgugugguacuucuggcagaagaagaagcagcggucuggcgugcugugggacacuccuucacccccagaagucgagagagccgugcucgaugacgggauauauaggaucaugcagcguggacugcuuggucgcagccagguuggcguagggguguuucaagaaaacgucuuccauaccauguggcacgugacacggggagcgguuuuaauguaccagggcaaaagacuggagccgaguugggcuagcgugaagaaagaccucauuuccuacggugggggauggagguugcagggcucuuggaauaccggcgaggaaguccaggugaucgccguagagccugggaagaaccccaaaaauguccaaacagcaccaggaacuuuuaagacccccgaaggugaggugggcgccauugcucuggauuucaagccugggacgucgggaagcccaaucguuaaccgagaaggcaaaauagugggucucuaugggaauggagucgugacaacuucaggcaccuacguuuccgccaucgcacaggcuaaggccagucaggagggcccccugccugagauugaagacgagguguuucggaaacgcaaccuuacaaucauggaucugcacccggggucuggaaagaccagaagguauuugccagcgauuguccgggaagccaucaaacgaaagcuaagaacucugauacucgcacccacccgcgugguagcuagcgagauggccgaggcuuuaaaggguaugccuauuagguaccaaacaacggcagugaaauccgagcauacuggcaaggagaucguugaccugaugugccacgccaccuucacaaugcgucuucugucaccaguccgggugcccaauuauaacaugaucauuauggaugaagcccauuuuaccgacccuucuagcaucgcugcgagaggguacauaaguacuagggugggaaugggcgaggcagccgcuauuuucaugacagccaccccgcccgguuccgucgaagcauuuccacagagcaaugccguaauccaggaugaggaacgcgacauuccugagcgaucuuggaacucaggguaugaguggaucacggauuuccccggaaaaacugugugguuuguuccauccauaaagaguggcaaugacauugcuaacugucucaggaaaaauggcaagcgggugauccaguugagcaggaagacauucgauaccgaauaccagaaaaccaagaacaacgacugggacuacgucgugacuacagauaucucggagaugggggcgaauuuccgcgccgaccguguuauugauccuagacggugccugaaacccgugauccucaaggacggaccagaaagggucauucuggcagguccgaugccugugaccguagcuucugccgcacagcgccgaggcagaauagggcggaaccacaauaaagagggagaucaguauaucuacaugggccagccccuuaacaaugacgaggaucaugcccacuggacagaagcuaagaugcuacuggacaacauuaauacuccagaggguaucauccccgccuuguuugaaccugagagggaaaaguccgcggcaauugauggggaguaucgcuuaagaggcgaggccaggaaaacguucguggaacugaugcggcguggagaccucccaguuuggcugagcuacaaggucgcuucagagggcuuucaauauagugaucgccgauggugcuucgacggggaaagaaacaaucaggugcuugaggaaaacauggauguggagauauggaccaaagagggagaaaggaagaaacugcggccccgcuggcucgacgccagaacauacucugacccuuuggcucugagggaguuuaaggaguucgcagccggucggcgauccgucagcggcgaucuaauccuggagauugggaaacucccgcagcaccuuacucagagagcucaaaaugcccuggacaacuuaguuauguugcauaauucagaacagggaggccgcgcauauaggcacgcgauggaggagcugccagauaccaucgaaacacucaugcugcuugcccugauugcugugcucaccggugggguaacuuuguuuuuccugaguggccggggauuaggcaagacgagcaucgggcuacugugugugauggccuccucuguccuccuuuggauggcaagcguggagccccauuggauagcugccuccaucauucuggaauuuuucuugaugguucugcucaucccugagcccgaccgucagagaaccccacaggauaaccaacuggcauacguggucauuggacuucucuuuaugauccugacaguagccgcuaaugagauggguuugcuggaaacuaccaagaaagacuuaggcauagggcacguggcgguugagaaccaccaucacgccgcaaugcuagauguggaccugcauccugcuucagccuggacacucuacgccgucgcaaccacuauuaucacacccaugaugaggcacacgauugaaaacaccacugcuaauaucucucuuacagccauagcgaaccaggcugccauccugaugggauuggauaagggcuggccaauuaguaaaauggacaucggugugccucugcucgcacuggggugcuauucgcaggucaauccgcuuaccuuaaccgccgcugugcugaugcucguugcacauuacgccauuaucggccccggauugcaagcgaaggcuacacgcgaggcccagaaacggacugcagccggcauaaugaagaacccaacgguggaugggauuguagcuaucgaccuggauccuguggucuaugacgccaaguucgaaaaacagcuaggacagaucaugcugcucauucuuuguaccagccaaauccuguugaugcgaacaacuugggcacugugcgaguccauaacccucgcuacaggcccccugaccacuuuaugggaggguucuccagggaaguuuuggaauacgacaauugccguuucaauggcgaacaucuucagaggaagcuaccuugccggcgcaggucuggcuuucucccucaugaaaagucuaggcgggggaaggcgcggcaccggggcccagggagaaacucugggcgagaaguggaaacggcaguugaaucagcugucuaagagcgaauuuaacaccuauaagagaucagguauuauggagguggaccguuccgaagcaaaagaggggcucaagaggggagagacaacuaaacacgcugucagucggggcaccgccaaacuucgcugguucguggaacgaaaucugguaaaaccugaggguaaggugaucgauuugggcugugggagaggaggcuggagcuacuauugcgccgggcugaagaaaguuacagaagugaagggauacacgaaaggcggucccgggcacgaggaaccgauaccaauggcgaccuacggauggaaccucgucaaguuacauucuggcaaagacguguuuuucaucccucccgagaagugugauacucugcuuugcgacauuggcgaguccucaccaaaucccacaaucgaagaggggaggacccugcggguccuaaaaaugguggaaccuuggcuccgcggaaaccaauuuuguauuaagauccugaauccguauaugcccagcguuguagagacuuuggagcagaugcagagaaagcacgguggcaugcuggugaggaacccacucucgcgaaauucuacacaugaaauguacugggucaguugcgggaccggaaacauuguguccgcuguuaauaugacgagccggaugcuucugaaccguuucaccauggcacacagaaaaccuacauaugagcgcgauguggacuuaggcgccgguacuaggcacgucgcuguggaacccgagguagccaaccuggauaucauagggcagcggauugaaaauaucaagcaugagcacaaaucaaccuggcauuacgacgaggauaacccuuauaagacaugggcauaccacggauccuaugaagugaaaccaucuggcagcgccaguuccaugguuaauggcgucgugaaguugcucacuaagcccugggacgugaucccuauggucacccaaauugcuaugacagauaccacuccauuugggcagcagagaguuuucaaagagaagguggacacgcgcacacccaaagcgaagaggggaaccgcccaaauaauggaaguaacugcaaaauggcugugggguuuucuaagccgaaacaagaagccgcggaucuguaccagagaggaguucacaaggaaagugcgcucuaaugcugccauuggcgcagucuuuguggacgagaaccaguggaacucagccaaggaggcuguugaagaugagcguuucugggaccuugugcaucgggaaagagagcugcacaaacaggggaagugcgccacgugcgucuacaacaugaugggaaaaagggaaaagaagcucggcgaguuugguaaagcgaaggggagucgcgcaaucugguacauguggcugggagcccgauucuuggaguucgaagcucugggcuuuaugaaugaggaucacugguucucccgggaaaacagccucucuggcguggagggggagggacuucauaaacuggguuauauuuuaagagacaucucgaagauaccuggcgggaauauguacgccgaugacaccgcaggaugggauacuaggaucacagaagacgaucugcagaacgaggcucgcauuaccgacaucauggaaccagagcacgccuugcucgcuagaucaauuuuuaaacugacuuaucaaaauaagguaguucgggugcagaggcccgccaaaaacggcacagucauggaugugaucagccgucgagaccagcgcgguuccggacaggugggaaccuacggccuaaauacauucacuaacauggaagcacaacuuauaagacagauggagagugagggcauauuuucuccuagcgaacuggagaccccaauccucgcggaacggguccuggauugguuggagaaguaugggguugaaagguuaaagcgcauggccaucuccggagacgacugugugguaaaacccauugaugacagauucgcuacggcccugaccgcacucaacgauauggguaaggugcggaaagacauaccgcagugggagccuucaaagggcuggaaugauuggcagcaaguccccuuuugcagucaucacuuccaccagcuuaucaugaaagacgggagggagauugugguuccaugucgaaaccaggaugaacuggugggacgugcuagagucucucagggcgccgguuggagccuacgcgagacagcaugccuggggaaguccuacgcccaaauguggcagcucauguauuuucaucggagggacuugagacuggcggcuaaugccaucuguucagcagugccuguagauuggauucccacuagccgcaccacauggucuauccacgcccaucaccaguggaugacuaccgaagacaugcuuuccguuuggaaccggguguggauagaggaaaauccauggauggaggauaagacgcauaucaguagcuggggagacguccccuaccugggcaaaagggaggaccaauggugcggcucgcucauuggguuaacagcucgagccaccugggcaacuaacauccagguggcuauuaaucagguuagacggcugaucggaaacgaaaauuacuuggauuauaugacauccaugaagagguucaaaaacgagucugacccugaaggugcccugugguga

SEQ ID NO: 13572 - RNA, 9879 nt, Artificial Sequence
  derived and/or modified CDS sequence (opt3) from DENV-1__EU677171__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgagagagccgugcuggaugacgggauauauaggaucaugcagcguggacuuuuaggucgcagccagguuggcguagggguguuucaagaaaacgucuuccauaccauguggcacgugacacggggagcgguucugauguaccagggcaaaagacucgagccgaguugggcuagcgugaagaaagacuugauuuccuacggugggggauggaggcugcagggcucuuggaauaccggcgaggaaguccaggugaucgccguagagccugggaagaaccccaaaaauguccaaacagcaccaggaacuuuuaagacccccgaaggugaggugggcgccauugcucucgauuucaagccugggacgucgggaagcccaaucguuaaccgagaaggcaaaauagugggucuguaugggaauggagucgugacaacuucaggcaccuacguuuccgccaucgcacaggcuaaggccagucaggagggcccccuuccugagauugaagacgagguguuucggaaacgcaaccugacaaucauggauuugcacccggggucuggaaagaccagaagguaucuaccagcgauuguccgggaagccaucaaacgaaagcugagaacucucauauuagcacccacccgcgugguagcuagcgagauggccgaagcucugaaggguaugccuauuagguaccaaacaacggcagugaaauccgagcauacuggcaaggagaucguugaccuuaugugccacgccaccuucacaaugcgucugcucucaccaguccgggugcccaauuauaacaugaucauuauggaugaagcccauuuuaccgacccuucuagcaucgcugcgagaggguacauaaguacuagggugggaaugggcgaggcagccgcuauuuucaugacagccaccccgcccgguuccgucgaagcauuuccacagagcaaugccguaauccaggaugaggaacgcgacauuccugagcgaucuuggaacucaggguaugaguggaucacggauuuccccggaaaaacugugugguuuguuccauccauaaagaguggcaaugacauugcuaacuguuugaggaaaaauggcaagcgggugauccagcugagcaggaagacauucgauaccgaauaccagaaaaccaagaacaacgacugggacuacgucgugacuacagauaucucggagaugggggcgaauuuccgcgccgaccguguuauugauccuagacggugccucaaacccgugauccugaaggacggaccagaaagggucauucuugcagguccgaugccugugaccguagcuucugccgcacagcgccgaggcagaauagggcggaaccacaauaaagagggagaucaguauaucuacaugggccagccccuaaacaaugacgaggaucaugcccacuggacagaagcuaagaugcuguuggacaacauuaauacuccagaggguaucauccccgccuuauuugaaccugagagggaaaaguccgcggcaauugauggggaguaucgccugagaggcgaggccaggaaaacguucguggaacucaugcggcguggagaccugccaguuuggcuuagcuacaaggucgcuucagagggcuuucaauauagugaucgccgauggugcuucgacggggaaagaaacaaucaggugcuggaggaaaacauggauguggagauauggaccaaagagggagaaaggaagaaacuccggccccgcugguuggacgccagaacauacucugacccucuggcucuaagggaguuuaaggaguucgcagccggucggcgauccgucagcggcgaucugauccucgagauugggaaacuuccgcagcaccugacucagagagcucaaaaugccuuagacaacuugguuaugcugcauaauucagaacagggaggccgcgcauauaggcacgcgauggaggagcucccagauaccaucgaaacacugaugcuucuggcccucauugcuguguugaccggugggguaacucuguuuuucuuaaguggccggggacuaggcaagacgagcaucgggcugcucugugugauggccuccucuguccuucuguggauggcaagcguggagccccauuggauagcugccuccaucauuuuggaauuuuuccugaugguucuccugaucccugagcccgaccgucagagaaccccacaggauaaccaacuugcauacguggucauuggacuccuguuuaugaucuugacaguagccgcuaaugagaugggucuguuagaaacuaccaagaaagaccuaggcauagggcacguggcgguugagaaccaccaucacgccgcaaugcuggauguggaccuccauccugcuucagccuggacacuuuacgccgucgcaaccacuauuaucacacccaugaugaggcacacgauugaaaacaccacugcuaauaucucucugacagccauagcgaaccaggcugccaucuugaugggacuggauaagggcuggccaauuaguaaaauggacaucggugugccucuccuggcacuugggugcuauucgcaggucaauccguuaacccugaccgccgcugugcucauguugguugcacauuacgccauuaucggccccggacugcaagcgaaggcuacacgcgaggcccagaaacggacugcagccggcauaaugaagaacccaacgguggaugggauuguagcuaucgaccuagauccuguggucuaugacgccaaguucgaaaaacagcugggacagaucaugcuccuuauucuguguaccagccaaaucuugcugaugcgaacaacuugggcacucugcgaguccauaacccuggcuacaggccccuuaaccacucuuugggaggguucuccagggaaguuuuggaauacgacaauugccguuucaauggcgaacaucuucagaggaagcuaccuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuauaagagaucagguauuauggagguggaccguuccgaagcaaaagaggggcuuaagaggggagagacaacuaaacacgcugucagucggggcaccgccaagcugcgcugguucguggaacgaaauuugguaaaaccugaggguaaggugaucgaucugggcugugggagaggaggcuggagcuacuauugcgccgggcucaagaaaguuacagaagugaagggauacacgaaaggcggucccgggcacgaggaaccgauaccaauggcgaccuacggauggaacuuagucaagcugcauucuggcaaagacguguuuuucaucccucccgagaagugugauacucuucugugcgacauuggcgaguccucaccaaaucccacaaucgaagaggggaggacccuacggguccucaaaaugguggaaccuuggcugcgcggaaaccaauuuuguauuaagaucuugaauccguauaugcccagcguuguagagacucuggagcagaugcagagaaagcacgguggcaugcucgugaggaacccacuuucgcgaaauucuacacaugaaauguacugggucaguugcgggaccggaaacauuguguccgcuguuaauaugacgagccggaugcuguuaaaccguuucaccauggcacacagaaaaccuacauaugagcgcgauguggaccugggcgccgguacuaggcacgucgcuguggaacccgagguagccaacuuggauaucauagggcagcggauugaaaauaucaagcaugagcacaaaucaaccuggcauuacgacgaggauaacccuuauaagacaugggcauaccacggauccuaugaagugaaaccaucuggcagcgccaguuccaugguuaauggcgucgugaagcuccugacuaagcccugggacgugaucccuauggucacccaaauugcuaugacagauaccacuccauuugggcagcagagaguuuucaaagagaagguggacacgcgcacacccaaagcgaagaggggaaccgcccaaauaauggaaguaacugcaaaauggcuaugggguuuucuuagccgaaacaagaagccgcggaucuguaccagagaggaguucacaaggaaagugcgcucuaaugcugccauuggcgcagucuuuguggacgagaaccaguggaacucagccaaggaggcuguugaagaugagcguuucugggaccuggugcaucgggaaagagagcuccacaaacaggggaagugcgccacgugcgucuacaacaugaugggaaaaagggaaaagaagcugggcgaguuugguaaagcgaaggggagucgcgcaaucugguacaugugguugggagcccgauuccuggaguucgaagcucucggcuuuaugaaugaggaucacugguucucccgggaaaacagccuuucuggcguggagggggagggacugcauaaauuagguuauauucugagagacaucucgaagauaccuggcgggaauauguacgccgaugacaccgcaggaugggauacuaggaucacagaagacgauuugcagaacgaggcucgcauuaccgacaucauggaaccagagcacgcccuccuggcuagaucaauuuuuaaacuaacuuaucaaaauaagguaguucgggugcagaggcccgccaaaaacggcacagucauggaugugaucagccgucgagaccagcgcgguuccggacaggugggaaccuacggccuuaauacauucacuaacauggaagcacaacugauaagacagauggagagugagggcauauuuucuccuagcgaacucgagaccccaaaccuggcggaacgggucuuggauugguuagagaaguaugggguugaaaggcugaagcgcauggccaucuccggagacgacugugugguaaaacccaucgaugacagauucgcuacggcccucaccgcacuuaaugauauggguaaggugcggaaagacauuccgcagugggagccuucaaagggcuggaacgauuggcagcaaguccccuuuugcagucaucacuuccaccagcugauaaugaaagacgggagggagaucgugguuccaugucgaaaucaggaugagcuagugggacgugcuagagucucucagggcgccgguuggagccugcgcgagacagcaugccucgggaaguccuacgcccaaauguggcaguugauguauuuucaucggagggaccugagacuugcggcuaacgccauuuguucagcagugccuguagauuggauccccacuagccgcaccacauggucuauucacgcccaucaccaguggaugacuaccgaagacaugcuguccguuuggaaucggguguggaucgaggaaaacccauggauggaggauaagacgcauauaaguagcuggggagacguccccuaccucggcaaaagggaggaccaauggugcggcucguuaaucgggcugacagcucgagccaccugggcaacuaauauucagguggcuaucaaccagguuagacgguugauuggaaaugaaaacuaccuggauuauaugacauccaugaagagguucaaaaaugagucugacccugaaggugcccucugguga

SEQ ID NO: 13573 - RNA, 9879 nt, Artificial Sequence
  derived and/or modified CDS sequence (opt3) from DENV-1__EU677172__SS-prME
uccgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaacuugccgagacgcagcacggaacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggaguacaaauauucguggaaaagcuggggcaaggccaagauaaucggggcggacgcccagaauaccacauuuauuaucgauggaccaaacacuccugaaugucccgacgaucagagagcuuggaauauuugggagguugaggacuacggcuucgguaucuuuaccacaaacauaugguugaagcucagggauuccuauacacaggugugcgaccaccgucugaugucagcagccauuaaagauaguaaggcuguccacgccgacaugggguacuggaucgaaucugagaaaaaugaaaccuggaagcuagcacgggcgagcuucauugaggugaagacuuguaucuggccaaaaucccauacacuguggucaaacggaguucucgaaagcgagaugauaauccccaagauuuauggcgguccuaucucucaacacaauuaccgaccaggcuacuucacccagacugccgggccguggcaucugggaaaacuugaguuggauuuugaccugugcgaaggcacaaccgugguagucgaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgugaaagaaaaggaggaaaaucuugucaagagcaugguuucugcuggcuccggugagguggacucauuuagucugggcuugcucuguauuagcaucaugaucgaagagguaaugcgcucgcgauggucccggaaaaugcugaugacugggacacuagccguguucuuucugcucaccaugggacagcugacauggaacgaucuuauucguuugugcaucauggucggcgcaaaugcuucugacagaauggggaugggaacuaccuaccuggccuuaauggcaacguucaagaugaggccuauguuugccgugggccuccuguuccgccggcuuacaagcagagagguucugcuacucaccauuggucugucauugguggcuagugucgaacugccaaacuccuuagaggaacucggggauggacuggcgaugggcauaaugauccuuaaacuguugacugacuuucaaucucaucagcucugggccacccugcuaagccugacauucauuaagacuaccuuuucccuucacuaugcauggaaaacgauggcuauggugcucucaaucguuagccuguuccccuugugucugaguacaaccucucagaagacuacaugguuaccggugcuccugggcucccuugggugcaagccucugaccauguuuuugauugccgagaauaaaaucuggggaaggcgaagcuggccacucaacgaagguauaauggccgucggcaucguaucgauucugcuaucaucucugcuuaagaacgaugugccccucgcugggccucugaucgcaggaggcauguugauugccuguuacguuaucagugguuccagcgcggacuuaucucuggagaaagcugccgaggugagcugggaagaggaagcagagcauuccggggccucacacaauauacucgucgaagugcaggaugacggaacuaugaagauuaaagaugaggagcgcgacgauacacugaccauccuucugaaggcuacguugcuagcaguaaguggcguguauccccugagcaucccagccacucucuucgucugguacuucuggcagaagaagaagcagcggucuggcguucugugggacaccccuucacccccagaaguggagagagcggugcuugaugacgggauuuauaggauaaugcagcguggauuacugggucgcagccaggucggcguggggguuuuucaagaaaacguauuccauacaauguggcacgugacccggggagcuguccucauguaccagggcaaaagauuggagccgaguugggccagcgugaagaaagaccugaucuccuacggugggggauggaggcuccagggcucuuggaauacaggcgaggaaguucaggugauugcagucgagccugggaagaaccccaaaaaugugcaaacugccccaggaaccuuuaagacgcccgaaggugagguaggcgcuaucgcccuggauuucaagccugggacaucgggaagcccaauugucaaccgagaaggcaaaaucgugggucuuuaugggaauggaguugugacuaccucaggcacauacgucuccgcaauagcucaggccaaggcgagucaggagggcccccugccugagaucgaagacgagguguuucggaaacgcaacuugaccauuauggaucuacacccggggucuggaaagacuagaagguaucugccagccaucguucgggaagcaauuaaacgaaagcucagaaccuuaauccuggcucccacacgcguggucgccagcgagauggcugaagcacuuaaggguaugccuauaagguaccaaacgacugccgugaaauccgagcauaccggcaaggagauuguagaccugaugugccacgccacauucaccaugcgucucuugucaccagugcggguucccaauuauaacaugaucaucauggaugaagcucauuuuacugacccuucuagcauugcggcaagaggguacaucaguacaagggucggaaugggcgaggccgcugccauauucaugaccgcaacgccgcccgguuccguggaagccuuuccacagagcaaugcugugauucaggaugaggaacgcgacaucccugagcgaucuuggaacucaggguaugaguggauuacugauuuccccggaaaaacagucugguuuguaccauccaucaagaguggcaaugacauagcgaacugucugaggaaaaauggcaagcgggugauucagcucagcaggaagaccuucgauaccgaauaccagaaaacuaagaacaacgacugggacuacguugugacaaccgauaucucggagaugggggccaauuuccgcgcagaccgugucaucgauccuagacggugccugaaacccgugauucuuaaggacggaccagaaaggguuauccuagcugguccgaugccugugacagucgccucugcagcccagcgccgaggcagaauugggcggaaccacaauaaagagggagaucaguauauauacaugggccagccccugaacaaugacgaggaucaugcucacuggacugaagccaagauguuguuagacaacaucaauacgccagaggguauuauccccgcgcuguuugaaccugagagggaaaaguccgcagccaucgauggggaguaucgccucagaggcgaggcuaggaaaaccuucguggaacugaugcggcguggagaccuuccaguauggcugagcuacaagguggccucagagggcuuucaauauagugaucgccgauggugcuucgacggggaaagaaacaaucagguucucgaggaaaacauggaugucgagauuuggacaaaagagggagaaaggaagaaauugcggccccgcuggcuggacgcuagaacuuacucugacccucuagcacugagggaguuuaaggaguucgccgcuggucggcgauccgugagcggcgaucucauacuugagaucgggaaacugccgcagcacuuaacccagagagcccaaaaugcauuggacaaccuggugaugcuccauaauucagaacagggaggccgcgcguauaggcacgccauggaggagcugccagauacaauugaaacccuuaugcugcucgcuuugaucgccguccugacuggugggguuacguuauuuuuccuaaguggccggggacugggcaagaccagcauugggcuccuuugugugauggcauccucuguacuguuguggauggcuagcguggagccccauuggaucgccgcauccauaauccuggaauuuuuccucaugguccugcuuauuccugagcccgaccgucagagaacaccacaggauaaccaacucgccuacgugguuaucggacuguuguuuaugauucugacuguggcugcgaaugagauggguuuacuagaaaccacaaagaaagaccugggcaucgggcacgucgccguagagaaccaccaucacgcagcuaugcucgauguggaccuucauccugccucagccuggacccuguacgcaguugcuacuacaauaauuacgcccaugaugaggcacaccaucgaaaacacuacagccaauauuucuuugaccgcgaucgcuaaccaggccgcaauacugaugggacucgauaagggcuggccaaucaguaaaauggacauuggugugccucugcuugccuuagggugcuauucgcaggucaauccgcugacccucacagcugcaguguugaugcuggucgcccauuacgcgaucauuggccccggacuacaagcuaaggccacucgcgaggcacagaaacggacggccgcuggcaucaugaagaacccaaccguggaugggauaguugccauugaccuggauccugugguauaugacgcaaaguucgaaaaacagcucggacagaucaugcuucugaucuuguguacaagccaaauucugcucaugcgaacuaccugggcucugugcgaguccaucacauuagccaccggcccccuuacuacgcugugggaggguucuccagggaaguuuuggaauacaaccauagcggugucaauggccaacauuuucagaggaagcuaccucgcaggcgcuggucuagccuucucccugaugaaaaguuugggcgggggaaggcgcggcacuggggcacagggagaaacccugggcgagaaguggaaacggcagcucaaucagcuuucuaagagcgaauuuaacacauauaagagaucagguaucauggaggucgaccguuccgaagcuaaagaggggcugaagaggggagagacuaccaaacacgccguuagucggggcacagccaaguugcgcugguucguggaacgaaaucuggucaaaccugaggguaaggugauugaucucggcugugggagaggaggcuggagcuacuauugcgcgggguuaaagaaaguaacggaagugaagggauacaccaaaggcggucccgggcacgaggaaccgaucccaauggcuacuuacggauggaaccugguuaaacuucauucuggcaaagacguguuuuucauaccucccgagaagugugauacacugcuaugcgacaucggcgaguccucaccaaaucccaccauugaagaggggaggacucuccggguccugaaaaugguggaaccuugguugcgcggaaaccaauuuuguaucaagauucugaauccguauaugcccagcgucguggagacacucgagcagaugcagagaaagcacgguggcaugcuuguuaggaacccacugucgcgaaauucuacccaugaaauguacuggguaaguugcgggacgggaaacaucguguccgcagucaauaugaccagccggauguuacugaaccguuucacaauggcccacagaaaaccuacuuaugagcgcgauguggacuugggcgcugguaccaggcacguugccguggaacccgaggucgcaaaccucgauauuaucgggcagcggauagaaaauauuaagcaugagcacaaaucaacauggcauuacgacgaggauaacccuuauaagacuugggccuaccacggauccuaugaagugaaaccaucuggcagcgcuaguuccaugguaaauggcgugguuaagcugcuaaccaagcccugggacgucaucccuauggugacacaaaucgcgaugaccgauacuacgccauuugggcagcagagaguguucaaagagaaggucgacacacgcacccccaaagccaagaggggaacugcacaaauuauggaaguuaccgcuaaauggcuuugggguuuucugagccgaaacaagaagccgcggauauguacaagagaggaguucacgaggaaagugcgcucuaaugccgcaaucggcgccguauuuguggacgagaaccaguggaacucagcuaaggaggccgucgaagaugagcguuucugggaccucgugcaucgggaaagagagcugcacaaacaggggaagugcgcgaccugcguuuacaacaugaugggaaaaagggaaaagaaguugggcgaguuugguaaagcaaaggggagucgcgccauuugguacauguggcugggagcucgauuccucgaguucgaagcccuuggcuuuaugaaugaggaucacugguucucccgggaaaacagccugucuggcguggagggggagggauuacauaaacuggguuauaucuugagagacauuucgaagaucccuggcgggaauauguacgcagaugacacugcuggaugggauacaaggauaaccgaagacgaucuccagaacgaggcccgcaucacugacauuauggaaccagagcacgcucugcuagccaaaucaaucuuuaaacuuacauaucaaaauaaagucgugagaguacagcggcccgcaaagaacggcaccguuauggaugugauuagcaggcgugaccagcgagguuccgggcaggucggaacauacggccugaauacuuucaccaacauggaagcgcaacucauccgccagauggagagugagggcauauuuucuccuagcgaacuggagacgccaaacuuggccgaaagaguguuagauuggcuggagaaguaugggguggaacggcucaaaaggauggcuauuuccggagacgacugugucguuaagcccaucgaugaccgcuucgccaccgcacuuacagcucugaaugauauggguaaagugagaaaggacaucccgcagugggagccuucaaaaggcuggaacgauuggcagcaaguacccuuuugcagucaucacuuccaccagcuaauuaugaaggacgggcgggagauaguggucccauguaggaaucaggaugaacuggugggacgagcccguguuucucagggcgcagguuggagccucagagagacugccugcuuggggaaguccuacgcgcaaauguggcagcugauguauuuucaucgccgggaccuuaggcuggcugccaacgcaaucuguucagccgugccugucgauuggauucccaccagcagaacaacuuggucuauccacgcucaucaccaguggaugaccacggaagacaugcucuccguguggaaucgcguauggauugaggaaaacccauggauggaggauaaaacacauaucaguagcuggggagacguucccuacuuaggcaagcgggaggaccaauggugcggcucgcugauaggguugaccgccagggcaacuugggcuacaaauauccagguggccauuaaccagguccgaagacugaucggaaaugaaaacuaccucgauuauaugaccuccaugaaacgguucaagaaugagucugacccugaaggugcgcuuugguga

SEQ ID NO: 13574 - RNA, 9879 nt, Artificial Sequence
  derived and/or modified CDS sequence (opt3) from DENV-1__EU677173__SS-prME
agcgugaccaugcugcucaugcuuaugcccacagcccuggcuuuccacuugacuacgagaggcggggagccucauaugaucgucaccaagcaggaaaggggaaaauccuuacuguuuaagacaucugcagguguuaacaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagagcaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuaccccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaacuacaucacaagagaccuggaaucggcaggaccuguuggugacauucaaaacugcucacgccaagaagcaggaaguaguugugcucgguagccaagagggggcuaugcacaccgcccugacgggcgcaaccgaaauccagacaaguggaacuaccacaauuuuugccggccauuuaaaaugccgucugaagauggauaaacuaacucucaaggggaugucuuaugucauguguaccggauccuucaaacuggagaaggaaguggcugagacgcagcacgguacaguccuugugcagauaaaguacgagggcaccgacgcgccuugcaaaaucccauucagcacucaagaugaaaaggggguuacacagaacggacgcuugauuaccgcaaaucccaucgugacugacaaagagaagccuguaaacauagaagccgagccacccuuuggcgagucguauauugucaucggugcuggggaaaaagcccugaagcucucuugguucaagaaaggcuccucaaucggaaagauguuugaggcaaccgccagaggcgcuaggcggauggccauucugggggauacagcaugggacuucggaaguaucgguggcguguuuacgagcguugggaaacuugugcaucagauuuucggaaccgcguacggcguccuguuuuccggugugucuuggacuaugaagauagggaucggcguauugcucacauggcugggauuaaauagccgaucaaccagucuguccaugacauguauugcugugggccuaguuacucucuaccugggggucauggugcaggccgauagcggaugcgugaucaacuggaaaggccgcgaacuuaagugugguucugggaucuucgucaccaaugagguucacacguggacagaacaauauaaguuucaggcagacucaccgaaaagauugagugccgcuauuggaaaggccugggaggagggcgugugcgguauaaggagcgcaacccggcuggaaaacaucauguggaaacagauuuccaacgagcucaaucauauccuguuagaaaacgacaugaaguucacugugguagucggcgaugugguugggauucuggcucagggaaaaaagaugauccgcccucaacccauggagcacaaauacucuuggaagucguggggcaaggccaaaauaaucggggcggacgugcagaauaccacauuuauuaucgauggaccaaacacuccugaaugucccgacgaucagagagccuggaauauuugggaggucgaggacuauggcuucgguaucuuuaccacaaacauauggcuuaaguugagggauagcuacacgcagaugugcgaccaccgucucauguccgcugcaauuaaagauucaaaggccgugcaugcugacaugggguauuggaucgaaagugagaaaaaugaaaccuggaagcuggcccgggcaucuuucauugagguuaagacuuguaucuggccaaaaagccacacacuaugguccaacggagugcuggaaucagagaugauaauccccaagauuuacggcgguccuaucagccaacauaauuaucgaccaggcuacuucacccagacugcggggccguggcaccucggaaaacuggagcuugauuuugacuugugcgaaggcacaaccguagucguggaugagcacugcgggaacagaggacccucucugaggacgacuaccgugacaggcaagauuauccaugaaugguguugccgcuccuguaccuuaccuccacuccgguucaaaggugaggacgggugcugguacggaauggagauaagacccgucaaggaaaaggaggaaaaucugguuaaaaguauggugagcgccggcucuggugagguagacuccuuuucacuuggccuguuguguauuaguaucaugaucgaagaggugaugaggagccgcuggucgcgaaagaugcucaugacugggacacuggcugucuuccuacugcucauuaugggacagcugaccuggaacgaucuuauccgguugugcauuauggugggcgccaaugcauccgaccguauggggaugggaacaacuuaucuggcuuuaauggccaccuuuaaaaugagaccuauguucgcaguuggccuccuguuuaggcgccuuacgucucgggaggugcugcuacucacaauaggucugagcuuggucgccucaguggaacugccaaacaguuuagaggaacucggggauggacuggcuaugggcaucaugauucuuaagcuguugaccgacuuccaaucccaccagcucugggcgacucugcuaucucugaccuuuaucaaaacaacucuuagccuccauuacgccuggaagaccauggcaaugguucuguccauugugucauuguucccccuguguuuaagcacgacaagucagaagaccacuuggcucccgguccugcuuggcucucuggggugcaaaccuuugacaauguuucucaucaccgagaauaagauauggggaagaaaauccuggccacugaacgaagguaucauggcuguaggcgugguuagcauucuacugucgucacuucucaagaacgaugugccccuggccgggccuuugaucgccggaggcauguuaauugcuuguuaugucaucucugguaguuccgcagaccugagccucgagaaagccgcggaggugucuugggaagaggaagcugagcacagcggggccucccauaauauacugguagaagugcaggaugacggaacuaugaagauuaaagaugaggagagggacgauacacuuaccauccuguugaaggcaacgcuacuggccgucucaggcguuuacccccucaguaucccagcuacucuguucgugugguauuuuuggcaaaagaaaaagcagcgaagcggcgugcuuugggacaccccuucucccccagaagucgagcgcgcaguguuagaugacgggauuuaccggauaaugcagagaggacugcucgguaggucccagguuggcguagggguguuccaagaaaacgucuuccacacaauguggcacgugacccguggagccguuuugauguaucagggcaaacgccuggagccgucaugggcgagugugaagaaagaccucaucagcuacggugggggauggcggcugcagggcuccuggaaugcuggcgaggaaguccaggugauugccguagagccugggaagaaccccaagaauguccaaacagcaccaggaacuuuuaaaacccccgaaggugaggugggcgccaucgcucuugauuucaagccugggacgucuggaucgccaauuguuaacagagaaggcaaaaucgugggucuguacgggaauggagucgugacaacuagcggcaccuauguuucagccauagcacaggcuaaggccucccaggagggccccuugccugagaucgaagacgagguguuuaggaaacgaaaccuaacaauuauggaucugcauccggggaguggaaagacccggcgcuaccucccagcgaucgucagagaagccauuaagaggaaauuacggacucugauccuugcacccacccgagugguagcuucugagauggccgaagcucugaaggguaugccuauaagauaucaaacaacggcagugaaaagcgagcacacuggcaaggagauuguugaccucaugugccaugccaccuucacaaugcgcuugcuguccccagucagggugcccaauuacaacaugaucaucauggaugaagcccacuuuaccgacccuucaucuauugcugcgcguggguauaucagcacucgggugggaaugggcgaggcagccgcuauauucaugacagccaccccgcccgguagugucgaagcauuuccacaguccaaugccguaauucaggaugaggaaagagacaucccugagaggagcuggaacucuggguacgaguggauuacggauuuccccggaaaaacugugugguuuguuccaucaaucaaguccggcaaugacauagcuaacugucuccgcaagaauggcaaacgagugauucagcugaguagaaagacauucgauaccgaauaucaaaaaaccaagaacaacgacugggacuacgucgugacuacagauaucagcgagaugggggcgaauuuucgggccgacaggguuaucgauccucgccguugccuuaaacccgugauucuaaaggacggaccagaaagagucauccuggcagguccgaugccugugaccguagcuucggccgcacagcggaggggccgcauugggcgaaaccauaauaaggagggagaucaguacauauauaugggccagcccuugaacaaugacgaggaucacgcccacuggacagaagcuaaaauguuacuggacaacaucaauacuccagaggguauuauccccgcccucuucgaaccugagagagaaaagucugcggcaaucgauggggaguaccggcugaggggcgaggcccgcaaaacguucguggaacuuaugagaaggggagaccugccaguuuggcucuccuauaaggucgcuagcgagggcuuucaauacucagaucggcguuggugcuucgacggggaacgcaacaaucagguguuggaggaaaacauggauguggagauuuggaccaaagagggagaacgaaagaaacugagacccagguggcuagacgcccggacauauagugacccucuggcucuccgcgaguuuaaggaauucgcagccgguagaaggucugucuccggcgaucuuauacuggagaucgggaaguuaccgcagcauuugacucagcgggcucaaaaugcccuggacaaccucguuaugcugcacaauagcgaacagggaggccgagcauacagacaugcgauggaggagcuuccagauaccauugaaacacugaugcucuuggcccugaucgcuguguuaaccggugggguaacucuauuuuuccugucaggccgcggacucggcaaaacgaguauugggcuucugugugugauggccagcuccgucuugcuguggauggcaucuguggagccccacuggaucgcugccagcauaauccucgaauuuuuccugaugguucuucucauuccugagcccgacaggcagcggaccccacaggauaaccaacuggcauauguggucaucggauugcuguuuaugauuuuaacaguagccgcuaaugagaugggucuacuggaaacuaccaagaaagaccucggcaucgggcacguggcgguugagaaccaucaccaugccacaaugcuugauguggaccugcacccugcauccgcuuggaccuuguacgccgucgccacuacaauaauuacgcccaugaugcgucauaccaucgaaaacacuacagcaaauauuucacugaccgcuaucgccaaccaggcggcuauacucaugggacuggauaagggcuggccaaucucuaaaauggacauuggugugccucuuuuagcccuggggugcuacagucaggucaauccgcucaccuugacagcagccgugcugaugcuaguugcucacuaugcaaucauuggccccggacugcaagccaaggcgacuagagaggcucagaagaggacggccgcaggcaucaugaaaaacccaaccguggaugggauaguagccauugaccucgauccuguggucuacgacgcuaaguucgaaaaacagcuuggacagaucaugcuguugauccuguguacaucgcaaauucuccugaugcgcacuaccugggccuuaugcgagagcaucacacuugcaaccggcccccugacuacgcucugggaggguuccccagggaaguuuuggaauacaaccauagcuguuucuauggccaacauuuuccggggaucauaucuagcgggcgccggucuggcauuuagcuugaugaaaucccugggcgggggacgaagaggcacuggggcucagggagaaacccucggcgagaaguggaagaggcagcuuaaucagcugaguaaaucugaauucaacaucuacaagcgcagcgguauuauggagguggaccggucagaagccaaagagggguugaagagaggagagacaacucgucacgcagucuccaggggcaccgcuaaacugcggugguucguggaacgcaaucucguaaagccugaggguaaggugaucgauuuaggcugugggcgaggaggcuggaguuauuacugcgccgggcugaaaaagguuacagaagugaaaggauauacgaagggcggucccgggcaugaggaaccgauaccaauggccaccuacggauggaaccuugucaaacugcacagcggcaaggacguguuuuucacuccucccgagaaaugugauacacuacucugcgacaucggcgagucuuccccaaaucccaccauugaagaggggagaacucugagggucuugaagaugguggaaccuuggcugcggggaaaccaauuuuguaucaagauucucaauccguacaugcccucaguuguagagacacuugagcagaugcagcgcaaauaugguggcaugcuggugagaaacccauuaagcaggaauucgacccaugaaauguacugggucucuugcgggacgggaaacaucgugagugcgguuaauaugaccucccgaaugcuguugaaccgguucacaauggcucaccguaagccuacuuaugagagagauguggaccucggcgcagguacccgccacgucgccguggaacccgagguagcuaaccuggauauuaucgggcagaggauagaaaauauuaaacaugagcacaagagcacauggcauuacgacgaggauaacccuuauaaaacuugggccuaccacggaucauaugaagugaagccauccggcucugcaagcaguaugguuaauggcgucgugaagcuacuuaccaaacccugggacgugaucccuauggucacacaaaucgccaugaccgauacuacgccauuugggcagcagcggguuuucaaggagaaaguggacacaagaacccccaaggcuaaacgcggaacugcgcaaauuauggaaguaaccgccagguggcugugggguuuucucucccgaaacaagaagccgcggauauguacaagagaggaauucacgaggaaagugcgcagcaaugcagcuaucggcgccgucuuuguggacgagaaccaguggaauucugcaaaggaggccguugaagaugagcguuucugggaccuggugcagaaagaacgggaguugcauaagcaggggaaaugcgcuaccugcgucuacaacaugaugggaaagagagaaaagaaacugggcgaguuugguaaggccaaagggucaagggcgauuugguacauguggcucggagcacgcuuccuugaguuugaagcccugggcuucaugaaugaggaucacugguucagucgagaaaacuccuuaagcggcguggagggggagggacugcacaaguuggguuauauccuccgggacauuucuaaaaucccuggcgggaauauguacgcugaugacacugccggaugggauacaagaauaaccgaagacgaucugcaaaacgaggcaaagaucacugacauuauggaaccagagcaugcucuacuugccacaucgaucuuuaaacugaccuaucagaauaagguaguuagggugcagcgccccgcuaagaacggcacagucauggaugugauuucaagacgggaccagagggguagcgggcaagugggaacuuacggccucaauaccuucacgaacauggaagcccagcugauccgucagauggaguccgagggcauauuuuugccuagugaauuagagaccccaaaccuggcagaacgaguccucgauuggcuugagaaauaugggguugaacgccugaagagaauggcgauuucuggagacgacugugugguaaaacccaucgaugaccgguucgccacagcucuaacugcccugaaugauauggguaaggugaggaaagacaucccgcagugggagccuagcaagggcuggaacgauuggcaacagguccccuuuugcucccaccauuuccaccagcucauuaugaaggacgggcgcgagauagugguuccauguagaaaucaggaugaauuggugggacgggcaagggucucacaaggcgcugguuggagucugcgagagaccgccugccuugggaaaucuuacgcacagauguggcagcugauguauuuucaccguagagaccuccgcuuagccgcgaacgcuaucuguagcgccgugccuguagauuggguucccacaucccggacuaccuggucaauucaugcacaccaucaauggaugacgacagaagacaugcugagcguguggaauagggucuggaucgaggaaaacccauggauggaggauaagacccacgugucuuccuggggagacguucccuacuugggcaaaagagaggaccaguggugcggcagucugauugggcucacugcccgcgcuacaugggccagcaauauccagguggcaauaaaccagguccggaggcuuaucggaaaugaaaacuaccuggauuauaugaccucgaugaagcgauucaaaaaugagggugacccugaaggcgcucuaugguga

SEQ ID NO: 13575 - RNA, 9879 nt, Artificial Sequence
  derived and/or modified CDS sequence (opt3) from DENV-1__EU726779__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccuccuucagcaugacauguauugcgguuggccuggucacucuauaccucggggugauggugcaggcugauucuggaugcgucaucaacuggaaaggccgcgaacugaagugugguucagggaucuuuguuaccaaugaggugcacacguggacagaacaauauaaguuccaggccgacaguccgaaaagacuuagcgcagccauuggaaaggcuugggaggagggcgugugcgguauaagguccgccacccgguuggaaaacaucauguggaaacagauuucuaacgagcugaaucauauccuccuggaaaacgacaugaaguuuacuguagucgugggcgauguugcagggauuuuagcucagggcaagaagaugauccgcccucaacccauggaguacaaauauucguggaaaagcuggggcaaggccaagauaaucggggcggacgugcagaauaccacauucauuaucgauggaccaaacacuccugaaugucccgacgaucagagagccuggaauauuugggaggucgaggacuacggcuuugguaucuucaccacaaacauauggcugaaacuuagggauuccuauacacaggugugcgaccaccguuugaugucagcugcaauuaaagauaguaaggccguucacgcugacaugggguacuggaucgaaucugagaaaaaugaaaccuggaagcucgcccgggcauccuucauugaggugaagacuuguaucuggccaaaaucccauacacuguggucaaacggaguacuagaaagcgagaugauaauccccaagauuuauggcgguccuaucucucaacacaauuaccgaccaggcuacuuuacccagacugcggggccguggcaucugggaaaacucgagcuggauuucgaccuuugcgaaggcacaaccgucgugguggaugagcacugcgggaacagaggacccuccuugaggacgacuaccgucacaggcaagauuauccacgaaugguguugccgcaguuguacccugccuccauuacgguuuagaggugaggacgggugcugguauggaauggagauaaggcccguuaaagaaaaggaggaaaaucucguaaagagcaugguaucugccggcuccggugagguggacucauucagucugggccuucuguguauuagcaucaugaucgaagaggucaugcgcucgcgauggucccggaaaauguugaugacugggacacucgcuguguuuuuccugcuaauuaugggacagcugaccuggaacgaucucauccgucugugcauuaugguuggcgccaaugcaucugacagaauggggaugggaacaacuuaccuugcuuugauggccaccuuuaagaugaggccuauguucgcagugggccuguuauuucgccggcucacgagcagagagguccugcuucugacaauaggucuaucacucguggccaguguugaacugccaaacuccuuggaggaacugggggauggauuagcuaugggcaucaugauucucaaacugcuuaccgacuuccaaucucaucagcugugggcgacuuugcucagccugaccuuuaucaagacaacuuucucccuacacuaugccuggaaaaccauggcaauggugcugucaauugucagccuuuuuccccucugucugaguacgacaucucagaagaccacuugguugccgguacuguuaggcucccucgggugcaagccucugacaauguuccuuaucgcugagaauaaaauauggggaaggcgaagcuggccacugaacgaagguaucauggccgugggcauuguuucgaucuugcucucaucucugcuaaagaacgaugugccccuggccgggccucuuauugcuggaggcaugcucaucgcauguuacgucauaagugguuccagcgccgaccugucuuuggagaaagcggcugaggugagcugggaagaggaagccgagcauuccggggcaucacacaauauuuuaguagaagugcaggaugacggaaccaugaagaucaaagaugaggagcgcgacgauacucugacaauccuccugaaggccacccuucuggcugucaguggcguuuaucccuugagcauuccagcaacgcuauucgugugguacuuuuggcagaagaagaagcagcggucuggcgugcugugggacacuccuucacccccagaagucgggagagccgugcucgaugacggaauauauaggaucaugcagcguggucugcuuggccgcagccagguugggguaggaguguuccaagagaacgucuuucauaccauguggcacgugacacggggcgcgguuuuaauguaccaggguaaaagacuggaaccgaguugggcuagcgugaagaaagaccucauuuccuacgggggaggcuggagguugcagggcucuuggaauaccggggaggagguccaggugaucgccguagaaccuggaaagaaccccaaaaauguccaaacagcaccagguacuuucaagacccccgagggcgaagugggggccauugcucuggauuuuaagccuggaacgucgggcagcccaaucguuaaccgagaggguaaaauaguggggcucuauggaaauggcgucgugacaacuucaggcaccuacguuuccgccaucgcacaggcuaaggccagucaggaagggccccugccugagauugaggacgaaguguuccggaaacgcaaccuuacaaucauggaucugcacccgggaucugguaagaccagaagguauuugccagcgauuguccgggaggccaucaaacgaaagcuaagaacucugauacucgcacccacccgcgugguagcuagcgaaauggccgaggcuuuaaagggcaugccuauuagguaccaaacaacggcagugaaauccgaacauacugggaaggagaucguugaccugaugugccacgccaccuuuacaaugcgucuucugucaccaguccgggugcccaauuauaacaugaucauuauggaugaggcccauuucaccgacccuucuagcaucgcugcgagaggauacauaaguacuagggugggcaugggugaagcagccgcuauuuuuaugacagccaccccgcccggguccgucgaggcauucccacagagcaaugccguaauccaggaugaagaacgcgacauuccugaacgaucuuggaacucaggauaugaguggaucacggauuuucccggcaaaacugugugguucguuccauccauaaagaguggcaaugacauugcuaacugucucaggaaaaaugggaagcgggugauccaguugagcaggaagacauucgauaccgaguaccagaaaaccaagaacaacgacugggacuacgucgugacuacagauaucucggaaaugggagcgaauuuucgcgccgaccguguuauugauccuagacggugccugaaacccgugauccucaaggacgguccagagagggucauucuggcaggcccgaugccugugaccguagcuucugccgcacagcgccgagggagaauaggacggaaccacaauaaagaaggcgaucaguauaucuacaugggucagccccuuaacaaugacgaggaucaugcccacuggacagaggcuaagaugcuacuggacaacauuaauacuccagaagggaucauccccgccuuguucgagccugaaagggagaaguccgcggcaauugauggcgaauaucgcuuaagaggagaggccaggaaaacguuuguggagcugaugcggcguggcgaccucccaguuuggcugagcuacaaggucgcuucagaaggguuccaauauagugaucgccgauggugcuuugacggagagagaaacaaucaggugcuugaagagaacauggauguggaaauauggaccaaagagggugagaggaagaaacugcggccccgcuggcucgacgccagaacauacucugacccuuuggcucugagggaguucaaggaguuugcagccggccggcgauccgucagcggggaucuaauccuggaaauuggaaaacucccgcagcaccuuacucagagagcucaaaaugcccuggacaacuuaguuauguugcauaauucagagcagggcggucgcgcauauaggcacgcgauggaggaacugccagauaccaucgagacacucaugcugcuugcccugauugcugugcucaccgggggcguaacuuuguucuuucugaguggacggggcuuagggaagacgagcaucggacuacugugugugauggccuccucuguccuccuuuggauggcaagcguggaaccccauuggauagcugccuccaucauucuggaguucuuuuugaugguucugcucaucccugaacccgaccgucagagaaccccacaggauaaccaacuggcauacguggucauuggucuucucuucaugauccugacaguagccgcuaaugagaugggcuugcuggagacuaccaagaaagacuuagggauaggacacguggcgguugaaaaccaccaucacgccgcaaugcuagauguggaccugcauccugcuucagccuggacacucuacgccgucgcaaccacuauuaucacacccaugaugaggcacacgauugagaacaccacugcuaauaucucucuuacagccauagcgaaccaggcugccauccugaugggcuuggauaaggguuggccaauuaguaaaauggacaucggggugccucugcucgcacugggcugcuauucgcaggucaauccgcuuaccuuaaccgccgcugugcugaugcucguugcacauuacgccauuaucggacccggcuugcaagcgaaggcuacacgcgaagcccagaaacggacugcagccgggauaaugaagaacccaacgguggauggaauuguagcuaucgaccuggauccuguggucuaugacgccaaguuugagaaacagcuaggccagaucaugcugcucauucuuuguaccagccaaauccuguugaugcgaacaacuugggcacugugcgaauccauaacccucgcuacagguccccugaccacuuuaugggaggggucuccaggaaaguucuggaauacgacaauugccguuucaauggcgaacaucuucagaggcagcuaccuugccggugcaggccuggcuuuuucccucaugaaaagucuagggggaggcaggcgcgggaccggagcccagggcgagacucugggugaaaaguggaaacggcaguugaaucagcugucuaagagcgaguucaacaccuauaagagaucagggauuauggaaguggaccguuccgaggcaaaagaaggacucaagaggggcgagacaacuaaacacgcugucagucgggguaccgccaaacuucgcugguuuguggagcgaaaucugguaaaaccugaaggcaaggugaucgauuugggguguggaagaggcggguggagcuacuauugcgccggacugaagaaaguuacagaggugaagggcuacacgaaaggugggcccggacacgaggaaccgauaccaauggcgaccuacggcuggaaccucgucaaguuacauucuggcaaagacguguucuuuaucccucccgaaaagugugauacucugcuuugcgacauuggggaguccucaccaaaucccacaaucgaggaaggaaggacccugcggguccuaaaaaugguggagccuuggcuccgcgguaaccaauucuguauuaagauccugaauccguauaugcccagcguuguagaaacuuuggagcagaugcagagaaagcacggcgggaugcuggugaggaacccacucucgcgaaauucuacacaugagauguacugggucaguugcggaaccggcaacauuguguccgcuguuaauaugacgagccggaugcuucugaaccguuuuaccauggcacacagaaaaccuacauaugaacgcgauguggacuuaggugccgggacuaggcacgucgcuguggagcccgaaguagccaaccuggauaucauaggacagcggauugagaauaucaagcaugaacacaaaucaaccuggcauuacgacgaggauaacccuuauaagacaugggcauaccacggcuccuaugaggugaaaccaucuggcagcgccaguuccaugguuaauggggucgugaaguugcucacuaagcccugggacgugaucccuauggucacccaaauugcuaugacagauaccacuccauucggacagcagagaguuuuuaaagaaaagguggacacgcgcacacccaaagcgaagagggguaccgcccaaauaauggagguaacugcaaaauggcuguggggcuuccuaagccgaaacaagaagccgcggaucuguaccagagaagaguuuacaaggaaagugcgcucuaaugcugccauuggggcagucuucguggacgaaaaccaguggaacucagccaaggaggcuguugaggaugaacguuuuugggaccuugugcaucgggagagagaacugcacaaacagggaaagugcgccacgugcgucuacaacaugaugggcaaaagggagaagaagcucggugaguucgggaaagcgaagggaagucgcgcaaucugguacauguggcugggcgcccgauucuuggaguuugaggcucugggcuucaugaaugaagaucacugguuuucccgggagaacagccucucugggguggaaggagagggucuucauaaacugggcuauauuuuaagagacaucucgaauauaccugggggaaacauguacgccgaugacaccgcaggcugggauacuaggaucacagaggacgaucugcagaaugaagcucgcauuaccgacaucauggagccagaacacgccuugcucgcuaagucaauuuucaaacugacuuaucaaaacaagguaguuagagugcagcggcccgccaaaaaugguacagucauggaugugaucagcaggcgugaccagcgaggguccggacaggugggcaccuacggccuaaacacauuuacuaacauggaggcacaacuuauacgccagauggaaagugaggggauuuucucuccuagcgagcuggaaaccccaaaucucgcggagagaguccuggauugguuggaaaaguauggaguugagcgguuaaagaggauggccaucuccggugacgacugugugguaaaacccaucgaugaccgcuuugcuacggcccugaccgcacucaacgauaugggcaaggugagaaaagacauuccgcagugggaaccuucaaagggguggaaugauuggcagcaaguccccuucugcagucaucacuuucaccagcuuauaaugaaagacggacgggagaucgugguuccauguaggaaccaggaugagcuggugggccgagcucgugucucucagggugccggguggagccuaagagaaacagcaugccugggaaaguccuacgcccaaauguggcagcucauguauuuccaucgccgggacuugaggcuggcggcuaaugccauuuguucagcagugccuguagauuggauccccacuagcagaaccacauggucuauucacgcccaucaccaguggaugacuaccgaggacaugcuuuccguuuggaaccgcguguggaucgaagagaauccauggauggaagauaagacgcauauaaguagcuggggcgacguccccuaccugggcaaacgggaggaccaauggugcgggucgcucaucggauuaacagcuagggccaccugggcaacuaacauucagguggcuaucaaucagguucgaagacugauugguaacgagaauuacuuggauuauaugacauccaugaagcgguuuaaaaacgaaucugacccugagggcgcccugugguga

SEQ ID NO: 13576 - RNA, 9879 nt, Artificial Sequence
  derived and/or modified CDS sequence (opt3) from DENV-1__EU677176__SS-prME
agcgugaccaugcugcucaugcuuaugcccacagcacuggcuuuccacuugacuacgagaggaggggaaccucauaugaucgucuccaagcaggaaagggggaaaucuuuacuguuuaagaccucagccgguguuaacaugugcacauuaauugccauggaccucggcgagcugugugaagauacuaugaccuacaaaugcccacggauaacagagguggaaccggacgauguagacuguuggugcaauaccacugauacaugggugaccuaugggacguguagccaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacugcucaaaacagaggugaccaacccugcaguccugagaaaacuuugcauugaagccaaaaucucuaauacgaccacagauaguagguguccaacucaaggagaggcuacccugguugaagaacaagacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauccagacguccggaaccacaacuauuuuugcaggccauuuaaagugccggcugaaaauggauaagcuaacccucaaagggaugagcuaugucauguguacaggacuguucaaacuugagaaggaaguggccgagacucagcacgguaccguuuuggugcagauaaaauacgagggcacggacgcuccuugcaagaucccauucucgacacaagaugaaaaagggguaacccagaacggacgucugauuacugcgaaucccaucgucacagacaaggagaaaccugugaacauagaagcagagccacccuuuggcgagucuuauauuguuaucggugccggggaaaaggcucucaagcuguccugguucaaaaagggcucaaguaucggaaaaauguuugaggccaccgcacgcggcgccagaaggauggcuauucuuggggauacugccugggacuucggaagcaucgguggcguguuuaccuccgucgggaagcuggugcaucagauuuucggaacagcauacggcguauuguuuucuggugugagcuggacgaugaaaauagggaucggcguucuccugaccugguuaggacuaaauucacggaguacuucccuaagcaugacauguauugcggucggccucgugacccuguaccuuggggugaugguccaggcugauucuggaugcguuaucaacuggaagggccgagaauugaagugugguucagggaucuucgugacaaaugaggugcacacuuggaccgaacaauauaaauuucaggccgacaguccgaagcgccugagcgcagccauuggaaaggcuugggaggagggcguaugcgguauaagauccgccacgaggcucgaaaacaucauguggcggcagauuucuaacgagcugaaucauaucuuacuggaaaacgacaugaaguucacagucgugguuggcgauguggucgggauucuugcacagggcaagaagaugauccgcccucaacccauggagcacaaauacucguggaaaagcuggggcaaggcuaagauaaucggggccgacgugcagaauaccacuuuuauuaucgauggaccaaacaccccugaaugucccgacgaucagagagcguggaauauuugggagguugaggacuauggcuucgguaucuuuacaacuaacauaugguugaagcucagggauuccuacacccaggugugcgaccaccgucugaugucagccgcuauuaaagauaguaaggcaguacaugccgacaugggguauuggaucgaaucugagaaaaaugaaacauggaagcuagcucgggccagcuucauugaggucaagacguguaucuggccaaaaucccacacccuguggucaaacggagugcucgaaagcgagaugauaauccccaagauuuacggcgguccuaucucucaacauaauuaucgaccaggcuacuucacucagacagcagggccguggcaccugggaaaacuugaguuggauuuugaccugugcgaaggcaccacuguggucguugaugagcacugcgggaacagaggacccuccuuaaggacaaccacggugacuggcaagauuauccaugaaugguguugccgcaguuguacccucccuccacugcgguucaaaggugaggacgggugcugguacggaauggagauaagacccguaaaggaaaaggaggaaaaucuugugaaaagcauggucucugcgggcuccggugagguggacucauuuagucugggcuugcucuguauuagcaucaugaucgaagagguuaugaggucgcgcuggucccgaaagaugcugaugacagggacccuagccguguucuuucugcucauuaugggacagcugacuuggaacgaucuuauccggucuugcauuauggucggcgcuaaugccagcgaccguauggggaugggaacaaccuauuuggcacugauggcuacauucaaaaugagaccuauguuugccgugggcuuacucuucaggcgccugacuucacgggagguucuucugcuaaccauaggucucagucugguggcauccgucgaauugccaaacucucuggaggaauuaggggauggacucgccaugggcaucaugauucugaaacuucugacggacuuucaaagcuaccaguugugggcuacacuccugucccuaaccuucaucaaaacuaccuuuucacugcacuaugcguggaagacaauggccaugguacuuagcauugugagucuccugcccuugugucugucuacuaccucccagaagacgacaugguuaccgguucuccugggcagccuugggugcaaaccucugaccauguucuugaucgcagagaauaagauauggggaagaaaaucguggccacucaacgaagguaucauggcugugggcauugucucaauccugcuaucuagucugcuuaagaacgaugugccccucgccgggccucugauugccggaggcauguugaucgcuuguuacguaauauccgguagcucugcagacuuaagccuggagaaagccgcggagguguccugggaagaggaagcugagcauucaggggccagucacaauauucucgucgaaguucaggaugacggaacuaugaagaucaaagaugaggagagggacgauacacugaccauccuucugaaggcaacuuugcuagccgugagcggcguguauccccugucuauuccagcuacacucuuugucugguacuucuggcaaaagaaaaagcagcgauccggcgugcugugggacaccccuucacccccagaaguugagcgcgcaguacuugaugacgggauauaucggaucaugcagagaggauuacuggguaggagucaggugggcgucgggguguuccaagaaaacguuuuucauacgauguggcacgugacucguggagccguccucauguaccagggcaaacgcuuggagccgagcugggcguccgugaagaaagaccugauuucuuacggugggggauggcggcuccagggcucguggaauaccggcgaggaaguacaggucaucgcuguggagccugggaagaaccccaagaauguucaaacagccccaggaaccuucaaaacacccgaaggugaggugggcgcaauugcccuggauuuuaagccugggacuagcggaucaccaaucgucaacagagaaggcaaaauagugggucuuuaugggaauggaguugugaccacguccggcacauacgucagugcuaucgcccaggcaaaggcuucucaggagggcccccugccugagauugaagacgagguguucaggaaacgaaacuugacuaucauggaucuacacccggggagcggaaagaccaagcgguaucugccagccauuguacgcgaagcgaucaaaagaaagcucaggacauuaauacuggcccccacccgggugguugcauccgagauggcugaagcccuuaaagguaugccuauucgauaccaaacuaccgcugucaagucagagcauacaggcagagagaucguggaccugaugugccacgcaacguuuacuaugcgccucuugucuccagugaggguccccaauuauaacaugaucauuauggaugaagcccauuucaccgacccuagcaguaucgccgcucguggguacauauccacacggguaggaaugggcgaggcggcagccauuuuuaugaccgcuacuccgcccgguagcguggaagccuucccacagucuaaugcaguuauccaggaugaggaaagagacauuccugagaggucauggaacuccggguaugaguggaucacagauuuucccggaaaaaccgugugguucgucccaaguauaaagagcggcaaugacauugccaacugucugcgcaagaauggcaaacgagugauccagcucucgagaaagacguuugauacugaauaccagaagacaaagaacaacgacugggacuacguugugaccaccgauaucucugagaugggggcuaauuuccgggcggacagggucauugauccucgccguugccugaaacccgugauccuuaaggacggaccagaaagaguaauucuagccgguccgaugccugugacuguugcauccgcugcccagcggaggggccgcauagggcgaaaccacaauaaggagggagaucaguauaucuacaugggccagccccugaacaaugacgaggaucaugcacacuggacagaagccaaaauguuguuagacaacauuaauaccccagaggguaucauccccgcucuguucgaaccugagagagaaaagagcgccgcgauugauggggaguaucggcucaggggcgaggcacgcaaaacauuugucgaacugaugagaaggggagaccuuccaguguggcugucauacaagguggccagugagggcuuccaauauucugaucggcguuggugcuuugacggggaacgcaacaaucagguccucgaggaaaacauggauguugagauauggacuaaagagggagaacgaaagaaauugagacccagguggcuggacgcucggacguacuccgacccucuagcccugcgcgaguucaaggaauuugcugcagguagaaggagcgugucaggcgaucucauccuugagauugggaagcugccgcagcacuuaacccagcgggcccaaaaugcuuuggacaaccugguaaugcuccauaauagugaacagggaggccgagccuauagacacgcaauggaggagcugccagauacaaucgaaacucuuaugcugcucgcguugauugccgugcugaccgguggggucacauuauucuuucuaagcggccgcggacugggcaaaaccuccaucgggcuccuuugugugauggcuucuagcgcccuguuguggauggcauccguugagccccauuggauagcugccucaaucauucuggaguucuuucucauggugcugcuuaucccugagcccgacaggcagcggacuccacaggauaaccaacucgcauacgucguaauuggacuguuguucaugauccugacgguggccgcuaaugagauggguuuacuagaaaccacaaagaaagaccugggcauagggcacguugcgguggagaaccaccaucacgccacuaugcucgaugucgaccuucauccugcaucugcuuggacccuguacgccguggccacaaccauuaucacucccaugaugcgucacacaauugaaaacacgaccgcaaauaucaguuugacugcuauagccaaccaggcggcuauccugaugggacucgauaagggcuggccaauuucgaaaauggacaucggugucccucugcuugccuuagggugcuauagccaggugaauccgcugacacucaccgcagccguuuugaugcugguggcucauuacgcaauuaucggccccggacuacaagccaaggcgaccagagaggcucagaagaggacagccgcaggcauaaugaaaaacccaacuguagaugggauuguggccaucgaccuggauccugucguuuaugacgcuaaguuugaaaaacagcucggacagaucaugcuucugauuuuguguacgucccaaauccugcucaugcgcaccacaugggcccugugcgagucuauaacuuuagcaaccggcccccuuacaacccugugggaggguucaccagggaaguucuggaauacuacgauugcugugagcauggccaacaucuuucggggauccuaccucgcgggcgccggucuagcauucagucugaugaaaucuuugggcgggggacgaagaggcacaggggcucagggagaaacccugggcgagaaguggaagaggcagcucaaucagcuuagcaaaucagaguucaacacuuauaagcgcuccgguauuauggaggucgaccggagugaagccaaagaggggcugagacguggagagaccacaaagcacgcagugagcaggggcacugcuaaauugcggugguuuguagaacgcaaucuggugaagccugaggguaagguuaucgaucucggcugugggcgaggaggcuggucuuacuauugcgccgggcuaaagaaggugaccgaagucaaaggauacacaaagggcggucccgggcacgaggaaccgauaccaauggccacguacggauggaaccuggugaaacuucauuccggcaaggacgucuucuuuaucccucccgagaaaugugauacccugcuaugcgacauuggcgagucaagcccaaaucccacuaucgaagaggggagaacacucagggugcugaagaugguugaaccuugguugcggggaaaccaauucuguauuaagauccugaauccguauaugcccucgguaguggagacccucgagcagaugcagcgcaaacacgguggcaugcuugucagaaacccacugucuaggaauaguacucaugaaauguacuggguguccugcgggacaggaaacauuguuagcgcggugaauaugaccucacgaauguuacugaaccgguuuacgauggcucaccguaagccuaccuaugagagagaugucgacuugggcgcagguacacgccacguggccguagaacccgagguggcuaaccucgauaucauagggcagaggauugaaaauaucaaacaugagcacaaguccacuuggcauuacgacgaggauaacccuuauaaaaccugggccuaccacggaucuuaugaaguuaagccaagcggcagugcauccagcauggucaauggcguggugaagcugcuaacaaaacccugggacgucaucccuaugguuacucaaauugccaugaccgauacaaccccauucgggcagcagcggguguuuaaggagaaaguagacacuagaacgcccaaggcuaaacgcggaacagcgcaaauaauggaagugaccgccagguggcuuugggguuuccugucucgaaacaagaagccgcggaucuguacuagagaggaauuuaccaggaaaguccgcucaaaugcagcuauuggcgccguguucguugacgagaaccaguggaauagugcaaaggaggccguggaagaugagcguuuuugggaccucguccaucgggaaagagagcugcacaaacaggggaagugcgcuacaugcguguacaacaugaugggaaaaagggaaaagaaguugggcgaguucgguaaagccaaggggucccgcgcgaucugguacauguggcugggagcacgauuucucgaguucgaagcccuuggcuucaugaaugaggaucacugguuuagccgggaaaacucucugucgggcguagagggggagggauuacauaaacuggguuauauuuugagagacaucucaaagauaccuggcgggaauauguacgcugaugacacggccggaugggauaccaggaucacugaagacgaucuccagaacgaggcaaaaauuacagacaucauggaaccagagcacgcucugcuagccaccagcauuuucaaacuuacuuaucaaaauaaaguugugcgcguccagagacccgcucggaacggcacagugauggaugugaucuccaggcgugaccagcgagguagugggcaggucggaaccuacggccugaauacauuuacuaacauggaagcccaacucauacgccagauggagucugagagaauuuucagcccuuccgaacuggagaccccaaacuuggcagaacggguuuuagauuggcuggagaagcauggcguggaaaggcucaagcgcauggcgaucucaggggacgacuguguagugaaacccaucgaugacagauuugccacggcucuuagugcccugaaugauaugggaaagguccggaaagacauuccgcagugggagccuucuaaggguuggaacgauuggcagcaagugcccuucugcagccaccacuuucaucagcuaauaaugaaagacggcagggagaucguugugccaugucgaaaucaggaugaacuggucgggcgugcaagagugucccagggagcuggcuggucacuccgcgagaccgccugcuuggguaagagcuaugcacaaauguggcagcugauguacuuccaccggagggaccuuagacuggccgcgaacgcuauuuguucugccguaccuguugauugggugcccacaucccgcacuaccuggaguauccaugcacaccaucaguggaugacaacugaagacaugcucagcgucuggaaucggguguggauugaggaaaacccauggauggaggauaagacccacaucucguccuggggagacguucccuauuuaggaaaaagggaggaccaauggugcggcucucugauaggcuugacggcccgagcuacaugggccaccaauauccagguggcaauuaaccaggucagacggcugaucgggaaugaaaacuaccucgauuacaugacuucaaugaagagguuuaaaaaugacagcgauccugagggagcucuuugguga

SEQ ID NO: 13577 - RNA, 9879 nt, Artificial Sequence
  derived and/or modified CDS sequence (opt3) from DENV-1__EU726780__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaacaugugcacacuaauugccauggaccucggcgaacugugugaagauacuaugaccuacaaaugcccacggauaacagaaaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcccaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggagaagacccugaagcucuccugguucaagaaaggcucaaguaucggaaagauguuugaggcuacagccagaggcgcaaggcggauggccauucugggggauacggcuugggacuucggaagcaucgguggcguuuuuaccuccguggggaaacuuguccaucagauuuucggaacugccuacggcgugcuguuuucugguguaagcuggacaaugaagauagggaucggcguguugcucaccuggcugggauuaaauucacgaaguacaucccugagcaugacuuguauugcaguuggccuagucacccucuaccugggggugauggugcaggcggauucuggaugcgucaucaacuggaaaggccgcgaacuuaagugugguucagggaucuucguuacgaaugaggugcacacauggaccgaacaauauaaguuucaggcugacaguccgaaaagauugagcgccgcaauuggaaaggccugggaggagggcgugugcgguauaagguccgcuacucggcuggaaaacaucauguggaaacagauuucuaacgagcucaaucauauccuguuagaaaacgacaugaaguucaccguagucgugggcgauguugccgggauucuggcacagggcaaaaagaugauccgcccucaacccauggaguacaaauauucguggaaaagcuggggcaaggcuaagauaaucggggccgacgugcagaauacaacuuuuauuaucgauggaccaaacaccccugaaugucccgacgaucagagagcguggaauauuugggaggucgaggacuacggcuucgguaucuuuacaacgaacauauggcuuaaguugagggauuccuauacccaggugugcgaccaccgucucaugucagccgcuauuaaagauaguaaggcaguucacgccgacaugggguacuggaucgaaucugagaaaaaugaaacuuggaagcuggcucgggccagcuucauugaggugaagacauguaucuggccaaaaucccauacccuauggucaaacggaguacuggaaagcgagaugauaauccccaagauuuauggcgguccuaucucucaacacaauuaccgaccaggcuacuucacucagacagcagggccguggcaucucggaaaacuggagcuugauuuugacuugugcgaaggcaccacggucgugguggaugagcacugcgggaacagaggacccucccugaggacuaccacagucaccggcaagauuauccacgaaugguguugccgcaguuguacuuuaccuccacuccgguucagaggugaggacgggugcugguauggaauggagauaaggcccguuaaagaaaaggaggaaaaucuggugaaguccaugguaucugcgggcuccggugagguggacucauuuagucuuggccuguuguguauuagcaucaugaucgaagaggucaugcgcucgcgauggucccggaaaaugcucaugacagggacccuggccguguucuuucuacugauuaugggacagcucacauggaacgaucugauccgucuuugcauuaugguuggcgcuaaugccucugacagaauggggaugggaacuaccuacuuggcacugauggcuacguucaagaugaggccuauguuugccgugggcuuacucuuccgccggcugacaagcagagagguccuucugcuaaccauaggucucucacugguggcaaguguugaauugccaaacucccuggaggaauuaggggauggacucgccaugggcaucaugauucugaaacuucugacugacuuucaaucucaucaguugugggugacccuccugagccuaacauucaucaagacuaccuuuucccugcacuaugcuuggaaaacgauggcgaugguccuuucaauuguaagccucuucccccuguguuugaguacaaccucucagaagacuacauggcugccgguguuacucggcucccuggggugcaagccucuuaccauguuucugaucgccgagaauaaaauauggggaaggcgaagcuggccauugaacgaagguaucauggcaguuggcauugugucgauccuccugucaucucuacugaagaacgaugucccccuugcugggccucucauugccggaggcaugcugaucgccuguuacgugauaagugguuccagcgcugacuugucuuuagagaaagcagccgagguaagcugggaagaggaagcggagcauuccggggcuucacacaauauucugguggaaguccaggaugacggaacuaugaagaucaaagaugaggagcgcgacgauacacucaccauccugcuuaaggccacgcuguuggcaguuaguggcguguauccccuaagcauuccagccacucuguucgugugguacuucuggcagaaaaagaagcagcggucuggcguccucugggacaccccuucacccccagaaguggagagagcuguucuggaugacgggauauauaggaucaugcagcguggacuuuuaggucgcagccagguaggcgugggggucuuucaagaaaacguguuccauacaauguggcacguuacccggggagcagugcugauguaccagggcaaaagacucgagccgaguugggccagcgucaagaaagacuugauuuccuacggugggggauggaggcugcagggcucuuggaauacaggcgaggaagugcagguaaucgcggucgagccugggaagaaccccaaaaaugugcaaacugcuccaggaaccuuuaagacgcccgaaggugagguuggcgccauugcacucgauuucaagccugggacaucgggaagcccaaucgugaaccgagaaggcaaaauagucggucuguaugggaauggagugguuacuaccucaggcacauacguguccgccaucgcucaggccaaggcaagucaggagggcccccuuccugagauugaagacgaggucuuucggaaacgcaaccugaccaucauggauuugcacccggggucuggaaagacuagaagguaucuaccagcuauugugcgggaagccaucaaacgaaagcugagaacccucauauuagcgcccacacgcguaguggccagcgagauggcagaagcucugaaggguaugccuauuagguaccaaacgacugccguuaaauccgagcauaccggcaaggagaucgucgaccuuaugugccacgcuacauucaccaugcgucugcucucaccagugcgggugcccaauuauaacaugaucauuauggaugaagcacauuuuacugacccuucuagcaucgccgccagaggguacauaaguacaagggucggaaugggcgaggcugcggcaauuuucaugaccgccacgccgcccgguuccguagaggcuuuuccacagagcaaugccgugauccaggaugaggaacgcgacauuccugagcgaucuuggaacucaggguaugaguggaucacugauuuccccggaaaaacaguuugguuugugccauccauaaagaguggcaaugacauugcaaacuguuugaggaaaaauggcaagcgggucauccagcugagcaggaagaccuucgauaccgaauaccagaaaacuaagaacaacgacugggacuacgugguuacaaccgauaucucggagaugggggccaauuuccgcgcugaccgugugauugauccuagacggugccucaaacccgucauccugaaggacggaccagaaagggugauucuugcggguccgaugccuguaacaguggccucugcagcucagcgccgaggcagaauagggcggaaccacaauaaagagggagaucaguauaucuacaugggccagccccuaaacaaugacgaggaucaugcccacuggacugaagcaaagaugcuguuggacaacauuaauacgccagaggguaucauccccgccuuauuugaaccugagagggaaaaguccgcugccauugauggggaguaucgccugagaggcgaggcgaggaaaaccuucguugaacucaugcggcguggagaccugccagucuggcuuagcuacaagguggcaucagagggcuuucaauauagugaucgccgauggugcuucgacggggaaagaaacaaucaggugcuggaggaaaacauggaugucgagauauggacaaaagagggagaaaggaagaaacuccggccccgcugguuggacgccagaacuuacucugacccucuggcucuaagggaguuuaaggaguucgccgcuggucggcgauccguuagcggcgaucugaucucagagauugggaaacucccgcagcaccuuacccagagagcacaaaaugcccuggacaacuuagugauguugcauaauagugaacagggaggccgcgcuuauaggcacgccauggaggagcugccagauacaaucgaaacccucaugcugcuugcacugauugcgguacucacugguggggugacguuguuuuuccugagcggccggggauuaggcaagaccuccaucgggcuacugugugucauggccucuagcgugcuccuuuggauggcuuccguugagccccauuggauagccgcaucaaucauucuggaauuuuucuugauggugcugcucaucccugagcccgaccgucagagaacaccacaggauaaccaacuggcuuacgucguaauuggacuucucuuuaugauccugacuguggccgcaaaugagauggguuugcuggaaaccacaaagaaagacuuaggcauagggcacguugccguggagaaccaccaucacgcugcgaugcuagaugucgaccugcauccugccucugcauggacccucuacgcuguggccacuacaauuaucacgcccaugaugaggcacaccauugaaaacacuacagccaauaucagucuuaccgcaauagcuaaccaggccgcgauccugaugggauuggauaagggcuggccaauuucgaaaauggacaucggugucccucugcucgcucuggggugcuauagccaggugaauccgcuuaccuuaacagccgcaguucugaugcucguggcccauuacgcuauuaucggccccggauugcaagcaaaggccacucgcgaggcgcagaaacggacggcugccggcauaaugaagaacccaaccguagaugggauuguggcaaucgaccuggauccugucguuuaugacgccaaguucgaaaaacagcuaggacagaucaugcugcucauucuuuguacaucccaaauccuguugaugcgaacuaccugggcucugugcgagucuauaacacucgccaccggcccccugacuacguuaugggaggguucaccagggaaguuuuggaauacaaccauugcagugagcauggcuaacaucuucagaggauccuaccuugccggcgcgggucuggccuucagucucaugaaaucucuaggcgggggaaggcgcggcacuggggcacagggagaaacccugggcgagaaguggaaacggcaguugaaucagcugagcaagucagaauuuaacacauauaagagauccgguauuauggaggucgaccguagugaagcuaaagaggggcucaagaggggagagacuaccaaacacgccgugagccggggcacagcaaaacuucgcugguucguagaacgaaaucuggugaaaccugaggguaagguuaucgauuugggcugugggagaggaggcuggucuuacuauugcgcugggcugaagaaagugacggaagucaagggauacaccaaaggcggucccgggcacgaggaaccgauaccaauggccacuuacggauggaaccucgugaaguuacauuccggcaaagacgucuuuuucaucccucccgagaagugugauacacugcuuugcgacauuggcgagucaagcccaaaucccaccaucgaagaggggaggacucugcgggugcuaaaaaugguugaaccuuggcuccgcggaaaccaauuuuguauuaagauccugaauccguauaugcccucgguaguggagacauuggagcagaugcagagaaagcacgguggcaugcuggucaggaacccacucucucgaaauaguacccaugaaauguacuggguguccugcgggacgggaaacauuguuagcgccgugaauaugaccucacggaugcuucugaaccguuucacaauggcgcacagaaaaccuacuuaugagcgcgaugucgacuuaggcgcugguaccaggcacguggcaguagaacccgagguggccaaccuggauaucauagggcagcggauugaaaauaucaagcaugagcacaaauccacauggcauuacgacgaggauaacccuuauaagacuugggcuuaccacggaucuuaugaaguuaaaccaagcggcagugccuccagcauggucaauggcguggugaaguugcucaccaagcccugggacgucaucccuaugguuacacaaauugcaaugaccgauacuacgccauuugggcagcagagaguguucaaagagaagguagacacacgcacccccaaagccaagaggggaacugcucaaauaauggaagugaccgcgaaauggcugugggguuuucuaucucgaaacaagaagccgcggaucuguacaagagaggaguucacgaggaaaguccgcucaaaugccgcaauuggcgcuguguuuguugacgagaaccaguggaauagugccaaggaggcaguggaagaugagcguuucugggaccuuguccaucgggaaagagagcugcacaaacaggggaagugcgcaaccugcguguacaacaugaugggaaaaagggaaaagaagcucggcgaguuugguaaagcuaaggggucccgcgccaucugguacauguggcugggagcgcgauucuuggaguucgaagcacugggcuuuaugaaugaggaucacugguucagccgggaaaacucucucucgggcguagagggggagggacuucauaaacuggguuauauuuuaagagacaucucaaagauaccuggcgggaauauguacgccgaugacacugcuggaugggauacaaggaucaccgaagacgaucugcagaacgaggcccgcauuacugacaucauggaaccagagcacgcauugcucgcuaaaagcauuuuuaagcugacauaucaaaauaaaguugugagaguccagcggcccgccaagaacggcaccgugauggaugugaucuccaggcgugaccagcgagguagugggcaggucggaacauacggccuaaauacuuucaccaacauggaagcucaacuuauacgccagauggagucugagggcauuuuuagcccuuccgaacuggagacgccaaaccucgccgaaagaguucuggauugguuggagaaguaugggaucgaacgguuaaaaaggauggcaaucucaggagacgacugugugguaaagcccauugaugaccgcuucgcgaccgcccugacagcucucaaugauauggguaaagugagaaaggacauaccgcagugggagccuaguaaaggcuggaacgauuggcagcaaguccccuuuugcucucaucacuuccaccagcuuaucaugaaggacgggcgggagauugugguuccauguaggaaucaggaugaacuggugggacgagcccgugucagccagggcgcagguuggucccuaagagagacugcuugccuggggaagucauacgcccaaauguggcagcucauguauuuucaucgccgggacuugaggcuggcagccaacgcgaucuguagcgcugugccuguagauuggauucccaccucuagaacaacuugguccauccacgcccaucaccaguggaugaccacggaagacaugcuuaguguuuggaaucgcguguggauagaggaaaacccauggauggaggauaaaacacauaucagcucguggggagacguccccuaccugggcaagcgggaggaccaauggugcggcucccucauuggguuaaccgcaagggccacuugggcuacaaauauccagguggccauuaaccagguucgaagacugaucggaaaugaaaacuacuuggauuauaugaccucuaugaaacgguucaagaaugagucagacccugaaggugcacugugguga

SEQ ID NO: 13578 - RNA, 9879 nt, Artificial Sequence
  derived and/or modified CDS sequence (opt3) from DENV-1__EU726781__SS-prME
agcgugaccaugcugcucaugcuuaugcccaccgcacuggcuuuccacuugacuacgagaggcggggaaccucauaugaucgucuccaagcaggaaaggggaaaaucuuuacuguuuaagaccucagccgguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucguugucggccuggugacacuauaccucggggugaugguccaggcugauucaggaugcguuauuaacuggaagggccgcgaacugaagugugguagugggaucuuugugacuaaugaggugcacaccuggacggaacaguauaaauuccaagccgacagcccgaagagacuuuccgcagccaucggaaaggcuugggaggagggcguaugcgguauuaggucugccacacgguuggaaaacauaauguggaagcagaucucgaacgagcugaaucauauucuccuggaaaacgacaugaaauuuaccgucgugguuggcgauguggcagggaucuuagcucagggaaagaaaaugauucgcccucagcccauggaguacaaguauagcuggaaguccuggggcaaagccaagaucauaggggcggacguccaaaauacuaccuucaucauugauggaccaaacacaccugaaugucccgacgaucagagagccuggaauaucugggagguggaggacuacggcuuugguauuuucacuaccaacaucuggcugaaacuuagggauucauauacacagguuugcgaccaccguuugaugagugcugcaauaaaggauucuaaagccgugcacgcugacaugggguacuggauugaaagcgagaagaaugaaacguggaagcucgcccgggcauccuucaucgagguaaaaaccuguauuuggccaaagucacauacucuguggagcaacggaguccuagaaucugagaugaucauacccaaaaauuauggcgguccuaucucccagcacaacuaccgaccaggcuacuuuacacaaaccgcggggccguggcaucugggaaagcucgagcuggauuucgaccuuugcgaaggcacuacagugguggucgaugagcacugcgggaauagaggacccaguuugaggaccacgacuguuaccggcaaaauuauccacgaaugguguugccgcagcuguacacugccuccauuacgguuuaagggugaggacgggugcugguauggaauggagauuagacccgugaaggaaaaagaggaaaaccucguaaagucuaugguguccgccggcucaggugaggucgacaguuucagccugggccuucuguguaucucgauaaugauugaagaggugaugaggucccgcuggucucgaaaaauguugaugaccgggacucucgcuguucuguuucuacugaucaugggacagcucacauggaaugaucugauccggcuuugcauuauggugggcgccaacgcaagcgaccguauggggaugggaaccacauacuuggcucugauggccacuuucaagaugagaccuauguuugcagucggcuuacucuucaggcgccugaccucacgggaggugcuucugcuaacgaucggucucagucugguugccuccguggaauugccaaauucucuggaggaauuaggggauggacucgcuaugggcauuaugauacugaaacuucugacagacuuucagagccaucaauugugggcgacccuccugucccuaacuuucaucaagaccacauuuucacugcacuaugccuggaagacuauggcaaugguccuuagcauuguaagucucuucccccuguguuugucuaccacgucccagaaaacaaccuggcugccgguguuacucggcagccuggggugcaagccucuuacuauguuucugaucgcugagaacaaaauuuggggaagaaagucguggccauugaacgaagguaucauggccguuggcauagugucaauccuccugucuagucuacugaaaaaugaugucccccuugccgggccucucauugcuggaggcaugcugaucgcauguuacgugauuuccgguagcucugccgacuugagcuuagagaaggcggcugagguauccugggaagaggaagccgagcauucaggggcaagucacaacauccugguggaaguccaggaugacggaacaaugaaaauaaaggaugaggagagggacgauacccucacuauucugcuuaaggccacacuguuggcuguuagcggcguguauccccuaucuaucccagcaacccuguucgugugguacuucuggcagaaaaagaaacaacgauccggcguccucugggacacgccuucacccccagaaguggagcgcgccguucuggaugacgggaucuaucggauuaugcagagaggacuuuuagguaggagucagguaggcgugggggucuuucaggaaaauguguuccauacuauguggcacguuacccguggagcggugcugauguaccaaggcaagcgccucgagccgagcugggcuuccgucaaaaaggacuugauaucuuacggugggggauggcggcugcagggcucguggaacacaggcgaggaagugcagguaaucgccgucgagccugggaagaaucccaaaaacgugcagaccgcaccaggaacauuuaagacuagcgaaggugagguuggcgccauugcucucgauuucaaacccgggaccucaggauccccuaucgugaauagagaaggcaagauugucggucuguaugggaacggagugguuacgacaaguggcacuuacgugucugccaucgcacaagcuaaagccagccaggagggcccacuucccgagauagaagacgaggucuuuaggaagcgaaaucugaccaucauggauuugcacccuggguccggaaagacacggcgcuaucuaccggcgauugugagagaagccaucaaaaggaagcugcggacccucauuuuagcaccaacucgaguaguggcuucagagauggccgaagcucugaaagguaugcccaucagauaccagaccacagcaguuaagucugagcauacgggcaaagagauagucgaccuuaugugccacgccacuuucaccaugcgccugcucagcccugugagggugccaaacuauaauaugauuaucauggaugaagcccauuuuacagaccccaguuccaucgcugcgcguggguacauuagcacccgggucggaaugggcgaggcagccgcuaucuucaugacugccacaccuccggguucuguagaagcauuuccccaaucaaacgccgugauacaggaugaggaaagagacauuccagagagguccuggaauaguggguaugaguggaucaccgauuucccuggaaagacgguuugguuugugcccagcauuaagucgggcaacgacaucgcuaauuguuugcgcaaaaacggcaagcgagucauacagcugucuagaaaaacuuucgauacagaauaccagaagaccaaaaacaaugacugggacuacgugguuaccacugauauuuccgagaugggggcgaacuuccgggccgacagggugaucgauccacgccguugccucaagccugucauccugaaggacggacccgaaagagugauucuugcagguccaaugccgguaacaguggcuagcgccgcacaacggaggggccgcaucgggcgaaaucacaacaaagagggagaucaguauauuuacaugggccagccucuaaauaacgacgaggaucaugcccacuggaccgaagcuaagaugcuguuggacaauauaaacacacccgaggguaucauuccagccuuauuugaacccgagagagaaaaaucagcggcaaucgauggggaguaucggcugaggggcgaggcccgcaagacuuucguugaacucaugagaaggggagaccugccugucuggcuuaguuacaaaguggcuucugagggcuuucaguauuccgaucggcguuggugcuucgacggggaacgcaauaaccaagugcuggaggaaaauauggaugucgagaucuggacgaaggagggagaacgaaagaaacucagaccaaggugguuggacgcccggaccuacagcgacccccuggcucuacgcgaguuuaaagaguucgcagccgguagaaggucaguuaguggcgaucugauucucgagauagggaaacuuccucagcaccugacacagcgggcucagaacgccuuagacaauuuggugaugcugcauaacagcgaacaaggaggccgagcauauagacacgcgauggaggagcucccggauacuaucgaaacccugaugcuucuggcccucauugcuguauugacagguggggugacccuguuuuucuuauccggccgcggacuaggcaagacuucuaucgggcugcucugugucauggccagcuccgugcuucuguggauggcaucaguugagccacauuggauugcugccucuaucauauuggaauuuuuccugauggugcuccugauccccgagccugacaggcagcggacgccccaggauaaucagcuugcauacgucguaauuggacuccuguuuaugaucuugaccguggccgcuaacgagaugggucuguuagaaacaacuaaaaaggaccuaggcauugggcacguugcgguggagaaccaccaucacgccgcaaugcuggaugucgaccuccauccagcuagugccuggacccuuuacgccguggcaacaaccaucauaacuccuaugaugcgucacacaauugaaaauacgaccgcuaacaucucgcugacugccauugcgaaucaagcugccaucuugaugggacuggauaaaggcuggcccauaagcaagauggacaucggugucccacuccuggcacuugggugcuauucccaggugaacccuuuaacacugaccgccgcuguucucauguugguggcacauuacgccauuaucggcccgggacugcaggcgaaggcuaccagagaggcccagaagaggacagcagccggcauuaugaagaaucccacuguagaugggaucguggcuauagaccuagauccagucguuuaugacgccaaauucgaaaagcagcugggacagauuaugcuccuuauccuguguacgucucagaucuugcugaugcgcaccacaugggcacucugcgagucaauuacucuggcuaccggcccuuuaacaacccuuugggaggguagccccgggaaauuuuggaacacuacgaucgccguguccauggcgaauauauuccggggaaguuaccuggccggcgcaggucucgcuuucucucuaaugaaaagccugggcgggggacgaagaggcacaggggcccaaggagaaaccuugggcgagaaguggaaaaggcagcugaaccagcucucaaaguccgaauuuaauacuuauaaacgcagugguauuauggaggucgaccggagcgaagcaaaggaggggcuuaaaagaggagagaccacaaagcacgcugugucucguggcacugccaagcugaggugguucguagaacggaacuuggugaaaccagaggguaagguuaucgaucugggcugugggcgcggaggcugguccuacuauugcgccgggcucaaaaaggugaccgaagucaaaggauacacaaagggcgguccugggcacgaggaacccauuccgauggcgacguacggauggaauuuagugaaacugcauucaggcaaggacgucuuuuucaucccaccugagaagugugauacccuucugugcgacauaggcgagagcucgcccaacccaacuaucgaagaggggcgaacacuaagagugcucaaaaugguugaacccuggcugaggggaaaucaguuuuguauuaagaucuugaacccuuauaugccgucuguaguggagacccuggagcaaaugcagcggaaacacgguggcaugcucguccgcaauccccuuaguagaaacuccacucaugaaauguacugggugagcugcgggacaggaaauauuguuucagcugugaacaugaccuccaggaugcuguuaaaccgauucacgauggcacaccggaagccaaccuaugagcgugaugucgaccugggcgccgguacaagacacguggcuguagaaccugagguggccaauuuggauaucauugggcagcgcaucgaaaacauaaaacaugagcacaagucuacuuggcauuacgacgaggauaaucccuauaagaccugggcauaccacggaagcuaugaaguuaaaccuaguggcuccgccagcucuauggucaacggcguggugaagcuccugacaaaaccaugggacgucauucccaugguuacucagaucgcuaugaccgauacaaccccuuuugggcaacagaggguguucaaggagaaaguagacacucggacgccaaaggcgaagagaggaacagcccagaucauggaagugaccgcaaaauggcuaugggguuuucuuucacgcaauaagaaacccaggauuuguacucgagaggaguucacccggaaggucagaaguaacgcugccauaggcgcaguguuuguugacgagaaucaauggaacuccgccaaagaggcuguggaagaugagagguucugggaccugguccaucgcgaacgugagcuccacaagcaggggaagugcgccacaugcguguacaauaugaugggaaaacgggaaaagaaacugggcgaguuugguaaggcgaaagggagcagagcaaucugguacaugugguugggagccagguuccuggaguucgaagcucucggcuuuaugaacgaggaucacugguucucucgcgaaaauucgcuuucaggcguagagggggagggacugcauaaguuagguuauauucugcgagacaucagcaaaauuccgggcgggaacauguacgccgaugacacggcaggaugggauacccggaucacugaagacgauuugcagaaugaggcuaagauaacagacaucauggaaccugagcacgcccuccuggcuaaguccauuuuuaaacuaaccuaucagaacaagguugugagaguccaaaggccagccaaaaauggcacugugauggaugugaucagucgcagagaccagcgggguucugggcaggucggaacauacggccuuaacaccuucacaaacauggaagcacagcugauuaggcaaauggagagcgagggcaucuuuucccccucagaacucgagacuccuaaucuggcggggcguguuuuggauugguuagaaaagcauggaguggagcgacugaaacgcauggccauaaguggugacgacuguguagugaagccaauugaugacagauucgcuaccgcccucacggcacuuaacgauaugggcaagguccggaaagacaucccccagugggaaccgucuaagggguggaaugauuggcaacaggugccuuuuugcagccaccacuuccaucaacugaucaugaaagacggaagggagauuguugugcccugucgcaaccaggaugagcuagucggcagagcucgggugucccagggugccggguggucacugagggaaaccgcaugccucggaaagagcuaugcccagauguggcaauugauguacuuucaccgacgugaccugagacuugcggcuaaugccauauguucugcaguaccaguugauugggugccuacaucccgcacuaccuggaguauccaugcccaccaucaguggaugacaacugaggacaugcugagcgucuggaaccggguguggauugaagagaaucccuggauggaagauaaaacccacaucucguccuggggcgacguuccauaucucggcaagagggaggaccaguggugcgggucuuuaauuggacugacggcuagagccacaugggcaaccaacauccaaguggcuauaaaucagguccgccgguugaucgguaacgagaauuaccuggauuacaugacuucaaugaagagguucaaaaacgaaagcgaccccgagggcgcccucugguga

SEQ ID NO: 13579 - RNA, 9879 nt, Artificial Sequence
  derived and/or modified CDS sequence (opt3) from DENV-1__EU726782__SS-prME
agcgugaccaugcugcucaugcuuaugcccacggcccuggcuuuccacuugacuacgagaggaggggaaccucauaugaucgucuccaagcaggaaagagggaaaucuuuacuguuuaagaccucagccgguguuaauaugugcacacuaauugccauggaccucggagagcugugugaagauacuaugaccuacaaaugcccacggauaacagagaccgaaccggacgauguggacuguuggugcaaugcgacugauacauggguaaccuaugggacguguagucaaacuggggagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcguugggaaacuggugcaucagauauucggaaccgcauacggcgucuuguuuuccggugugucuuggacuaugaagaucgggauuggcguacuccugacaugguuaggacugaauagccgaucaaccagucuauccaugacauguaucgcggugggccucguuacucuguaccuuggggucauggugcaggcugauagcggaugcgugaucaacuggaaaggccgcgaauugaagugugguucugggauuuucgucaccaaugagguucacacguggacagaacaauauaaguuucaggccgacucaccgaaaagacugagugcagccauaggaaaggcuugggaggagggcgugugcgguaucaggagcgccacccggcucgaaaacauuauguggaaacagaucuccaacgagcugaaucauauuuuacuggaaaacgacaugaaguucacugugguagucggcgauguggcagggauccuugcucagggcaagaagaugauacgcccucaacccauggaguacaaauauucuuggaagucguggggcaaggccaaaaucauuggggcggacguucagaauaccacauuuaucauugauggaccaaacacuccugaaugucccgacgaucagagagccuggaauaucugggagguggaggacuacggcuucgguauauuuaccacaaacauuugguugaagcucagggauagcuauacgcaggucugcgaccaccgucugauguccgcugcaaucaaagauucaaaggccgugcacgcugacaugggguacuggauugaaagugagaaaaaugaaaccuggaagcuagcccgggcaucuuucaucgagguuaagacuuguauauggccaaaaagccauacacugugguccaacggagugcucgaaucagagaugaucauucccaagaucuauggcgguccuauuagccaacacaauuaccgaccaggcuacuucacccagacugcggggccguggcaucugggaaaacuugaguuggauuuugaccugugcgaaggcacaaccguagucguggaugagcacugcgggaacagaggacccucuuuaaggacgacuaccgugacaggcaagaucauacacgaaugguguugccgcuccuguacccucccuccacugcgguucagaggugaggacgggugcugguauggaauggagauuaggcccgucaaagaaaaggaggaaaaucuuguuaagaguauggugagcgccggcucuggugagguagacuccuuuucacugggcuugcucuguaucaguaucauuaucgaagaggugaugcgcagccgauggucgcggaaaaugcugaugacugggacacuagcugucuucuuucugcucauuaugggacagcugaccuggaacgaucuuauacguuugugcaucauggugggcgccaaugcauccgacagaauggggaugggaacaacuuaccuggcuuuaauggccaccuucaagaugaggccuauguuugcaguuggccuccuguuccgccggcuuacgucuagagaggugcugcuacucacaauuggucugagcuuggucgccucaguggaacugccaaacaguuuagaggaacucggggauggacuggcuaugggcaucaugauucuuaaacuguugaccgacuuucaaucccaucagcucugggcgacucugcuaucucugaccuucaucaagacaacuuuuagccuucacuaugccuggaaaaccauggcaaugguucucuccauagugucacuguuccccuugugucugagcacgacaagucagaagaccacuugguuaccgguccuccugggcucucuugggugcaagccucugacaauguuuuugaucgcugagaauaaaauuuggggaaggcgauccuggccacucaacgaagguaucauggccguaggcauugugagcauccugcuaucgucacugcuuaagaacgauguuccccucgccgggccucugauagcuggaggcauguugauugcauguuacgugaucucugguaguuccgccgacuuaagccuggagaaagcggcugaggucucuugggaagaggaagccgagcauagcggggcaucccacaauauccucguggaaguacaggaugacggaaccaugaagauuaaagaugaggagcgcgacgauacucugacaauacuucugaaggccaccuugcuagcugugucaggcgucuauccccugaguaucccagcaacacucuucguuugguacuucuggcagaagaagaagcagcggagcggcgugcugugggacacuccuucucccccagaaguggagagagccguccuugaugacgggauuuauaggaucaugcagcguggauuacugggucgcucccaggugggcguugggguauuucaagaaaacguguuccauaccauguggcacgucacacggggagcggugcucauguaccagggcaaaagauuggagccgucaugggcuaguguuaagaaagaccugauuagcuacggugggggauggaggcuccagggcuccuggaauaccggcgaggaagugcaggucaucgccguggagccugggaagaaccccaaaaauguacaaacagcaccaggaacuuuuaagacccccgaaggugaggucggcgccauagcucuggauuucaagccugggacgucuggaucgccaaucgugaaccgagaaggcaaaauuguuggucuuuaugggaauggaguggucacaacuagcggcaccuacgugucagccaucgcacaggcuaaggccucccaggagggcccccugccugagauugaagacgagguuuuucggaaacgcaacuugacaaucauggaucuacacccggggaguggaaagaccagaagguaucugccagcgauagugcgggaagccauuaaacgaaagcucagaacuuuaauccuggcacccacccgcgucguggcuucugagauggccgaagcucuuaaggguaugccuaucagguaccaaacaacggcaguaaaaagcgagcauacuggcaaggagauuguggaccugaugugccacgccaccuucacaaugcgucucuuguccccaguucggguccccaauuauaacaugaucauaauggaugaagcccauuuuaccgacccuucaucuauugcugcgagaggguacaucagcacuagggugggaaugggcgaggcagccgcuauuuucaugacagccaccccgcccgguaguguggaagcauuuccacaguccaaugccgucauccaggaugaggaacgcgacauaccugagcgaagcuggaacucuggguaugaguggauuacggauuuccccggaaaaacuguaugguuugugccaucaaucaaguccggcaaugacaucgcuaacugucugaggaaaaauggcaagcggguuauucagcucaguaggaagacauucgauaccgaauaccagaaaaccaagaacaacgacugggacuacguggucacuacagauaucagcgagaugggggcgaauuuccgcgccgaccgugugauugauccuagacggugccugaaacccguuauacuuaaggacggaccagaaagggugauccuagcagguccgaugccugucaccguggcuucggccgcacagcgccgaggcagaauugggcggaaccacaauaaagagggagaucaguauaucuacaugggccagccccugaacaaugacgaggaucaugcccacuggacagaagcuaagauguuguuagacaacaucaauacuccagaggguauuauacccgcccuguuugaaccugagagggaaaagucugcggcaaucgauggggaguaucgccucagaggcgaggccaggaaaacguucguagaacugaugcggcguggagaccuuccaguguggcuguccuacaagguugcuagcgagggcuuucaauauucagaucgccgauggugcuucgacggggaaagaaacaaucagguccucgaggaaaacauggauguggagauuuggaccaaagagggagaaaggaagaaauugcggccccgcuggcuggacgccagaacauacagugacccucuagcucugagggaguuuaaggaguucgcagccggucggcgaucuguguccggcgaucucauccuugagauugggaaacugccgcagcacuuaacucagagagcucaaaaugccuuggacaaccuggucaugcuccauaauagcgaacagggaggccgcgcauauaggcacgcgauggaggagcugccagauaccaucgaaacacuuaugcugcucgccuugauagcuguucugaccgguggggugacuuuauuuuuccuaucaggccggggacugggcaagacgaguaucgggcuccuuuguguaauggccagcuccgugcuguuguggauggcaucugucgagccccauuggauugcugccagcaucauucuggaauuuuuccucauggugcugcuuaucccugagcccgaccgucagagaaccccacaggauaaccaacucgcauacguugugauaggacuguuguuuaugauucugacagucgccgcuaaugagauggguuuacuagaaacuaccaagaaagaccugggcaucgggcacguagcgguggagaaccaccaucacgccgcaaugcucgauguugaccuucauccugcuuccgccuggacacuguacgccguggcaaccacuauuaucacacccaugaugaggcacacgauagaaaacaccacugcuaauaucucauugacagccauugcgaaccaggcugccauccugaugggacucgauaagggcuggccaauuucuaaaauggacaucggugucccucugcuugcauuagggugcuauagucaggugaauccgcugacccucaccgccgcugucuugaugcugguggcacauuacgccauaauuggccccggacuacaagcgaaggcuacacgcgaggcccagaaacggacugcagccggcaucaugaagaacccaacgguugaugggaucguggcuauugaccuggauccuguaguguaugacgccaaguucgaaaaacagcucggacagaucaugcuucugauauuguguaccucgcaaauucugcucaugcgaacaacuugggcacugugcgagagcaucaccuuagcuacaggcccccuuaccacucugugggaggguuccccagggaaguuuuggaauacgacaauugccgucucuauggcgaacaucuucagaggaucauaccucgccggcgcaggucuagcuuucagccugaugaaauccuugggcgggggaaggcgcggcaccggggcccagggagaaacucugggcgagaaguggaaacggcagcucaaucagcuuaguaagucugaauuuaacaccuauaagagaagcgguauaauggagguugaccguucagaagcaaaagaggggcugaagaggggagagacaacuaaacacgcugugucccggggcaccgccaaguugcgcugguucgucgaacgaaaucuggugaaaccugaggguaagguaaucgaucucggcugugggagaggaggcuggaguuacuauugcgccggguuaaagaaagugacagaaguuaagggauacacgaaaggcggucccgggcacgaggaaccgauuccaauggcgaccuacggauggaaccuggugaaacuucauagcggcaaagacgucuuuuucaucccucccgagaagugugauacucugcuaugcgacauuggcgagucuuccccaaaucccacaaucgaagaggggaggacccuccgggugcugaaaauggucgaaccuugguugcgcggaaaccaauuuuguauuaagauccugaauccguauaugcccucagugguugagacucucgagcagaugcagagaaagcacgguggcaugcuuguaaggaacccacugagccgaaauucgacacaugaaauguacugggugucuugcgggaccggaaacauagucagugcugugaauaugacgucccggauguuacugaaccguuucaccauggcacacagaaaaccuacauaugagcgcgauguugacuugggcgccgguacuaggcacguggcugucgaacccgagguggccaaccucgauauuaucgggcagcggaucgaaaauauuaagcaugagcacaaaagcaccuggcauuacgacgaggauaacccuuauaagacaugggcauaccacggaucauaugaaguaaaaccauccggcucugccagcaguauggugaauggcguugucaagcugcuaacuaagcccugggacgugauaccuauggugacccaaaucgcuaugacagauaccacuccauuugggcagcagagagucuucaaagagaagguugacacgcgcacacccaaagcgaagaggggaaccgcccaaauuauggaagugacugcaaaauggcuuugggguuuucugucccgaaacaagaagccgcggaucuguaccagagaggaguucacaaggaaaguacgcagcaaugcugccauuggcgcaguguuugucgacgagaaccaguggaacucugccaaggaggcuguggaagaugagcguuucugggaccucguucaucgggaaagagagcugcacaaacaggggaagugcgccacgugcguguacaacaugaugggaaaaagggaaaagaaguugggcgaguuugguaaagcgaaggggucacgcgcaaucugguacauguggcugggagcccgauuccucgaguucgaagcucuuggcuuuaugaaugaggaucacugguucagucgggaaaacucccugagcggcgucgagggggagggauuacauaaacuggguuauauauugagagacaucucuaagauuccuggcgggaauauguacgccgaugacaccgcaggaugggauacuaggaucacagaagacgaucuccagaacgaggcucgcauuaccgacaucauggaaccagagcacgcccugcuagcuaaaucgauauuuaaacuuacuuaucaaaauaaagugguaagaguucagcggcccgccaagaacggcacagugauggaugucauuucaaggcgugaccagcgagguagcggacaggugggaaccuacggccugaauacauucacuaacauggaagcacaacucauccgccagauggaguccgagggcaucuuuaguccuucugaacuggagauuccaaacuuggcggaaagaguguuagauuggcuggagaaguauggggucgaacggcucaaaaggauggccauaagcggagacgacuguguugugaagcccaucgaugaccgcuucgcuaccgcccuuacggcacugaaugauauggguaaaguaagaaaggacauuccgcagugggagccuuccaaaggcuggaacgauuggcagcaagugcccuuuugcucacaucacuuccaccagcuaaucaugaaggacgggcgggagauugucgugccauguaggaaucaggaugaacugguuggacgagcucgugugagucagggcgccgguuggucucucagagagaccgcaugcuugggaaagagcuacgcccaaauguggcagcugauguauuuucaucgccgggaccuuaggcuggcggcuaacgccaucuguuccgcagucccuguggauuggauacccacaucaagaacuaccuggagcauccacgcccaucaccaguggaugacaacugaagacaugcucucuguauggaaucgcguuuggauugaggaaaacccauggauggaggauaaaacccauaucuccaguuggggagacgugcccuacuuaggcaagcgggaggaccaauggugcggcagccugauuggguugacggcuagggccacaugggcaaccaauauccaggucgcuauuaaccaggugcgaagacugauaggaaaugaaaacuaccucgauuauaugacuucgaugaaacgguucaagaaugagggugacccugaaggcgcccuuugguga

SEQ ID NO: 13580 - RNA, 9879 nt, Artificial Sequence
  derived and/or modified CDS sequence (opt3) from DENV-1__EU677178__SS-prME
agcgugaccaugcugcucaugcuuaugcccacagcccuggcuuuccacuugacuacgagaggaggggaaccucauaugaucgucuccaagcaggaaagagggaaaucuuuacuguuuaagaccucagccgguguuaauaugugcacacuaauugccauggaccucggagagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcguugggaaacuggugcaucagauauucggaaccgcauacggcgucuuguuuuccggugugucuuggacuaugaagaucgggauuggcguacuccugacaugguuaggacugaauagccgaucaaccagucuauccaugacauguaucgcggugggccucguuacucuguaccuuggggucauggugcaggcugauagcggaugcgugaucaacuggaaaggccgcgaauugaagugugguucugggauuuucgucaccaaugagguucacacguggacagaacaauauaaguuucaggccgacucaccgaaaagacugagugcagccauaggaaaggcuugggaggagggcgugugcgguaucaggagcgccacccggcucgaaaacauuauguggaaacagaucuccaacgagcugaaucauauuuuacuggaaaacgacaugaaguucacugugguagucggcgauguggcagggauccuugcucagggcaagaagaugauacgcccucaacccauggaguacaaauauucuuggaagucguggggcaaggccaaaaucauuggggcggacguucagaauaccacauuuaucauugauggaccaaacacuccugaaugucccgacgaucagagagccuggaauaucugggagguggaggacuacggcuucgguauauuuaccacaaacauuugguugaagcucagggauagccacacgcaggucugcgaccaccgucugauguccgcugcaaucaaagauucaaaggccgugcaugcugacaugggguauuggauugaaagugagaaaaaugaaaccuggaagcuagcccgggcaucuuucaucgagguuaagacuuguauauggccaaaaagccacacacugugguccaacggagugcucgaaucagagaugaucauucccaagaucuacggcgguccuauuagccaacauaauuaucgaccaggcuacuucacccagacugcggggccguggcaccugggaaaacuugaguuggauuuugaccugugcgaaggcacaaccguagucguggaugagcacugcgggaacagaggacccucuuuaaggacgacuaccgugacaggcaagaucauacaugaaugguguugccgcuccuguacccucccuccacugcgguucagaggugaggacgggugcugguacggaauggagauuaggcccgucaaagaaaaggaggaaaaucuuguuaagaguauggugagcgccggcucuggugagguagacuccuuuucacugggcuugcucuguaucaguaucaugauugaagaggugaugcgcagccgauggucgcggaaaaugcugaugacugggacacuagcugucuucuuucugcucaucaugggacagcugaccuggaacgaucuuauucguuugugcauaauggugggcgccaauacauccgacagaauggggaugggaacuaccuaucuggcauuaauggcuacguucaagaugaggccuauguuugccguuggccuccuguuccgccggcuuacaucuagagaggugcugcuacucaccaucggucugagcuuggucgcaucaguggaacugccaaacaguuuagaggaacucggggauggacuggccaugggcauuaugauccuuaaacuguugacugacuuucaaucccaccagcucugggcuacccugcuaucucugacauucauuaagacuaccuuuagccuucauuacgcguggaaaacgauggccaugguucucuccaucgugucacuguuccccuugugucugagcacaaccagucagaagacuacaugguuaccgguccuccugggcucucuugggugcaagccucugaccauguuuuugauagcagagaauaaaaucuggggaaggcgauccuggccacucaacgaagguauuauggcuguaggcaucgugagcauucugcuaucgucacugcuuaagaacgauguuccccucgccgggccucugaucgccggaggcauguugauagcuuguuaugugauuucugguaguuccgcagacuuaagccuggagaaagccgcggaggucucuugggaagaggaagcugagcacagcggggccucccauaauauccucguggaaguacaggaugacggaacuaugaagaucaaagaugaggagcgcgacgauacacugaccauucuucugaaggcaacguugcuagccgugucaggcgucuacccccugaguauaccagcuacucucuucguuugguauuucuggcagaagaagaagcagcggagcggcgugcugugggacaccccuucucccccagaaguggagagagcaguccuugaugacgggaucuacaggauuaugcagcguggauuacugggucgcucccaggugggcguugggguauuucaagaaaacguguuccacacaauguggcacgucacccggggagccgugcucauguaucagggcaaaagauuggagccgucaugggcgaguguuaagaaagaccugaucagcuacggugggggauggaggcuccagggcuccuggaauacaggcgaggaagugcaggucauugcuguggagccugggaagaaccccaaaaauguacaaacugccccaggaaccuuuaagacgcccgaaggugaggucggcgcaaucgcccuggauuucaagccugggacaucuggaucgccaauagugaaccgagaaggcaaaaucguuggucuuuacgggaauggaguggucacuaccagcggcacauaugugucagcuauugcccaggcaaaggcuucccaggagggcccccugccugagaucgaagacgagguuuuucggaaacgcaacuugaccauuauggaucuacauccggggaguggaaagacuagaagguaccugccagccaucgugcgggaagcgauaaaacgaaagcucagaaccuuaauucuggcccccacacgcgucguggcaucugagauggcugaagcccuuaaggguaugccuaucagguaucaaacgacugcuguaaaaagcgagcacaccggcaaggagaucguggaccugaugugccaugcaacauucaccaugcgucucuuguccccaguucggguccccaauuacaacaugauuaucauggaugaagcccacuuuacugacccuucaucuauagccgcuagaggguauauuagcacaagggugggaaugggcgaggcggcagccaucuucaugaccgcuacgccgcccgguaguguggaagccuuuccacaguccaaugcagucauucaggaugaggaacgcgacaucccugagcgaagcuggaacucuggguacgaguggauaacugauuuccccggaaaaacaguaugguuugugccaucaauuaaguccggcaaugacaucgccaacugucugaggaaaaauggcaagcggguuauccagcucaguaggaagaccuucgauaccgaauaucagaaaacuaagaacaacgacugggacuacguggucacaaccgauauuagcgagaugggggcuaauuuccgcgcggaccgugugaucgauccuagacggugccugaaacccguuauucuuaaggacggaccagaaagggugauacuagccgguccgaugccugucacaguggcaucggcugcccagcgccgaggcagaaucgggcggaaccauaauaaagagggagaucaguacauuuauaugggccagccccugaacaaugacgaggaucacgcacacuggacugaagccaagauguuguuagacaacaucaauacgccagaggguaucauucccgcucuguuugaaccugagagggaaaagucugccgcgauagauggggaguaccgccucagaggcgaggcaaggaaaaccuucguagaacugaugcggcguggagaccuuccaguguggcuguccuauaagguugccagcgagggcuuucaauacucagaucgccgauggugcuucgacggggaaagaaacaaucagguccucgaggaaaacauggauguggagaucuggacaaaagagggagaaaggaagaaauugcggccccgcuggcuggacgcuagaacuuauagugacccucuagcccugagggaguuuaaggaguucgcugcaggucggcgaucuguguccggcgaucucauucuugagaucgggaaacugccgcagcauuuaacccagagagcccaaaaugcuuuggacaaccuggucaugcuccacaauagcgaacagggaggccgcgccuacaggcaugcaauggaggagcugccagauacaauugaaacccuuaugcugcucgcguugaucgccguucugacugguggggugacguuauuuuuccuaucaggccggggacugggcaagaccaguauagggcuccuuuguguaauggcuagcuccgugcuguuguggauggccucugucgagccccacuggaucgcagcuagcauuauccuggaauuuuuccucauggugcugcuuauuccugagcccgaccgucagagaacaccacaggauaaccaacucgccuauguugugaucggacuguuguuuaugauacugacugucgcagccaaugagauggguuuacuagaaaccacaaagaaagaccugggcauugggcacguagcuguggagaaccaucaccaugcggccaugcucgauguugaccuucacccugcauccgcuuggacccuguacgccguggccacuacaaucauuacgcccaugaugaggcauaccaucgaaaacacuacagcaaauauaucauugaccgcuaucgccaaccaggcggcuauucugaugggacucgauaagggcuggccaaucucuaaaauggacauuggugucccucugcuugccuuagggugcuacagucaggugaauccgcugacccucacagcagccgucuugaugcugguggcucacuaugcaaucauaggccccggacuacaagccaaggcgacucgcgaggcucagaaacggacggccgcaggcauuaugaagaacccaaccguugaugggaucguggccaucgaccuggauccuguaguguacgacgcuaaguucgaaaaacagcucggacagauuaugcuucugaucuuguguacaucgcaaauacugcucaugcgaacuaccugggcccugugcgagagcauuacauuagcaaccggcccccuuacuacgcugugggaggguuccccagggaaguuuuggaauacaaccaucgcugucucuauggccaacauuuucagaggaucauaucucgcgggcgccggucuagcauucagccugaugaaauccuugggcgggggaaggcgcggcacuggggcucagggagaaacccugggcgagaaguggaaacggcagcucaaucagcuuaguaagucugaauuuaacacauacaagagaagcgguaucauggagguugaccguucagaagccaaagaggggcugaagaggggagagacuaccaaacacgcagugucccggggcacagcuaaguugcgcugguucgucgaacgaaaucuggugaaaccugaggguaagguaauagaucucggcugugggagaggaggcuggaguuauuacugcgccggguuaaagaaagugacggaaguuaagggauauaccaaaggcggucccgggcaugaggaaccgaucccaauggccacuuacggauggaaccuggugaaacuucacagcggcaaagacgucuuuuucauuccucccgagaagugugauacacugcuaugcgacaucggcgagucuuccccaaaucccaccauugaagaggggaggacucuccgggugcugaaaauggucgaaccuugguugcgcggaaaccaauuuuguaucaagauucugaauccguacaugcccucagugguugagacacucgagcagaugcagagaaagcaugguggcaugcuuguaaggaacccacugagccgaaauucgacccacgaaauguauugggugucuugcgggacgggaaacaucgucagugcggugaauaugaccucccggauguuacugaaccguuucacaauggcucacagaaaaccuacuuacgagcgcgauguugacuugggcgcagguaccaggcauguggccgucgaacccgagauagcuaaccucgauauuaucgggcagcggaucgaaaauauuaagcacgagcauaaaagcacauggcacuaugacgaggauaacccuuacaagacuugggccuaucauggaucauacgaagugaaaccauccggcucugcaagcaguaugguaaauggcgugguuaagcugcuaaccaagcccugggacgucauaccuauggugacacaaaucgccaugaccgauacuacgccauuugggcagcagagaguguucaaagagaaggucgacacacgcacccccaaagcuaagaggggaacugcgcaaauuauggaaguuaccgccaaauggcuuugggguuuucugucccgaaacaagaagccgcggaucuguacaagagaggaguucacgaggaaagugcgcagcaaugcagcuauuggcgccguauuuguggacgagaaccaguggaacucugcaaaggaggccgucgaagaugagcguuucugggaccucgugcaccgggaaagagagcugcacaaacaggggaagugcgcuaccugcguuuauaacaugaugggaaaaagggaaaagaaguugggcgaguuugguaaagccaaggggucacgcgcgaucugguacauguggcugggagcacgauuccucgaguucgaagcccuuggcuuuaugaaugaggaucauugguucagucgggaaaacucccugagcggcguggagggggagggauuacacaaacuggguuacauauugagagacaucucuaagauuccuggcgggaauauguaugcugaugacacugccggaugggauacaaggaucaccgaagacgaucuccagaacgaggcacgcauuacugacaucauggaaccagagcaugcucugcuagccaaaucgauauuuaaacuuacauaccaaaauaaagucgugagaguacagcggcccgcuaagaacggcaccguuauggaugugauuucaaggcgugaccagcgagguagcgggcaggucggaacauauggccugaauacuuucaccaacauggaagcccaacucauccgccagauggaguccgagggcaucuuuaguccuucugaacuggagacgccaaacuuggcagaaagaguguuagauuggcuggagaaguacgggguggaacggcucaaaaggauggcgauuagcggagacgacugugucguuaagcccauagaugaccgcuucgccaccgcucuuacagcccugaaugauauggguaaagugagaaaggacaucccgcagugggagccuuccaaaggcuggaacgauuggcagcaaguacccuuuugcucacaccacuuccaucagcuaauuaugaaggacgggcgggagaucguggucccauguaggaaucaggaugaacuggugggacgagcacguguuagucagggcgcugguuggucucucagagagacugccugcuugggaaagagcuaugcacaaauguggcagcugauguacuuucaccgccgggaccuuaggcuggccgcgaacgcuauuuguuccgccgugccugucgauuggauccccaccucaagaacaacuuggagcauacaugcacaccaucaguggaugaccacggaagacaugcucucuguguggaaucgcguauggaucgaggaaaacccauggauggaggauaaaacacacauuuccaguuggggagacguucccuauuuaggcaagcgggaggaccaauggugcggcagccugaucggguugaccgccagggcuacuugggccacaaauauucagguggcaaucaaccagguccgaagacugauuggaaaugaaaacuaccucgauuacaugaccucgaugaaacgguucaagaaugagggugacccugaaggcgcucuuugguga

SEQ ID NO: 13581 - RNA, 9879 nt, Artificial Sequence
  derived and/or modified CDS sequence (opt3) from DENV-1__EU687251__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauuaucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaaaaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauucccacacgcaggucugcgaccaccgucucaugucagcugcaaucaaagauaguaaggccgugcaugcugacaugggguauuggauugaaucugagaaaaaugaaaccuggaagcuggcccgggcauccuucaucgagguuaagacuuguauauggccaaaaucccacacacuauggucaaacggagugcuggaaagcgagaugaucauucccaagaucuacggcgguccuauuucucaacauaauuaucgaccaggcuacuucacccagacugcggggccguggcaccucggaaaacuggagcuugauuuugacuugugcgaaggcacaaccguagucguggaugagcacugcgggaacagaggacccucccugaggacgacuaccgugacaggcaagaucauacaugaaugguguugccgcaguuguaccuuaccuccacuccgguucagaggugaggacgggugcugguacggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuucuuucuacugaucaugggacagcucaccuggaacgaucugauucgucuuugcauaauggugggcgccaaugcaucugacagaauggggaugggaacaacuuauuuggcucugauggccaccuucaagaugaggccuauguuugcaguuggcuuacucuuccgccggcugacgagcagagaggugcuucugcuaacaaucggucucucacuggucgccaguguggaauugccaaacucccuggaggaauuaggggauggacucgcuaugggcauuaugauccugaaacuucugaccgacuuucaaucucaccaguugugggcgacucuccugagccuaaccuucauuaagacaacuuuuucccugcauuacgccuggaaaaccauggcaaugguucuuucaaucgugagccucuucccccuguguuugaguacgacaucucagaagaccacuuggcugccggucuuacucggcucccuggggugcaagccucuuacaauguuucugauagcugagaauaaaaucuggggaaggcgaagcuggccauugaacgaagguauuauggccguaggcaucgugucgauucuccugucaucucuacugaagaacgauguuccccuugccgggccucucaucgcuggaggcaugcugauagcauguuaugugauuagugguuccagcgccgacuugucuuuagagaaagcggcugaggucagcugggaagaggaagccgagcacuccggggcaucacauaauauccugguggaaguacaggaugacggaaccaugaagaucaaagaugaggagcgcgacgauacucucacaauucugcuuaaggccacccuguuggcugugaguggcgucuacccccuaagcauaccagcaacgcuguucguuugguauuucuggcagaaaaagaagcagcggucuggcgugcucugggacacuccuucacccccagaaguggagagagccguccuggaugacgggaucuacaggauuaugcagcguggacuuuuaggucgcagccaggugggcguugggguauuucaagaaaacguguuccacaccauguggcacgucacacggggagcggugcugauguaucagggcaaaagacucgagccgaguugggcuagcguuaagaaagacuugaucuccuacggugggggauggaggcugcagggcucuuggaauaccggcgaggaagugcaggucauugccguggagccugggaagaaccccaaaaauguacaaacagcaccaggaacuuuuaagacccccgaaggugaggucggcgccaucgcucucgauuucaagccugggacgucgggaagcccaauagugaaccgagaaggcaaaaucguuggucuguacgggaauggaguggucacaacuucaggcaccuauguguccgccauugcacaggcuaaggccagucaggagggcccccuuccugagaucgaagacgagguuuuucggaaacgcaaccugacaauuauggauuugcauccggggucuggaaagaccagaagguaccuaccagcgaucgugcgggaagccauaaaacgaaagcugagaacucucauuuuagcacccacccgcgucguggcuagcgagauggccgaagcucugaaggguaugccuaucagguaucaaacaacggcaguaaaauccgagcacacuggcaaggagaucguggaccuuaugugccaugccaccuucacaaugcgucugcucucaccaguucggguccccaauuacaacaugauuaucauggaugaagcccacuuuaccgacccuucuagcauagcugcgagaggguauauuaguacuagggugggaaugggcgaggcagccgcuaucuucaugacagccaccccgcccgguuccguggaagcauuuccacagagcaaugccgucauucaggaugaggaacgcgacaucccugagcgaucuuggaacucaggguacgaguggauaacggauuuccccggaaaaacuguaugguuugugccauccauuaagaguggcaaugacaucgcuaacuguuugaggaaaaauggcaagcggguuauccagcugagcaggaagacauucgauaccgaauaucagaaaaccaagaacaacgacugggacuacguggucacuacagauauuucggagaugggggcgaauuuccgcgccgaccgugugaucgauccuagacggugccucaaacccguuauucugaaggacggaccagaaagggugauacuugcagguccgaugccugucaccguggcuucugccgcacagcgccgaggcagaaucgggcggaaccauaauaaagagggagaucaguacauuuauaugggccagccccuaaacaaugacgaggaucacgcccacuggacagaagcuaagaugcuguuggacaacaucaauacuccagaggguaucauucccgccuuauuugaaccugagagggaaaaguccgcggcaauagauggggaguaccgccugagaggcgaggccaggaaaacguucguagaacucaugcggcguggagaccugccaguguggcuuagcuauaagguugcuucagagggcuuucaauacagugaucgccgauggugcuucgacggggaaagaaacaaucagguccuggaggaaaacauggauguggagaucuggaccaaagagggagaaaggaagaaacuccggccccgcugguuggacgccagaacauauucugacccucuggcucuaagggaguuuaaggaguucgcagccggucggcgauccgugagcggcgaucugauucucgagaucgggaaacuuccgcagcaucugacucagagagcucaaaaugccuuagacaacuuggucaugcugcacaauucagaacagggaggccgcgcauacaggcaugcgauggaggagcucccagauaccauugaaacacugaugcuucuggcccucaucgcuguuuugaccgguggggugacucuguuuuucuuaaguggccggggacuaggcaagacgagcauagggcugcucuguguaauggccuccucugugcuucuguggauggcaagcgucgagccccacuggaucgcugccuccauuaucuuggaauuuuuccugauggugcuccugauuccugagcccgaccgucagagaaccccacaggauaaccaacuugcauauguugugaucggacuccuguuuaugauauugacagucgccgcuaaugagaugggucuguuagaaacuaccaagaaagaccuaggcauugggcacguagcgguggagaaccaucaccaugccgcaaugcuggauguugaccuccacccugcuucagccuggacacuuuacgccguggcaaccacuaucauuacacccaugaugaggcauacgaucgaaaacaccacugcuaauauaucucugacagccaucgcgaaccaggcugccauuuugaugggacuggauaagggcuggccaaucaguaaaauggacauuggugucccucuccuggcacuugggugcuacagccaggugaauccguuaacccugaccgccgcuguccucauguugguggcacacuaugccaucauaggccccggacugcaagcgaaggcuacacgcgaggcccagaaacggacugcagccggcauuaugaagaacccaacgguugaugggaucguggcuaucgaccuagauccuguaguguacgacgccaaguucgaaaaacagcugggacagauuaugcuccuuauccuguguaccagccaaauauugcugaugcgaacaacuugggcacucugcgaguccauuacccuggcuacaggccccuuaaccacucuuugggaggguucuccagggaaguuuuggaauacgacaaucgccgucucaauggcgaacauuuucagaggaagcuaucuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuacaagagaucagguaucauggagguugaccguuccgaagcaaaagaggggcuuaagaggggagagacaacuaaacacgcugugagucggggcaccgccaagcugcgcugguucgucgaacgaaauuuggugaaaccugaggguaagguaauagaucugggcugugggagaggaggcuggagcuauuacugcgccgggcucaagaaagugacagaaguuaagggauauacgaaaggcggucccgggcaugaggaaccgaucccaauggcgaccuacggauggaacuuagugaagcugcacucuggcaaagacgucuuuuucauuccucccgagaagugugauacucuucugugcgacaucggcgaguccucaccaaaucccacaauugaagaggggaggacccuacgggugcucaaaauggucgaaccuuggcugcgcggaaaccaauuuuguaucaagauuuugaauccguacaugcccagcgugguugagacucuggagcagaugcagagaaagcaugguggcaugcucguaaggaacccacuuucgcgaaauucuacacacgaaauguauugggugaguugcgggaccggaaacaucgucuccgcugugaauaugacgagccggaugcuguuaaaccguuucaccauggcacacagaaaaccuacauacgagcgcgauguugaccugggcgccgguacuaggcauguggcugucgaacccgagguggccaacuuggauauaauugggcagcggaucgaaaauaucaagcacgagcauaaaucaaccuggcacuaugacgaggauaacccuuacaagacaugggcauaucauggauccuacgaaguaaaaccaucuggcagcgccaguuccauggugaauggcguugucaagcuccugacuaagcccugggacgugauuccuauggugacccaaauagcuaugacagauaccacuccauuugggcagcagagagucuucaaagagaagguugacacgcgcacacccaaagcgaagaggggaaccgcccaaaucauggaagugacugcaaaauggcuaugggguuuucuuagccgaaacaagaagccgcggauuuguaccagagaggaguucacaaggaaaguacgcucuaaugcugccaucggcgcaguguuugucgacgagaaccaguggaacucagccaaggaggcuguggaagaugagcguuucugggaccugguucaccgggaaagagagcuccacaaacaggggaagugcgccacgugcguguauaacaugaugggaaaaagggaaaagaagcugggcgaguuugguaaagcgaaggggagucgcgcaauuugguacaugugguugggagcccgauuccuggaguucgaagcucucggcuuuaugaaugaggaucauugguucucccgggaaaacagccuuucuggcgucgagggggagggacugcacaaauuagguuacauccugagagacauaucgaagaucccuggcgggaauauguaugccgaugacaccgcaggaugggauacuaggauuacagaagacgauuugcagaacgaggcucgcaucaccgacauuauggaaccagagcaugcccuccuggcuaaaucaaucuuuaagcuaacuuaccaaaauaaagugguaagaguucagcggcccgccaagaacggcacagugauggaugucauaagcaggcgugaccagcgagguuccggacaggugggaaccuauggccuuaauacauucacuaacauggaagcacaacugauucgccagauggagagugagggcaucuuuucuccuagcgaacucgagaccccaaaccuggcggaaagaguguuggauugguuaaagaaauacggggucgagcggcugaagaggauggccaucuccggagacgacuguguugugaaacccauugaugaccgcuucgcuacggcccucaccgcacuuaaugauauggguaagguaagaaaagacauaccgcagugggaaccuucaaagggcuggaacgauuggcagcaagugcccuuuugcagucaccacuuccaucagcugaucaugaaggacgggcgggagauugucgugccauguaggaaucaggaugagcuaguuggacgagcucgugugucucagggcgccgguuggagccugagagaaacagcaugccucgggaaauccuaugcccaaauguggcaguugauguacuuucaccgccgggaccugaggcuugcggcuaacgccaucuguucagcagucccuguggauuggauucccacuagcagaaccacauggucuauccaugcccaccaucaguggaugacuaccgaggacaugcuguccguauggaaucgcguuuggauagaagagaacccauggauggaagauaagacgcacaucaguagcuggggagacgugcccuaucucggcaaacgggaggaccaauggugcggcucguuaauugggcugacagcuagggccaccugggcaacuaauauccaggucgcuauuaaccaggugcgaagauugaucggaaaugagaacuaccuggauuacaugacauccaugaagcgguucaaaaaugaaucugacccugagggugcccucugguga

SEQ ID NO: 13582 - RNA, 9879 nt, Artificial Sequence
  derived and/or modified CDS sequence (opt3) from DENV-1__FJ024427__SS-prME
ucggugaccaugcugcucaugcuuaugcccacagcacuggcuuuccacuugacuacgagaggcggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguuccguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacuggguacggagcgcucacacuugacuguagcccaaggacgggccuggauuucaacgaaauggucuugcuaaccaugaaggagaaaucuuggcuggugcauaagcagugguuucucgaccugccgcuucccuggacuuccggugccucaacaagccaagagaccuggaaucggcaggaucuguugguaacauucaaaacugcacacgcuaagaagcaggaaguugugguccucgggagucaagagggcgccaugcacaccgcucugacgggagccaccgaaauccagacaucuggcacuaccacaauuuuugcagggcauuuaaaaugccgucugaagauggacaaacuaacucucaagggaauguccuaugugauguguaccgguagcuucaaacuggagaaggaagucgccgagacgcagcacggcacagugcuuguucagauaaaguacgagggggcugaugcgccuugcaaaaucccauucucgacccaagacgaaaagggaauuacucagaacggccgcuugaucacagcaaaucccauagugaccgauaaagagaagccuguaaacauugaagccgagccacccuuuggugagucuuauaucgucaucggggcuggcgaaaaagcccugaagcucuccugguucaagaaaggaucaaguauuggcaagauguuugaggcaacugccagaggggcuaggcggauggccauccugggagacaccgcaugggauuucgguagcauuggcgggguguuuacauccguuggaaaacuugugcaucagauauucggcacggcguacgguguccuguuuucuggggugagcuggaccaugaagaucggcauuggaguauugcucacuuggcugggcuuaaauucacgaaguacaucccugagcaugaccuguaucgcuguggggcuaguuacacucuaccugggagucauggugcaggccgacucuggcugcgugaucaacuggaaaggucgcgaacuuaagugugggucaggaauuuucgucacuaaugagguucacaccuggacggaacaauauaaguuucaggcagauaguccgaaaagauugagcgccgcuauaggcaaggccugggaggagggugugugcggcaucagguccgcaacacggcuggaaaacauuauguggaaacagaucucuaacgagcucaaucauauucuguuagaaaacgacaugaaguucaccgugguagucggggacguggcuggaauccuggcccagggcaaaaagaugauacgcccucaacccauggaguacaaauauucguggaaaagcugggggaaggcgaagaucauuggagccgauguucagaauacuaccuuuaucauugacggcccaaacacaccugaaugucccgaugaccagagagcuuggaauaucugggagguggaggauuacgguuucgggauauuuacuaccaacauuuggcuuaaguugagggacuccuauacacaggucugcgaucaccgucucaugucagcagccaucaaagacaguaaggcugugcacgccgauaugggauacuggauugaaucugagaaaaaugaaacguggaagcuggcacgggcgagcuucaucgagguuaagaccuguauauggccaaaaucccauacucuauggucaaacggcgugcuggaaagcgagaugaucauucccaagaucuaugguggcccuauuucucaacacaauuaccgaccaggguacuucacacagaccgccggaccguggcaucucggcaaacuggagcuugacuuugauuugugcgaagggacuacaguagucguggacgagcacugcggaaacagaggccccucccugaggaccacgacugugaccgguaagaucauacacgaaugguguugccgcaguuguacauuaccuccacuccgguucagaggggaggauggaugcugguauggcauggagauuaggcccgucaaagaaaaggaggaaaaucugguuaagagcauggugucugcugguuccggcgagguagacucauuuagucuugggcuguuguguaucagcaucaugauugaagaggugaugcgcucgcgauggucccggaaaaugcucaugaccggaacucuggccgucuucuuucuacugaucaugggccagcucacauggaacgaccugauucgucuuugcauaauggugggggcaaaugcuucugauagaaugggaaugggcaccacauacuuggcccugauggcaacuuucaagaugaggccuauguuugccguugguuuacucuuccgccggcugaccagcagagaggugcuucugcuaacgaucgggcucucacuggucgcuaguguggaauugccaaacucccuggaggaauuaggagacggccucgcgaugggcauuaugauccugaaacuucugacagauuuucaaucucaucaguugugggccacccuccugagccuaacuuucauuaagaccacauuuucccugcacuaugcauggaaaacuauggcuaugguucuuucaaucgugagccucuucccccuguguuugaguaccacgucucagaagacaaccuggcugccggucuuacucgggucccugggaugcaagccucuuacuauguuucugauagccgagaauaaaaucugggguaggcgaagcuggccauugaacgaaggcauuauggccguagggaucgugucgauucuccugucaucucuacugaagaacgacguuccccuugcuggaccucucaucgcaggcgguaugcugauagccuguuacgugauuaguggguccagcgcggauuugucuuuagagaaagcugccgaggucagcugggaagaggaagcagagcauuccggagccucacacaauauccugguggaaguacaggacgauggcacaaugaagaucaaagacgaggagcgcgaugacacccucacuauucugcuuaaggcuacacuguuggcagugaguggcgucuauccccuaagcauaccagccacccuguucguuugguacuucuggcagaaaaagaagcagcggucuggggugcucugggauacgccuucacccccagaaguggagagagcgguccuggacgauggaaucuauaggauuaugcagcguggucuuuuaggccgcagccagguggggguuggaguauuucaagaaaacguguuccauacuauguggcacgucacccggggcgcugugcugauguaccaggguaaaagacucgagccgaguugggccagcguuaagaaagacuugaucuccuacgggggaggcuggaggcugcagggcucuuggaauacaggggaggaagugcaggucauugcaguggagccuggaaagaaccccaaaaauguacaaaccgccccagguacauuuaagacucccgaaggcgaggucggggcuaucgcccucgacuucaagccuggaaccucgggcagcccaauagugaaccgagaagguaaaaucguugggcuguauggaaauggcguggucacgacaucaggcacuuacguguccgcaauugcucaggccaaggcgagucaggaggggccccuuccugagaucgaagaugagguuuuucggaaacgcaaccugaccauuauggacuugcacccgggaucugguaagacaagaagguaucuaccagccaucgugcgggaagcaauaaaacgaaagcugagaacccucauuuuagcucccacucgcgucguggccagcgagauggcugaagcacugaagggcaugccuaucagguaccaaaccacagccguaaaauccgagcauacggggaaggagaucguggaucuuaugugccacgccacuuucaccaugcgucugcucucaccaguucggguccccaauuauaacaugauuaucauggacgaagcucauuuuacagauccuucuagcauagcggcaagaggauacauuaguaccagggugggcaugggugaggccgcugccaucuucaugacugcaacaccgcccggguccguggaagccuuuccacagagcaaugcugucauucaggacgaggaacgcgauaucccugagcgaucuuggaacucaggauaugaguggauaaccgacuuccccggcaaaacgguaugguuugugccauccauuaagaguggcaaugauaucgcgaacuguuugaggaaaaaugggaagcggguuauccagcugagcaggaagacuuucgacacagaauaccagaaaaccaagaacaacgauugggacuacguggucaccacugacauuucggagaugggagccaauuuccgcgcagaucgugugaucgacccuagacggugccucaaacccguuauucugaaggaugguccagaaagggugauacuugcuggcccgaugccugucacaguggccucugcagcccagcgccgagggagaaucggacggaaccacaauaaagagggcgaccaguauauuuacaugggucagccccuaaacaaugaugaggaccaugcucacuggaccgaagccaagaugcuguuggauaacaucaauacaccagaggggaucauucccgcguuauuugaaccugagagggaaaaguccgcagccauagacggcgaguaucgccugagaggagaggcuaggaaaacuuucguagaacucaugcggcguggcgaucugccaguguggcuuagcuacaagguugccucagagggguuucaauauagugaccgccgauggugcuucgauggagaaagaaacaaucagguccuggaggaaaacauggacguggagaucuggacgaaagagggugaaaggaagaaacuccggccccgcugguuggaugcuagaaccuacucugacccucuggcacuaagggaguuuaaggaguucgccgcuggccggcgauccgugagcggggaccugauucucgagaucggaaaacuuccgcagcaccugacacagagagcccaaaaugcauuagauaacuuggucaugcugcauaauucagaacagggcggucgcgcguauaggcacgccauggaggagcucccagacacuauugaaacccugaugcuucuggcucucaucgccguuuugacagggggcgugacccuguuuuucuuaaguggacggggccuagggaagacuagcauaggacugcucuguguaauggcauccucugugcuucuguggauggcuagcgucgagccccauuggaucgccgcauccauuaucuuggaauuuuuccugauggugcuccugauuccugagcccgaucgucagagaacgccacaggacaaccaacuugccuacguugugaucggucuccuguuuaugauauugaccgucgcugcgaaugagaugggccuguuagaaacaacuaagaaagaucuagggauuggacacguagccguggagaaccaccaucacgcagcuaugcuggacguugaucuccauccugccucagccuggacccuuuacgcaguggcuacaaccaucauuacucccaugaugaggcacacaaucgaaaacacgaccgccaauauaucucugacugcgaucgcuaaccaggccgcaauuuugaugggccuggacaaggguuggccaaucaguaaaauggauauuggggucccucuccuggcccuuggcugcuauagccaggugaauccguuaacacugaccgcugcaguccucauguugguggcccauuacgcgaucauaggacccggccugcaagcuaaggccacccgcgaggcacagaaacggacagccgcugggauuaugaagaacccaacuguugacggaaucguggccaucgaucuagacccuguaguguaugaugcaaaguucgaaaaacagcugggccagauuaugcuccuuauccuguguacgagccaaauauugcugaugcgaaccacaugggcucucugcgaguccauuacucuggccaccggucccuuaacaacccuuugggaggggucuccaggaaaguuuuggaauacuacgaucgcggucucaauggccaacauuuucagaggcagcuaccuggcaggagcuggccucgccuucucccuaaugaaaagucuaggggguggcaggcgcgggacaggagcacagggcgaaaccuugggugagaaguggaaacggcagcugaaucagcucucuaagagcgaauuuaacacuuauaagagaucagggaucauggagguugaccguuccgaagcuaaagagggacuuaagaggggcgagaccacaaaacacgccgugagucgggguacugccaagcugcgcugguucgucgaacgaaauuuggugaaaccugagggcaagguaauagaccugggguguggaagaggcggguggagcuacuauugcgcgggacucaagaaagugaccgaaguuaagggcuacacaaaaggugggcccggacacgaggaaccgaucccaauggcuacguacggcuggaacuuagugaagcugcauucuggcaaagaugucuuuuucauuccucccgagaagugugacacccuucugugcgauaucggggaguccucaccaaaucccacuauugaagagggaaggacacuacgggugcucaaaauggucgaaccuuggcugcgcgguaaccaauuuuguaucaagauuuugaauccguauaugcccagcgugguugagacccuggagcagaugcagagaaagcacggcgggaugcucguaaggaacccacuuucgcgaaauucuacucaugaaauguacugggugaguugcggaacaggcaacaucgucuccgcagugaauaugaccagccggaugcuguuaaaccguuucacgauggcccacagaaaaccuaccuaugagcgcgacguugaucugggugcugggacaaggcacguggccgucgaacccgagguggcaaacuuggacauaauuggacagcggaucgaaaauaucaagcaugagcacaaaucaacuuggcauuacgaugaggacaacccuuauaagaccugggccuaccacggcuccuaugaaguaaaaccaucuggcagcgcuaguuccauggugaaugggguugucaagcuccugacaaagcccugggaugugauuccuauggugacucaaauagcgaugaccgacacaaccccauuuggacagcagagagucuucaaagagaagguugauacucgcacgcccaaagccaagagggguacagcacaaaucauggaagugaccgcuaaauggcuauggggcuuucuuagccgaaacaagaagccgcggauuuguacuagagaggaguucaccaggaaaguacgcucuaaugccgcaaucggggccguguuugucgacgagaaccaguggaacucagcuaaggaggccguggaagacgagcguuucugggaucugguucaucgggaaagagagcuccacaaacagggaaagugcgcgacaugcguguacaacaugaugggcaaaagggaaaagaagcugggugaguuugggaaagcaaagggaagucgcgccauuugguacaugugguugggcgcucgauuccuggaguucgaagcccucggcuuuaugaaugaggaccacugguucaaccgggaaaauucccuuagcggggucgagggagagggucugcauaaauuaggcuauauccugagagauauaucuaagaucccugggggaaacauguacgcagacgauacggcuggcugggacaccaggauuacugaagaugacuugcagaaugaggcccgcaucacagauauuauggaaccagagcacgcucuccuggccagaucgaucuuuaaacuaaccuaucaaaacaaggugguacggguucagaggcccgccaaaaaugguacugugauggacgucauaucacgucgagaucagcgcgggagcggacaggugggcacauacggccuuaacaccuucacaaacauggaagcgcaacugauuagacagauggaguccgaggggaucuuuaguccuucugaacucgagacuccaaaucuggccgaacggguguuggacugguuagagaaguauggagucgaaaggcugaagcgcauggcuaucagcggugaugacuguguugugaaacccauugacgauagauucgccaccgcacucacggcucuuaacgacaugggcaagguacggaaagauauaccgcagugggagccuuccaagggguggaaugacuggcagcaagugcccuuuugcucacaucacuuccaccagcugaucaugaaagauggaagggagauugucgugccaugucgaaaccaggacgagcugguuggccgugccagagugagucagggugcaggguggucucugcgcgagaccgccugccucggaaagagcuacgcgcaaauguggcaguugauguauuuucaucggagggaucugagacuugcugccaaugcaaucuguuccgccgucccuguggacuggauucccacaucacgcacuaccuggagcauccacgcucaucaccaguggaugacaacugaagauaugcugucuguauggaaccggguuuggauagaggaaaauccauggauggaggacaagacccauaucuccaguuggggcgaugugcccuaccucggcaaaagggaggaccaauggugcgggagcuuaauuggacugacggcccgagcaacaugggcuaccaacauccaggucgccauuaaucaggugagacgguugaucgguaacgaaaauuaccuggacuauaugacuucgaugaagagguucaaaaacgaguccgauccugaaggcgcgcucugguga

SEQ ID NO: 13583 - RNA, 9879 nt, Artificial Sequence
  derived and/or modified CDS sequence (opt3) from DENV-1__FJ024428__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuaccgcucuguuucuggcacaugccauuggcacgucgaucacucagaagggcauuaucuucauacucuuaaugcuggugacaccaucaauggcuaugcgcugcgucgggaucggaagcagagauuuuguggagggucuuaguggcgccaccuggguagacguuguguuggagcacggguccugugucacuacaauggcgaaggauaaacccacccuggacauugaacuacucaagacggaggugaccaacccugcagugcugaggaaacuuugcaucgaagccaagauuucuaauacaacuaccgauagccgguguccaacacaaggagaggcuacucuggucgaagaacaagacgccaacuucguuugccgccgaaccuuuguggauagaggcugggguaauggguguggauuguucggcaaaggcucccucaucacaugcgcaaaguuuaagugcguaaccaaacuggaggggaagauagugcaguacgaaaacuuaaaauauucagucauugugacuguucacacgggagaccagcaucaaguggguaaugagaguacagaacacggcaccacugcuaccaucacaccccaggccccuaccacugagauucagcugacagacuacggggcgcucacgcuugauuguagcccaaggaccggacuggacuucaacgaaauggucuugcuaacuaugaaggagaaaucuuggcuggugcauaagcagugguuucucgaucugccgcuucccuggacauccggcgccucaaccagccaagagacauggaaucggcaggaccuguugguaacuuucaaaaccgcacacgcuaagaagcaggaaguugugguccucgguagucaagagggggccaugcacacggcucugaccggcgccacagaaauccagacuucuggaaccacaacuaucuuugcaggccauuuaaaaugccgucugaagauggauaaacuaacccucaaggggauguccuaugugauguguacggguagcuucaaacuggagaaggaacuugccgagacacagcacggaaccgucuuggugcagauuaaguacgagggcacugacgcuccuugcaaaauaccauucucgacacaagaugaaaaggggguuacccagaacggacgccugaucacugcgaaucccauugugaccgacaaagagaagccuguaaacaucgaagcagagccacccuuuggcgagucuuauauagucauuggugccggggaaaaagcucucaagcuguccugguucaagaaaggcucaaguaucggaaagauguuugaggccacagcaagaggcgccaggcggauggcuauccuuggggauacggccugggacuucggaagcauugguggcguguuuaccuccguugggaaacuggugcaucagaucuucggaacugcauacggcgucuuguuuucuggugugagcuggacaaugaagauugggauaggcguacuccugaccugguuaggacuaaauucacgaaguacaucccuaagcaugacuuguaucgcggugggccucguuacccuguaccuuggggucauggugcaggcugauucuggaugcgugauuaacuggaaaggccgcgaauugaagugugguucagggaucuucgucacgaaugagguucacacauggaccgaacaauauaaguuucaggccgacaguccgaaaagacugagcgcagccaucggaaaggcuugggaggagggcgugugcgguauuagguccgccacucggcucgaaaacauaauguggaaacagaucucuaacgagcugaaucauauuuuacuggaaaacgacaugaaguucaccgugguagucggcgauguggcagggauccuugcucagggcaagaagaugauucgcccucaacccauggagcacaaauacucguggaaaagcuggggcaaggccaagaucauaggggcggacguucagaauacaacuuuuaucauugauggaccaaacaccccugaaugucccgacgaucagagagccuggaauaucugggagguggaggacuauggcuucgguauuuuuacaacgaacaucugguugaagcucagggauuccuacacccaggucugcgaccaccgucugaugucagcugcaauaaaagauaguaaggccgugcaugcugacaugggguauuggauugaaucugagaaaaaugaaacuuggaagcuagcccgggccuccuucaucgagguuaagacauguauuuggccaaaaucccacacccuguggucaaacggagugcucgaaagcgagaugaucauacccaagaucuacggcgguccuauuucucaacauaauuaucgaccaggcuacuucacucagacagcggggccguggcaccugggaaaacuugaguuggauuuugaccugugcgaaggcaccacgguagucguggaugagcacugcgggaacagaggacccuccuuaaggacuaccacagugaccggcaagaucauucaugaaugguguugccgcaguuguacucucccuccacugcgguucagaggugaggacgggugcugguacggaauggagaucaggcccgucaaagaaaaggaggaaaaucuuguuaagagcauggugucugccggcuccggugagguagacucauuuagucugggcuugcucuguauaagcauuaugaucgaagaggugaugcgcucgcgauggucccggaaaaugcugaugacagggacccuagcugucuucuuucugcucaucgugggacagcugacauggaacgaucuuauucguuugugcaucaugguuggcgccaaugcaucugacagaauggggaugggaacuaccuaucuggcuuuaauggccacguucaagaugaggccuauguuugcagugggccuccuguuccgccggcuuacaagcagagagguccugcuacucaccauuggucugucauugguggccaguguugaacugccaaacuccuuagaggaacucggggauggacuggcuaugggcauaaugauccuuaaacuguugacugacuuucaaucucaccagcucugggcgacccugcuaagccugacauucauuaagacuaccuuuucccuucauuacgccuggaaaacgauggcaauggugcucucagucguaagccuguuccccuugugucugaguacaaccucucagaagacuacaugguuaccggugcuccugggcucccuugggugcaagccucugaccauguuuuugaucgcugagaauaaaauuuggggaaggcgaagcuggccacucaacgaagguaucauggccguuggcauagugucgauccugcuaucaucucugcuuaagaacgaugucccccucgccgggccucugauugcuggaggcauguugaucgcauguuaugugauuagugguuccagcgccgacuuaucucuggagaaagcggcugagguaagcugggaagaggaagccgagcacuccggggcaucacauaauauccucguggaaguccaggaugacggaacuaugaagauaaaagaugaggagcgcgacgauacacugaccauucuucugaaggccacguugcuagcuguuaguggcguguacccccugagcaucccagcaacucucuucgugugguauuucuggcagaagaagaagcagcggucuggcguccugugggacaccccuucacccccagaaguggagagagccguucuugaugacgggaucuacaggauuaugcagcguggauuacugggucgcagccagguaggcgugggggucuuucaagaaaacguguuccacacaauguggcacguuacccggggagcggugcucauguaucagggcaaaagauuggagccgaguugggcuagcgucaagaaagaccugauauccuacggugggggauggaggcuccagggcucuuggaauacaggcgaggaagugcagguaaucgccgucgagccugggaagaaccccaaaaaugugcaaacugcaccaggaaccuuuaagacgcccgaaggugagguuggcgccauugcucuggauuucaagccugggacaucgggaagcccaaucgugaaccgagaaggcaaaauugucggucuuuacgggaauggagugguuacuaccucaggcacauauguguccgccaucgcacaggcuaaggccagucaggagggcccccugccugagauagaagacgaggucuuucggaaacgcaacuugaccaucauggaucuacauccggggucuggaaagacuagaagguaccugccagcgauugugcgggaagccaucaaacgaaagcucagaaccuuaauucuggcacccacacgcguaguggcuagcgagauggccgaagcucuuaaggguaugccuaucagguaucaaacgacugcaguuaaauccgagcacaccggcaaggagauagucgaccugaugugccaugccacauucaccaugcgucucuugucaccagugcgggugcccaauuacaacaugauuaucauggaugaagcccacuuuacugacccuucuagcaucgcugcgagaggguauauuaguacaagggucggaaugggcgaggcagccgcuaucuucaugaccgccacgccgcccgguuccguagaagcauuuccacagagcaaugccgugauacaggaugaggaacgcgacauuccugagcgaucuuggaacucaggguacgaguggaucacugauuuccccggaaaaacaguuugguuugugccauccauuaagaguggcaaugacaucgcuaacugucugaggaaaaauggcaagcgggucauacagcucagcaggaagaccuucgauaccgaauaucagaaaacuaagaacaacgacugggacuacgugguuacaaccgauauuucggagaugggggcgaauuuccgcgccgaccgugugaucgauccuagacggugccugaaacccgucauccuuaaggacggaccagaaagggugauucuagcagguccgaugccuguaacaguggcuucugccgcacagcgccgaggcagaaucgggcggaaccauaauaaagagggagaucaguacauuuauaugggccagccccugaacaaugacgaggaucacgcccacuggacugaagcuaagauguuguuagacaacauaaauacgccagaggguaucauucccgcccuguuugaaccugagagggaaaaguccgcggcaaucgauggggaguaccgccucagaggcgaggccaggaaaaccuucguugaacugaugcggcguggagaccuuccagucuggcugagcuauaagguggcuucagagggcuuucaauacagugaucgccgauggugcuucgacggggaaagaaacaaucaggugcucgaggaaaacauggaugucgagaucuggacaaaagagggagaaaggaagaaauugcggccccgcuggcuggacgccagaacuuauucugacccucuagcucugagggaguuuaaggaguucgcagccggucggcgauccguuagcggcgaucucauucuugagauagggaaacugccgcagcauuuaacccagagagcucaaaaugccuuggacaaccuggugaugcuccacaauucagaacagggaggccgcgcauacaggcaugcgauggaggagcugccagauacaaucgaaacccuuaugcugcucgccuugauugcuguacugacugguggggugacguuauuuuuccuaaguggccggggacugggcaagaccagcaucgggcuccuuugugucauggccuccucugugcuguuguggauggcaagcguugagccccacuggauugcugccuccaucauacuggaauuuuuccucauggugcugcuuaucccugagcccgaccgucagagaacaccacaggauaaccaacucgcauaugucguaauuggacuguuguuuaugauccugacuguggccgcuaaugagauggguuuacuagaaaccacaaagaaagaccugggcauugggcacguugcgguggagaaccaucaccaugccgcaaugcucgaugucgaccuucacccugcuucagccuggacccuguacgccguggcaacuacaaucauaacgcccaugaugaggcauaccauugaaaacacuacagcuaauaucucuuugaccgccauugcgaaccaggcugccauccugaugggacucgauaagggcuggccaauaaguaaaauggacaucggugucccucugcuugcauuagggugcuacucgcaagugaauccgcugacccucacagccgcuguuuugaugcugguggcacacuaugccauuaucggccccggacuacaagcgaaggcuacucgcgaggcccagaaacggacggcagccggcauuaugaagaacccaaccguagaugggaucguggcuauagaccuggauccugucguuuacgacgccaaguucgaaaaacagcucggacagauuaugcuucugaucuuguguacaagccaaauccugcucaugcgaacuaccugggcacugugcgaguccauuacauuagcuaccggcccccuuacuacgcugugggaggguucuccagggaaguuuuggaauacaaccaucgccgugucaauggcgaacauauucagaggaagcuaucucgccggcgcaggucuagcuuucucccugaugaaaaguuugggcgggggaaggcgcggcacuggggcccagggagaaacccugggcgagaaguggaaacggcagcucaaucagcuuucuaagagcgaauuuaacacauacaagagaucagguauuauggaggucgaccguuccgaagcaaaagaggggcugaagaggggagagacuaccaaacacgcugugagucggggcacagccaaguugcgcugguucguagaacgaaaucuggugaaaccugaggguaagguuaucgaucucggcugugggagaggaggcuggagcuauuacugcgccggguuaaagaaagugacggaagucaagggauauaccaaaggcggucccgggcaugaggaaccgauuccaauggcgacuuacggauggaaccuggugaaacuucacucuggcaaagacgucuuuuucaucccucccgagaagugugauacacugcuaugcgacauaggcgaguccucaccaaaucccaccaucgaagaggggaggacucuccgggugcugaaaaugguugaaccuugguugcgcggaaaccaauuuuguauuaagauccugaauccguacaugcccagcguaguggagacacucgagcagaugcagagaaagcaugguggcaugcuugucaggaacccacugucgcgaaauucuacccacgaaauguauugggugaguugcgggacgggaaacauuguuuccgcugugaauaugaccagccggauguuacugaaccguuucacaauggcacacagaaaaccuacuuacgagcgcgaugucgacuugggcgccgguaccaggcauguggcuguagaacccgagguggccaaccucgauaucauugggcagcggaucgaaaauauaaagcacgagcauaaaucaacauggcacuaugacgaggauaacccuuacaagacuugggcauaucauggauccuacgaaguuaaaccaucuggcagcgccaguuccauggucaauggcguggugaagcugcuaaccaagcccugggacgucauuccuaugguuacacaaaucgcuaugaccgauacuacgccauuugggcagcagagaguguucaaagagaagguagacacacgcacccccaaagcgaagaggggaacugcccaaaucauggaagugaccgcaaaauggcuuugggguuuucugagccgaaacaagaagccgcggauuuguacaagagaggaguucacgaggaaaguccgcucuaaugcugccauaggcgcaguguuuguugacgagaaccaguggaacucagccaaggaggcuguggaagaugagcguuucugggaccucguccaccgggaaagagagcugcacaaacaggggaagugcgcaaccugcguguauaacaugaugggaaaaagggaaaagaaguugggcgaguuugguaaagcgaaggggagucgcgcaaucugguacauguggcugggagcccgauuccucgaguucgaagcucuuggcuuuaugaaugaggaucauugguucucccgggaaaacagccugucuggcguagagggggagggauuacacaaacuggguuacauuuugagagacaucucgaagauuccuggcgggaauauguaugccgaugacacugcaggaugggauacaaggaucaccgaagacgaucuccagaacgaggcucgcauaacugacaucauggaaccagagcaugcccugcuagcuaaaucaauuuuuaaacuuacauaccaaaauaaaguugugagaguccagcggcccgccaagaacggcaccgugauggaugugaucagcaggcgugaccagcgagguuccgggcaggucggaacauauggccugaauacuuucaccaacauggaagcacaacucauucgccagauggagagugagggcaucuuuucuccuagcgaacuggagacgccaaacuuggcggaaagaguuuuagauuggcuggagaaguacgggguggaacggcucaaaaggauggccauauccggagacgacuguguagugaagcccauugaugaccgcuucgcuaccgcccuuacagcacugaaugauauggguaaagucagaaaggacaucccgcagugggagccuucaaaaggcuggaacgauuggcagcaagugcccuuuugcagucaccacuuccaucagcuaaucaugaaggacgggcgggagauuguugugccauguaggaaucaggaugaacuggucggacgagcucgugugucucagggcgccgguuggagccucagagagacugcaugcuuggggaaguccuaugcccaaauguggcagcugauguacuuucaccgccgggaccuuaggcuggcggcuaacgccauauguucagcaguaccuguugauuggauccccaccagcagaacaacuuggucuauucaugcccaccaucaguggaugaccacggaagacaugcucuccguguggaaucgcgucuggaucgaggaaaacccauggauggaggauaaaacacacauuaguagcuggggagacgugcccuauuuaggcaagcgggaggaccaauggugcggcucgcugaucggguugaccgcuagggccacuugggcaacaaauauacagguugcuaucaaccaggugcgaagacugauuggaaaugaaaacuaccucgauuacaugaccuccaugaaacgguucaagaaugagucugacccugaaggugcccuuugguga

SEQ ID NO: 13584 - RNA, 9879 nt, Artificial Sequence
  derived and/or modified CDS sequence (opt3) from DENV-1__FJ024429__SS-prME
agcgugaccaugcugcucaugcuuaugcccacagcccuggcuuuccacuugacuacgaggggaggggagccucauaugaucgucuccaagcaggaaaggggaaaaucuuuacuguuuaagaccucagccgguguuaauaugugcacacuaauugccauggaccucggcgagcugugugaagauacuaugaccuacaaaugcccacggauuacagagaccgaaccggacgauguggacuguuggugcaaugcgacugauacauggguaaccuaugggacguguagucagacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagccgggauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggaucggggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaaggggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacucaugacauggcugggauuaaauucacgaaguaccucccugagcaugacauguauugcggugggccuaguuacucucuaccugggggucauggugcaggcugauucuggaugcgugaucaacuggaaaggccgcgaacuuaagugugguucagggaucuucgucaccaaugagguucacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacugugguagucggcgauguggcagggauucuggcucagggcaaaaagaugauccgcccucaacccauggagcacaaauacucguggaaaagcuggggcaaggccaagauaaucggggcggacguucagaauaccacauuuauuaucgauggaccaaacacuccugaaugucccgacgaucagagagccuggaauauuugggagguggaggacuauggcuucgguaucuuuaccacaaacauauggcuuaaguugagggauuccuacacgcaggucugcgaccaccgucucaugucagcugcaauuaaagauaguaaggccgugcaugcugacaugggguauuggaucgaaucugagaaaaaugaaaccuggaagcuggcccgggcauccuucauugagguuaagacuuguaucuggccaaaaucccacacacuauggucaaacggagugcuggaaagcgagaugauaauccccaagauuuacggcgguccuaucucucaacauaauuaucgaccaggcuacuucacccagauugcggggccguggcaccucggaaaacuggagcuugauuuugacuugugcgaaggcacuacaguagucguggaugagcacugcgggaacagaggacccucccugaggaccacgacugugaccggcaagaucauacaugaaugguguugccgcaguuguacauuaccuccacuccgguucagaggugaggacgggugcugguacggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugaccgggacucuggcugucuucuuucuacugaucgugggacagcucacauggaacgaucugauucgucuuugcauaaugguuggcgccaaugcaucugacagaauggggaugggaaccacauauuuggcucugauggccacuuucaagaugaggccuauguuugcagugggcuuacucuuccgccggcugaccagcagagagguccuucugcuaacgaucggucucucacugguggccaguguugaauugccaaacucccuggaggaauuaggggauggacucgcuaugggcauuaugauccugaaacuucugacagacuuucaaucucaccaguugugggcgacccuccugagccuaacuuucauuaagaccacauuuucccugcauuacgccuggaaaacuauggcaauggugcuuucagucguaagccucuucccccuguguuugaguaccacgucucagaagacaaccuggcugccgguguuacucggcucccuggggugcaagccucuuacuauguuucugaucgcugagaauaaaauauggggaaggcgaagcuggccauugaacgaagguaucauggccguuggcauugugucgauccuccugucaucucuacugaagaacgaugucccccuugccgggccucucauugcuggaggcaugcugaucgcauguuaugugauaagugguuccagcgccgacuugucuuuagagaaagcggcugagguaagcugggaagaggaagccgagcacuccggggcaucacauaauauucugguggaaguccaggaugacggaacaaugaagaucaaagaugaggagcgcgacgauacccucacuauccugcuuaaggccacacuguuggcuguuaguggcguguacccccuaagcauuccagcaacccuguucgugugguauuucuggcagaaaaagaagcagcggucuggcguccucugggacacgccuucacccccagaaguggagagagccguucuggaugacgggauauacaggaucaugcagcguggacuuuuaggucgcagccagguaggcgugggggucuuucaagaaaacguguuccacacuauguggcacguuacccggggagcggugcugauguaucagggcaaaagacucgagccgaguugggcuagcgucaagaaagacuugauuuccuacggugggggauggaggcugcagggcucuuggaauacaggcgaggaagugcagguaaucgccgucgagccugggaagaaccccaaaaaugugcaaaccgcaccaggaacauuuaagacucccgaaggugagguuggcgccauugcucucgauuucaagccugggaccucgggaagcccaaucgugaaccgagaacggaaaauagucggccuguacgguaauggggugguuacgacaucaggaacuuauguguccgccaucgcacaggcuaaggccagucaggagggcccccuuccugagauugaagacgaggucuuucgcaaaagaaaccugaccaucauggauuugcauccgggcucugggaagacaaggcgguaccuaccagcgauugugcgagaagccaucaaaagaaagcugcgcacccucauauuagcacccacuaggguaguggcuagcgagauggccgaagcucugaagggaaugccuauucguuaucaaaccacagcaguuaaauccgagcacacggguaaggagaucgucgaccuuaugugccaugccacuuucaccaugcggcugcucucaccagugagagugcccaauuacaacaugaucauuauggaugaagcccacuuuacagacccuucuagcaucgcugcgaggggcuauauaaguacccgcgucgggaugggagaggcagccgcuauuuucaugacugccacaccgcccggcuccguagaagcauuuccacagagcaaugccgugauccaggaugaggaacgagacauuccugagagaucuuggaacucagguuacgaguggaucaccgauuuccccgggaaaacgguuugguuugugccauccauaaagaguggaaaugacauugcuaacuguuugcggaaaaauggcaagagggucauccagcugagccgcaagacuuucgauacagaauaucagaaaaccaagaacaacgacugggacuacgugguuaccacugauaucucggagaugggcgcgaauuuccgugccgacagagugauugauccucggaggugccucaaacccgucauccugaaggacgggccagaacgcgugauucuugcaggaccgaugccuguaacaguggcuucugccgcacagcgaagaggucggauaggcaggaaccauaauaaagagggggaucaguacaucuauaugggacagccccuaaacaaugacgaggaucacgcccacuggaccgaagcuaagaugcuguuggacaacauuaauacaccagagggcaucauccccgccuuauuugaaccugagcgcgaaaaguccgcggcaauugauggugaguacagacugagaggggaagcccggaaaacuuucguugaacucaugcgucgcggcgaccugccagucuggcuuagcuauaagguggcuucagagggauuucaauacagugaucgaagauggugcuucgacggcgaaaggaacaaucaggugcuggaggaaaacauggaugucgagauauggacgaaagagggggaacggaagaaacuccgccccagaugguuggacgccaggaccuauucugacccucuggcucuacgggaguuuaaggaguucgcagccggacgaagauccguuagcggugaucugauccucgagauuggcaaacuuccgcagcaucugacacagcgcgcucaaaaugccuuagacaacuuggugaugcugcacaauucagaacaagggggaagggcauaccggcaugcgauggaggagcucccagauacuaucgaaacccugaugcuucuggcccucauugcuguauugacaggcggugugacccuguuuuucuuaagugggcguggccuaggaaagacuagcaucggccugcucugugucauggccuccucugugcuucuguggauggcaagcguugagccccacuggauagcugccuccaucauuuuggaauuuuuccugauggugcuccugaucccugagcccgacagacagaggacgccacaggauaaccaacuugcauaugucguaauugggcuccuguuuaugaucuugaccguggccgcuaaugagaugggacuguuagaaacaacuaagaaagaccuagguauaggccacguugcgguggagaaccaucaccaugccgcaaugcuggaugucgaccuccacccugcuucagccuggacccuuuacgccguggcaacaaccauuaucacucccaugaugcgccauacaauugaaaacacgaccgcuaauaucucucugacugccauagcgaaccaggcugccaucuugauggggcuggauaagggauggccaauuaguaaaauggacaucggcgucccucuccuggcacuugguugcuacagccaggugaauccguuaacacugaccgccgcuguucucauguugguggcacacuaugccauuaucgggcccggccugcaagcgaaggcuacccgggaggcccagaaacgaacagcagccggaauaaugaagaacccaacuguagauggcauuguggcuaucgaccuagauccugucguuuacgacgccaaguucgaaaaacagcuggggcagaucaugcuccuuauucuguguacgagccaaaucuugcugaugagaaccacaugggcacucugcgaguccauaacucuggcuaccggacccuuaacaacccuuugggagggcucuccagguaaguuuuggaauacuacgauugccgugucaauggcgaacaucuucagggggagcuaucuggccggagcaggccucgcuuucucccuaaugaaaagucuggguggcgggcgccggggaacaggcgcccagggggaaaccuugggagagaaguggaaaagacagcugaaucagcucucuaagagcgaauuuaacacuuacaagcguucaggcauuauggaggucgacagguccgaagcaaaagagggucuuaagagaggggaaaccacaaaacacgcugugagucgcggaacugccaagcugcgaugguucguagaaagaaauuuggugaaaccugagggcaagguuaucgaucuggguuguggcagagggggauggagcuauuacugcgccggccucaagaaagugaccgaagucaagggguauacaaaaggaggccccggucaugaggaaccgauaccaauggcgacguacggguggaacuuagugaagcugcacucuggaaaagacgucuuuuucaucccucccgagaagugugauacccuucugugcgacauuggcgaguccucaccaaaucccacuaucgaagagggccggacacuacgcgugcucaaaaugguugaaccuuggcugagagggaaccaauuuuguauuaagaucuugaauccguacaugcccagcguaguggagacccuggagcagaugcagaggaagcauggagguaugcucguccgaaacccacuuucgagaaauucuacucacgaaauguauugggugaguugcggcacagggaacauuguuuccgcugugaauaugaccagccguaugcuguuaaacagauucacgauggcacaccgcaaaccuaccuacgagagggaugucgaccugggagccggcacacggcauguggcuguagaacccgagguggccaacuuggauaucauaggucagagaauugaaaauaucaagcacgagcauaaaucaacuuggcacuaugacgaggauaacccuuacaagaccugggcauaucauggguccuacgaaguuaaaccaucuggaagcgccaguuccauggucaauggcguggugaagcuccugacaaagcccugggacgucaucccuaugguuacucaaauugcuaugaccgauacaaccccauuuggccagcagcgcguguucaaagagaagguagacacuaggacgcccaaagcgaagcgagggacagcccaaauaauggaagugaccgcaaaauggcuauggggauuucuuagccggaacaagaagccgagaaucuguacuagggaggaguucacccgcaaaguccguucuaaugcugccauuggugcaguguuuguugacgagaaccaguggaacucagccaaggaggcuguggaagaugagcgguucugggaccugguccacagagaaagggagcuccacaaacagggcaagugcgccacaugcguguauaacaugauggggaaacgcgaaaagaagcugggagaguuuggcaaagcgaaggguagucgagcaaucugguacaugugguugggggcccgguuccuggaguucgaagcucucggauuuaugaaugaggaucauugguucuccagagaaaacagccuuucuggcguagagggcgaggggcugcacaaauuaggauacauucugagggacaucucgaagauaccugguggcaauauguaugccgaugacacggcagggugggauacccgcaucacugaagacgauuugcagaacgaggcuagaauuacagacaucauggaaccagagcaugcccuccuggcuaaaucaauuuuuaagcuaaccuaccaaaauaaaguugugcggguccagaggcccgccaagaacggaacugugauggaugugaucagccgucgagaccagcgcggcuccggucaggucgggacauauggacuuaauaccuucacaaacauggaagcacaacugauaagacagauggagagugagggcauauuuucuccuagcgaacucgagacuccaaaccuggcggaacggguuuuggauugguuagagaaguacggcguggaaaggcugaaacgcauggccaucuccggggacgacuguguagugaagcccaucgaugacagauucgcuaccgcccucacggcacuuaaugauaugggaaaaguccggaaggacauuccgcagugggagccuucaaaagguuggaacgauuggcagcaagugcccuuuugcagucaccacuuccaucagcugauaaugaaggacggcagggagaucguugugccaugucgaaaucaggaugagcuagucgggcgugcuagagugucucagggagccggcuggagccugcgcgagaccgcaugccucgguaaguccuaugcccaaauguggcaguugauguacuuucaccggagggaccugagacuugcggcuaacgccauuuguucagcaguaccuguugauuggauccccacaagccgcacuaccuggucuauucaugcccaccaucaguggaugacaacugaagacaugcuguccguguggaaucgggucuggaucgaggaaaacccauggauggaggauaaaacccacauaaguagcuggggagacgugcccuaucucggaaagagggaggaccaauggugcggcucguuaaucggccugacggcucgagccacaugggcaaccaauauucagguugcuaucaaccaggugagacgguugauugggaaugaaaacuaccuggauuacaugacuuccaugaaaagguucaagaaugagucugacccugaaggagcccucugguga

SEQ ID NO: 13585 - RNA, 9879 nt, Artificial Sequence
  derived and/or modified CDS sequence (opt3) from DENV-1__FJ024430__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaaugcuguugaucgcugagaauaaaauauggggaaggcgaagcuggccacucaacgaagguaucauggccgugggcauuguuucgauccugcuaucaucucugcuuaagaacgaugugccccucgccgggccucugauugcuggaggcauguugaucgcauguuacgucauaagugguuccagcgccgcguuaucucuggagaaagcugccgaggugagcugggaagaggaagcagagcauuccggggccucacacaauauucucguagaagugcaggacgauggaaccaugaagaucaaagacgaggagcgcgaugacacucugacaauccuucugaaggcuaccuugcuagcagucaguggcguuuauccccugagcauuccagccacgcucuuugugugguacuucuggcagaaaaagaagcagcggucuggcgugcugugggauacuccuucacccccagaagucgggagagcggugcuugacgauggaauauauaggaucaugcagcgugguuuacugggccgcagccagguugggguaggaguguuccaagagaacgucuuucauaccauguggcacgugacacggggcgcuguucucauguaccaggguaaaagauuggaaccgaguugggccagcgugaagaaagaccugauuuccuacgggggaggcuggaggcuccagggcucuuggaauaccggggaggagguccaggugaucgcaguagaaccuggaaagaaccccaaaaauguccaaacagccccagguacuuucaagacccccgagggcgaagugggggcuauugcccuggacuuuaagccuggaacgucgggcagcccaaucguuaaccgagaggguaaaauaguggggcuuuauggaaauggcgucgugacaacuucaggcaccuacguuuccgcaaucgcucaggccaaggcgagucaggaagggccccugccugagauugaggaugaaguguuccggaaacgcaacuugacaaucauggaccuacacccgggaucugguaagaccagaagguaucugccagccauuguccgggaggcaaucaaacgaaagcucagaacuuuaauacuggcucccacccgcgugguagccagcgaaauggcugaggcacuuaagggcaugccuauuagguaccaaacaacggccgugaaauccgaacauacugggaaggagaucguugaucugaugugccacgccaccuuuacaaugcgucucuugucaccaguccgggugcccaauuauaacaugaucauuauggacgaggcucauuucaccgauccuucuagcaucgcggcaagaggauacauaaguacuagggugggcaugggugaagccgcugccauuuuuaugacagcaaccccgcccggguccgucgaggccuucccacagagcaaugcuguaauccaggacgaagaacgcgauauuccugaacgaucuuggaacucaggauaugaguggaucacggacuuucccggcaaaacugugugguucguuccauccauaaagaguggcaaugauauugcgaacugucugaggaaaaaugggaagcgggugauccagcucagcaggaagacauuugacaccgaguaccagaaaaccaagaacaacgauugggacuacgucgugacuacagacaucucggaaaugggagccaauuuccgcgcagaucguguuauugacccuagacggugccugaaacccgugauccuuaaggaugguccagagagggucauucuagcuggcccgaugccugugaccguagccucugcagcccagcgccgagggagaauaggacggaaccacaauaaagaaggcgaccaguauaucuacaugggucagccccugaacaaugaugaggaccaugcucacuggacagaggccaagauguuguuagauaacauuaauacuccagaagggaucauccccgcgcuguucgagccugaaagggagaaguccgcagccauugacggcgaauaucgccucagaggagaggcuaggaaaacguuuguggagcugaugcggcguggcgaucuuccaguuuggcugagcuacaaggucgccucagaaggguuccaauauagugaccgccgauggugcuuugauggagagagaaacaaucaggugcucgaagagaacauggacguggaaauauggaccaaagagggugagaggaagaaauugcggccccgcuggcuggaugcuagaacauacucugacccucuagcacugagggaguucaaggaguuugccgcuggccggcgauccgucagcggggaccucauccuugaaauuggaaaacugccgcagcacuuaacucagagagcccaaaaugcauuggauaaccugguuaugcuccauaauucagagcagggcggucgcgcguauaggcacgccauggaggaacugccagacaccaucgagacacuuaugcugcucgcuuugauugccgugcugaccgggggcguaacuuuauucuuucuaaguggacggggccuggggaagacgagcaucggacuccuuugugugauggcauccucuguccuguuguggauggcuagcguggaaccccauuggauagccgcauccaucauucuggaguucuuucucaugguucugcuuaucccugaacccgaucgucagagaaccccacaggacaaccaacucgccuacguggucauuggucuguuguucaugauccugacaguagcugcgaaugagaugggcuuacuagagacuaccaagaaagaucuggggauaggacacguggccguugaaaaccaccaucacgcagcuaugcucgacguggaucuucauccugccucagccuggacacuguacgcagucgcuaccacuauuaucacacccaugaugaggcacacgauugagaacaccacugccaauaucucuuugacagcgauagcuaaccaggccgcaauccugaugggccucgacaaggguuggccaauuaguaaaauggauaucggggugccucugcuugccuuaggcugcuauucgcaggucaauccgcugacccucaccgcugcaguguugaugcugguugcccauuacgcgauuaucggacccggccuacaagcuaaggccacacgcgaagcacagaaacggacugccgcugggauaaugaagaacccaacgguggacggaauuguagccaucgaucuggacccuguggucuaugaugcaaaguuugagaaacagcucggccagaucaugcuucugauuuuguguaccagccaaauccugcucaugcgaacaacuugggcucugugcgaauccauaaccuuagccacagguccccuuaccacucugugggaggggucuccaggaaaguucuggaauacgacaauugcgguuucaauggccaacaucuuuagaggcagcuaccucgcaggagcuggccuagccuucucccugaugaaaagucuagggggaggcaggcgcgggaccggagcacagggcgagacucugggugaaaaguggaaacggcagcucaaucagcuuucuaagagcgaguucaacaccuauaagagaucagggauuauggaaguggaccguuccgaggcuaaagaaggacugaagaggggcgagacaacuaaacacgccgucagucgggguaccgccaaguugcgcugguuuguggagcgaaaucugguaaaaccugaaggcaaggugaucgaccucggguguggaagaggcggguggagcuacuauugcgcgggauuaaagaaaguuacagaggugaagggcuacacgaaaggugggcccggacacgaggaaccgauaccaauggcuaccuacggcuggaaccuggucaaacuucauucuggcaaagauguguucuuuaucccucccgaaaagugugacacucugcuaugcgauauuggggaguccucaccaaaucccacaaucgaggaaggaaggacccuccggguccugaaaaugguggagccuugguugcgcgguaaccaauucuguauuaagauccugaauccguauaugcccagcguuguagaaacucucgagcagaugcagagaaagcacggcgggaugcuugugaggaacccacugucgcgaaauucuacacaugagauguacugggucaguugcggaaccggcaacauuguguccgcaguuaauaugacgagccggauguuacugaaccguuuuaccauggcccacagaaaaccuacauaugaacgcgacguggauuugggugcugggacuaggcacgucgccguggagcccgaaguagcaaaccucgacaucauaggacagcggauugagaauaucaagcaugaacacaaaucaaccuggcauuacgaugaggacaacccuuauaagacaugggccuaccacggcuccuaugaggugaaaccaucuggcagcgcuaguuccaugguuaauggggucgugaagcugcuaacuaagcccugggaugugaucccuauggucacccaaauugcgaugacagacaccacuccauucggacagcagagaguuuuuaaagaaaagguggauacgcgcacacccaaagccaagagggguaccgcacaaauaauggagguaacugcuaaauggcuuuggggcuuccugagccgaaacaagaagccgcggaucuguaccagagaagaguuuacaaggaaagugcgcucuaaugccgcaauuggggccgucuucguggacgaaaaccaguggaacucagcuaaggaggccguugaggacgaacguuuuugggaucucgugcaucgggagagagaacugcacaaacagggaaagugcgcgacgugcgucuacaacaugaugggcaaaagggagaagaaguugggugaguucgggaaagcaaagggaagucgcgccaucugguacauguggcugggcgcucgauuucucgaguucgaggcccuuggcuucaugaaugaagaccacugguuuucccgggagaacagccugucugggguggaaggagaggguuuacauaaacugggcuauauuuugagagauaucucgaauauaccugggggaaacauguacgcagacgauaccgcuggcugggacacuaggaucacagaggaugaccuccagaaugaagcccgcauuaccgauaucauggagccagaacacgcucugcuagccaagucaauuuucaaacuuacuuaucaaaacaagguaguuagagugcagcggcccaccaaaaaugguaccgucauggacgugaucagcaggcgugaucagcgaggguccggacaggugggcacauacggccugaacacuuuuaccaacauggaggcacaacucauacgccagauggaaagugaggggauuuucucuccuagcgagcuggaaacgccaaauuuggcggagagagucuuagacuggcuggaaaaguauggaguugagcggcucaagaggauggccaucuccggugaugacugugugguaaaacccguggacgaucgcuuugcuaccgcccuuacagcacugaacgacaugggcaaggucagaaaagauaucccgcagugggaaccuucaaagggguggaaugacuggcagcaagugcccuucugcagucaucacuuucaccagcuaauuaugaaagauggacgggagauaguugugccauguaggaaccaggacgagcuggucggccgagcucgugugucucagggugccggguggagccucagagaaacugcaugcuugggaaaguccuacgcccaaauguggcagcugauguauuuccaucgccgggaucuuaggcuggcggcuaaugccaucuguucagcaguaccuguugacuggauucccaccagcagaacaacuuggucuauccacgcccaucaccaguggaugaccacggaggauaugcucuccguguggaaccgcgucuggauugaagagaauccauggauggaagacaagacacauaucaguagcuggggcgaugugcccuacuuaggcaaacgggaggaccaauggugcgggucgcugauaggauugaccgcuagggccacuugggcaacaaacauccagguugcuauuaaucaggugcgaagacugaucgguaacgagaauuaccucgacuauaugaccuccaugaagcgguuuaaaaacgaaucugauccugagggcgcccuuugguga

SEQ ID NO: 13586 - RNA, 9879 nt, Artificial Sequence
  derived and/or modified CDS sequence (opt3) from DENV-1__FJ024433__SS-prME
agcgugaccaugcugcucaugcuuaugcccaccgcccuggcuuuccacuugacuacgcggggcggggaaccucauaugaucgucuccaagcaggaaagggggaagucuuuacuguuuaagaccucagccgguguuaauaugugcacacuaauugccauggaccucggcgaacugugugaagauacuaugaccuacaaaugcccacggauaacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaaucagccaagagacauggaaucggcaggaccuguugguaaccuucaaaacagcacacgcuaagaagcaggaaguugugguccucgguagucaagagggggccaugcacacugcucugaccggcgccacggaaauucagaccucuggaacaacuaccauauuugcaggccauuuaaaaugccgucugaagauggauaaacuaacacuccgcgggauguccuaugugauguguacugggagcuucaagcuggagaaagaagucgccgagacccagcacgguacggugcuuguucagaucaaguacgagggcacagacgcuccuugcaagauuccauucucgacccaagaugaaaaaggggugacucagaacggaagauugaucacagcgaaucccauaguaaccgacaaggagaaaccugucaacauugaagcagagccacccuuuggcgagucuuauaucgugaucggugccggggaaaaggcucugaaacucuccugguucaagaagggcucaaguauuggaaaaauguuugaggccacugcaaggggcgcccggcgaauggcuauccugggggauaccgccugggacuucggaagcauugguggcguuuuuacauccguggggaaacuuguccaucagauauucggaacggcauacggcgugcuguuuucugguguaagcuggaccaugaaaaucgggauuggcguguugcucacuuggcugggauuaaauucacgcaguacaucccugagcaugaccuguaucgcgguuggccuagucacacucuaccugggggugauggugcaggcugauucuggaugcgucaucaacuggaagggcagagaacuuaaaugugguucagggauuuucguuacuaaugaggugcacaccuggacggaacaauauaaguuucaggccgacaguccgaagagguugagcgcagccauaggaaaggcuugggaggagggcgugugcgguauccgguccgccacacgccuggaaaacauuauguggaagcagaucucuaacgagcucaaucauauucuguuagaaaacgacaugaaauucaccguagucgugggcgauguugcagggauccuggcucagggaaagaaaaugauaagaccucaacccauggagcacaaguacucguggaaaagcuggggcaaggccaagaucauuggggcggacgugcagaauacuaccuuuaucauugauggaccaaacacaccugaaugucccgacgaucagagggccuggaauaucugggaggucgaggacuauggcuucgguauauuuacuaccaacauuuggcuuaaauugcgugauuccuacacacaggugugcgaccaccggcucaugucagcugcaaucaaggauaguaaagccguucaugcugacaugggguauuggauugaaucugagaagaaugaaacguggaaacuggcccgagcauccuucaucgaggugaagaccuguauauggccaaagucccacacucuauggucaaacggaguacuggaaagcgagaugaucauucccaaaaucuacggcgguccuauuucucaacauaauuauagaccaggcuacuucacacagaccgcggggccguggcaccucggaaagcuggagcuugauuuugacuugugcgaaggcacuacagucgugguggaugagcacugcgggaacaggggacccucccugcgcaccacgacugucaccggcaaaaucauacaugaaugguguugccggaguuguacauuaccuccacucagauucaggggugaggacgggugcugguacggaauggagauucgccccguuaaggaaaaagaggaaaaucugguaaagagcaugguaucugccggcuccggugagguggacucauuuagucuuggccuguuguguaucagcaucaugauugaagaggucaugcgaucgcgguggucccguaagaugcucaugaccgggacucuggcuguguucuuucuacugaucaugggacagcucacauggaacgaucugauuagacuuugcauaaugguuggcgccaaugcaucugacaggauggggaugggaaccacauauuuggcucugauggccacuuucaaaaugcgcccuauguuugcagugggcuuacucuuccggagacugaccagcagggagguccuucugcuaacgaucggucucucacugguggccaguguugaauugccaaacucccuggaggaauuaggggauggacucgcuaugggcauuaugauccugaaacuucugacagacuuucaaucucaccaguugugggcgacccuccugagccuaacuuucauuaaaaccacauuuucccugcauuacgccuggaagacuauggcaauggugcuuucaaucgucagccucuucccccuguguuugaguaccacgucucagaaaacaaccuggcugccgguauuacucggcucccuggggugcaagccucuuacuauguuucugauagcugagaauaagaucuggggacgacgcagcuggccauugaacgaagguauuauggccgugggcaucguuucgauucuccugucaucucuacugaaaaacgaugugccccuugccgggccucucaucgcuggaggcaugcugauagcauguuaugucauuagugguuccagcgccgacuugucuuuagagaaggcggcugaggugagcugggaagaggaagccgagcacuccggggcaucacauaauauccugguagaagugcaggaugacggaacaaugaaaaucaaggaugaggagcgggacgauacccucacuauucugcuuaaagccacacuguuggcugucaguggcguuuacccccuaagcauaccagcaacccuguucgugugguauuucuggcaaaagaaaaagcagagaucuggcgugcucugggacacgccuucacccccagaagucgagagggccgugcuggaugacgggaucuaccguauuaugcagcgcggacuuuuaggucggagccagguuggcguagggguguuucaagaaaacgucuuccacacuauguggcacgugaccagaggagcgguucugauguaucagggcaagaggcucgagccgaguugggcuagcgugaaaaaggacuugaucuccuacggugggggauggcgacugcagggcucuuggaauacaggcgaggaaguccaggugauugccguagagccugggaaaaaccccaagaauguccaaaccgcaccaggaacauuuaaaacucccgaaggugaggugggcgccaucgcucucgauuucaagccugggaccucgggaagcccaauaguuaaccgggaaggcaagaucgugggucuguacgggaauggagucgugacgacaucaggcacuuauguuuccgccauugcacaggcuaaagccagucaggagggcccccuuccugagaucgaagacgagguguuucgcaagagaaaccugaccauuauggauuugcauccggggucuggaaaaacaaggcgguaccuaccagcgaucguccgagaagccauaaagagaaaacugcgcacccucauuuuagcacccacuagggugguagcuagcgagauggccgaagcucugaaggguaugccuauccguuaucaaaccacagcagugaaguccgagcacacgggcaaagagaucguugaccuuaugugccaugccacuuucaccaugcggcugcucucaccagucagagugcccaauuacaacaugauuaucauggaugaagcccacuuuacagacccuucuagcauagcugcgaggggguauauuaguacccgcgugggaaugggcgaggcagccgcuaucuucaugacugccacaccgcccgguuccgucgaagcauuuccacagagcaaugccguaauucaggaugaggaacgagacaucccugagagaucuuggaacucaggguacgaguggauaaccgauuuccccggaaagacggugugguuuguuccauccauuaaaaguggcaaugacaucgcuaacuguuugcggaagaauggcaaaagggugauccagcugagccgcaagacuuucgauacagaauaucaaaagaccaaaaacaacgacugggacuacgucgugaccacugauauuucggagaugggggcgaauuuccgugccgacagaguuaucgauccucggaggugccucaagcccgugauucugaaagacggaccagaacgcgucauacuugcagguccgaugccugugacaguagcuucugccgcacagcgaagaggccggaucgggaggaaccauaauaaggagggagaucaguacauuuauaugggccagccccuaaacaaugacgaggaucacgcccacuggaccgaagcuaaaaugcuguuggacaacaucaauacaccagaggguaucauucccgccuuauuugaaccugagcgcgaaaaguccgcggcaauagauggggaguacagacugaggggcgaggcccggaagacuuucguggaacucaugcgucgcggagaccugccaguuuggcuuagcuauaaagucgcuucagagggcuuucaauacagugaucgaagauggugcuucgacggggaaaggaacaaucaggugcuggaggaaaacauggauguggagaucuggacgaaggagggagaacggaaaaagcuccgccccagaugguuggacgccaggaccuauucugacccucuggcucuacgggaguuuaaagaguucgcagccggucgaagauccgucagcggcgaucugauucucgagaucgggaaacuuccgcagcaucugacacagcgcgcucaaaaugccuuagacaacuugguuaugcugcacaauucagaacagggaggcagggcauaccggcaugcgauggaggagcucccagauacuauugaaacccugaugcuucuggcccucaucgcuguguugacaggugggguaacccuguuuuucuuaaguggccguggacuaggcaaaacuagcauagggcugcucugugugauggccuccucuguccuucuguggauggcaagcguggagccccacuggaucgcugccuccauuaucuuggaauuuuuccugaugguucuccugauuccugagcccgacagacagaggacgccacaggauaaccaacuugcauauguggucaucggacuccuguuuaugauauugaccguagccgcuaaugagaugggucuguuagaaacaacuaagaaggaccuaggcauugggcacguggcgguugagaaccaucaccaugccgcaaugcuggauguggaccuccacccugcuucagccuggacccuuuacgccgucgcaacaaccaucauuacucccaugaugcgccauacaaucgaaaacacgaccgcuaauauaucucugacugccaucgcgaaccaggcugccauuuugaugggacuggauaaaggcuggccaaucaguaagauggacauuggugugccucuccuggcacuugggugcuacucgcaggucaauccguuaacacugaccgccgcugugcucauguugguugcacacuaugccaucauaggccccggacugcaagcgaaagcuacccgggaggcccagaagcgaacagcagccggcauuaugaaaaacccaacuguggaugggaucguagcuaucgaccuagauccuguggucuacgacgccaaguucgaaaagcagcugggacagauuaugcuccuuauccuguguacgagccaaauauugcugaugagaaccacaugggcacucugcgaguccauuacucuggcuaccggccccuuaacaacccuuugggaggguucuccagggaaauuuuggaauacuacgaucgccguuucaauggcgaacauuuucaggggaagcuaucuggccggcgcaggucucgcuuucucccuaaugaagagucugggcgggggacgccggggcacaggggcccagggagaaaccuugggcgagaaauggaagagacagcugaaucagcucucuaaaagcgaauuuaacacuuacaagcguucagguaucauggagguggacagguccgaagcaaaggaggggcuuaaacggggagagaccacaaagcacgcugucagucgcggcacugccaaacugcgaugguucguggaaagaaauuugguaaagccugaggguaaagugauagaucugggcugugggaggggaggcuggagcuauuacugcgccgggcucaagaagguuaccgaagugaaaggauauacaaagggcggucccgggcaugaggaaccgaucccaauggcgacguacggauggaacuuagucaaacugcacucuggcaaggacguguuuuucauuccucccgagaaaugugauacccuucugugcgacaucggcgaguccucaccaaaucccacuauugaagaggggcggacacuacgcguccucaagaugguggaaccuuggcugagaggaaaccaauuuuguaucaaaauuuugaauccguacaugcccagcguuguagagacccuggagcagaugcagaggaagcaugguggcaugcucgugcgaaacccacuuucgagaaauucuacucacgaaauguauugggucaguugcgggacaggaaacaucguguccgcuguuaauaugaccagccguaugcuguuaaacagauucacgauggcacaccgcaagccuaccuacgagagggauguggaccugggcgccgguacacggcaugucgcuguggaacccgagguagccaacuuggauauaauugggcagagaaucgaaaauaucaaacacgagcauaagucaacuuggcacuaugacgaggauaacccuuacaaaaccugggcauaucauggauccuacgaagugaagccaucuggcagcgccaguuccaugguuaauggcgucgugaaacuccugacaaagcccugggacgugauuccuauggucacucaaauagcuaugaccgauacaaccccauuugggcagcagcgcguuuucaaggagaaaguggacacuaggacgcccaaggcgaaacgaggaacagcccaaaucauggaaguaaccgcaaaguggcuaugggguuuucuuagccggaacaaaaagccgagaauuuguacuagggaggaguucacccgcaaggugcguucuaaugcugccaucggcgcagucuuuguggacgagaaccaguggaacucagccaaagaggcuguugaagaugagcgguucugggaccuggugcacagagaaagggagcuccacaagcaggggaaaugcgccacaugcgucuauaacaugaugggaaagcgcgagaagaagcugggcgaguuugguaaggcgaaagggagucgagcaauuugguacaugugguugggagcccgguuccuggaguucgaagcucucggcuuuaugaaugaggaucauugguucuccagagaaaacagccuuucuggcguggagggggagggacugcacaaguuagguuacauccugagggacauaucgaaaaucccuggcgggaauauguaugccgaugacacggcaggaugggauacccgcauuacugaagacgauuugcagaacgaggcuagaaucacagacauuauggaaccagagcaugcccuccuggcuaagucaaucuuuaaacuaaccuaccaaaauaagguaguucgggugcagaggcccgccaaaaacggcacugucauggaugugauaagccgucgagaccagcgcgguuccggacaggugggaacauauggccuuaauaccuucacaaacauggaagcacaacugauuagacagauggagagugagggcaucuuuucuccuagcgaacucgagacuccaaaccuggcggaacgggucuuggauugguuagagaaguacgggguugaaaggcugaagcgcauggccaucuccggagacgacugugugguaaaacccauugaugacagauucgcuaccgcccucacggcacuuaaugauauggguaaggugcggaaagacauaccgcagugggagccuucaaagggcuggaacgauuggcagcaaguccccuuuugcagucaccacuuccaucagcugaucaugaaagacgggagggagauugugguuccaugucgaaaucaggaugagcuagugggacgugcuagagucucucagggcgccgguuggaaccugcgcgagaccgcaugccucggaaagagcuaugcccaaauguggcaguugauguacuuucaccggagggaccugagacuugcggcuaaugccaucuguuccgcagugccuguagauuggauucccacaucacgcacuaccuggagcauccaugcccaccaucaguggaugacaacugaagacaugcugucuguuuggaaccggguguggauagaggaaaauccauggauggaggauaagacccacaucuccaguugggaggacguccccuaucucggaaaaagggaagaccaauggugcggcagcuuaauuggccugacggcucgagccacaugggcaaccaacauccagguggcuauuaaucagguuagacgguugaucgggaacgagaauuaccuggauuacaugacuucgaugaagagguucaaaaacgaauccgacccugagggagcccucugguga

SEQ ID NO: 13587 - RNA, 9879 nt, Artificial Sequence
  derived and/or modified CDS sequence (opt3) from DENV-1__FJ024434__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacauuaauugccauggaccucggcgaacugugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuuggacagggcaaaaagaugauccgcccucaacccauggaguacaaauauucguggaaaagcugggggaaggccaaaauaaucggagcggacgcccagaauacuaccuucauuaucgauggcccaaacacaccugaaugucccgacgaucagagagcuuggaauauuugggagguggaggacuacgguuuugggaucuucacuaccaacauaugguugaagcucagggauuccuauacacaggucugcgaccaccgucugaugucagcagccauuaaagauaguaaggcugugcacgccgacaugggauacuggaucgaaucugagaaaaaugaaacguggaagcuagcacgggcgagcuuuauugagguuaagaccuguaucuggccaaaaucccauacucuguggucaaacggcgugcucgaaagcgagaugauaauccccaagauuuaugguggcccuaucucucaacacaauuaccgaccaggguacuucacacagaccgccggaccguggcaucugggcaaacuugaguuggauuucgaccugugcgaagggacuacaguagucguggaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgucaaagaaaaggaggaaaaucuuguuaagagcauggugucugcugguuccggcgagguagacucauucagucugggguugcucuguauuagcaucaugaucgaagaggugaugcgcucgcgauggucccggaaaaugcugaugaccggaacucuagccgucuuuuuccugcucauuaugggccagcugacauggaacgaucuuauccguuugugcauuauggugggggcaaaugcuucugacagaaugggaaugggcaccacauaccuggccuuaauggcaacuuuuaagaugaggccuauguucgccguuggucuccuguuucgccggcuuaccagcagagaggugcugcuacucacgauagggcugucauuggucgcuaguguggaacugccaaacuccuuagaggaacucggagauggccuggcgaugggcaucaugauucuuaaacuguugacagacuuccaaucucaucagcucugggccacccugcuaagccugacuuuuaucaagaccacauucucccuucacuaugcauggaaaacuauggcuaugguucucucaauugugagccuguuucccuugugucugaguaccacgucucagaagacaaccugguuaccgguccuccuggggucccuuggaugcaagccucugacuauguucuugaucgccgagaauaaaauaugggguaggaaguccuggccacucaacgaaggcaucauggccguagggauugugucgauccugcuaucaucucugcuuaaaaacgauguuccccucgcuggaccucugauugcaggcgguauguugaucgccuguuacgugauaaguggguccagcgcggacuuaucucuggagaaggcugccgaggucagcugggaagaggaagcagagcauuccggagccucacacaauauucucguggaaguacaggaugacggcacaaugaaaaucaaggaugaggagcgagacgauacccugacuauccuucugaaagcuacauugcuagcagugaguggcgucuauccccugagcauuccagccacccucuuuguuugguacuucuggcaaaagaagaaacagcgcucuggggugcugugggacacgccuucacccccagaaguggagcgggcgguccuugaugacggaauauauagaaucaugcagagggguuuacugggccguagccagguggggguuggaguauuccaagaaaacguguuucauacuauguggcacgucacccgcggcgcugugcucauguaccaggguaagcgguuggagccgaguugggccagcguuaaaaaggaccugauuuccuacgggggaggcuggagacucaggggcucuuggaauacaggggaggaagugcaggucaucgcaguggagccuggcaaaaaucccaagaauguacagaccgccccagguacauucaagacucccgaaggcgaggucggggcuauugcccuggauuuuaaaccuggaaccucgggcagcccaaucgugaaccgagaagguaagauaguugggcuuuauggaaauggcguggucacgacaucaggcacuuacguguccgcaaucgcucaagccaaagcgagucaggaggggccccugccugagauugaagacgagguuuuccggaagcgcaacuugaccaucauggaucuacacccgggaucugguaaaacaagaagguaucugccagccauugugcgggaagcaaucaagcgaaagcucagaaccuuaauacuggcucccacucgcgucguggccagcgagauggcugaagcacuuaaaggcaugccuauuagguaccagaccacagccguaaaguccgagcauacggggaaagagaucguggaccugaugugccacgccacuuuuaccaugcgucucuugucaccaguucggguccccaauuauaacaugaucauuauggaugaagcucauuucacagacccuucuagcaucgcggcaagaggauacauaaguaccagggugggcaugggugaggccgcugccauuuuuaugacugcaacaccgcccggguccguggaagccuucccacaaagcaaugcugucauccaggaugaggaacgcgacauuccugagcgaucuuggaacucaggauaugaguggaucaccgauuuucccggcaagacgguaugguucgugccauccauaaaaaguggcaaugacauugcgaacugucugagaaagaaugggaagcggguuauccagcucagcaggaaaacuuuugauacagaauaccagaagaccaaaaacaacgacugggacuacguggucaccacugauaucucggagaugggagccaauuuccgcgcagaccgugugauugauccuagacggugccugaagcccguuauccuuaaagacgguccagaaagggugauucuagcuggcccgaugccugucacaguggccucugcagcccaacgccgagggagaauaggacggaaccacaauaaggagggcgaucaguauaucuacaugggucagccccugaacaaugacgaggaucaugcucacuggaccgaagccaagauguuguuagacaacauuaauacaccagaggggaucauccccgcgcuguucgaaccugagagggaaaaauccgcagccguagauggcgaguaucgccucagaggagaggcuaggaagacuuuuguggaacugaugcggcguggcgaccuuccaguuuggcugagcuacaaagucgccucagagggguuccaguauagugaucgccgauggugcuuugacggagaaagaaacaaucaagugcucgaggaaaacauggauguggagauuuggacgaaggagggugaaaggaaaaaguugcggccccgcuggcuggacgcuagaaccuacucugacccucuagcacugagggaguauaaagaguucgccgcuggccggcgauccgucagcggggaucucauacuugagaucggaaagcugccgcagcacuuaacacagagagcccagaaugcauuggacaaccugguuaugcuccauaauucagaacaaggcggucgcgcguacaggcacgccauggaggagcugccagauacuauugaaacccuuaugcugcucgcuuugaucgccgugcugacagggggcguaaccuuauuuuuccuaaguggacggggccuggggaagacuagcauuggacuccuuugugugauggcauccucuguccuguuguggauggcuagcguggagccccauuggaucgccgcauccauaauccuggaauuuuuccucaugguucugcuuauuccugagcccgaccgucagagaacgccacaggauaaccagcucgccuacguggucaucggucuguuguuuaugauucugaccguagcugcgaaugagaugggcuuacuagaaacaacuaaaaaggaccuggggaucggacacguggccguugagaaccaccaucacgcagcuaugcucgauguggaccuucauccugccucagccuggacccuguaugcagucgcuacaaccauaauuacucccaugaugaggcacacaaucgaaaacacgaccgccaauauuucuuugacugcgaucgcuaaccaagccgcaauacugaugggccucgauaaagguuggccaaucaguaagauggacauuggggugccucugcuugccuuaggcugcuacucgcaggucaauccgcugacacucaccgcugcaguguugaugcugguugcccauuaugcgaucauuggacccggccuacaggcuaaagccacccgcgaggcacaaaagcggacagccgcugggaucaugaagaacccaacuguggauggaauaguagccauugaccuggauccuguggucuacgacgcaaaauucgaaaagcagcucggccagaucaugcuucugaucuuguguacgagccagauucugcucaugcgaaccacaugggcucugugcgaguccaucacuuuagccgcggguccccuuaccacacugugggaggggucuccaggaaaauuuuggaauaccacuauagccguuucaauggcaaacauuuucagaggcagcuaucucgcuggugccggccuagcauuuucccugaugaagagucuagggggaggcaggcgcgggacgggagcucaaggcgaaacacugggugagaaauggaagcggcagcucaaucagcuuucuaagagcgaguucaacaccuacaaaagaucagggaucauggagguggaccguuccgaagccaaggagggacugaaaaggggcgagacuaccaagcacgccgucagucgggguacagcgaaauugcgcugguucguggaacgaaaucugguaaagccugagggcaaggugauugaucucggguguggaagaggcggguggagcuauuacugcgcuggacuaaagaagguuacugaagugaaaggcuacaccaagggugggcccggacacgaggaaccgaucccaauggcaacauauggcuggaaccuggucaaacuucauucuggcaaggacguguuuuucauaccucccgagaaaugugauacgcugcuaugcgacaucggggaguccucaccaaaucccaccauugaagagggaaggacucuccggguccugaagaugguggaaccuugguugcgcgguaaccaguuuuguaucaagauucugaauccguacaugcccagcguuguagaggcccucgagcaaaugcagagaaaacacggcgggaugcuugugaggaacccacugucgcgaaauucuacacaugaaauguauugggucaguugcggaaccggcaacaucguguccgcuguuaauaugacuagccggauguuacugaaccguuucacaauggcccacagaaagccuaccuacgagcgcgauguggacuuggguacggggaccaggcacgucgcaguggaacccgagguagccaaccucgauauuaucggacagcggauagaaaauauuaaacaugagcacaagucaacauggcauuaugacgaggauaacccuuacaaaacuugggcuuaucacggcuccuacgaagugaagccaucuggcagcgcgaguuccaugguuaauggggucgugaagcugcuaaccaaacccugggacgugaucccuauggucacacagaucgccaugacugauaccacaccauuuggacaacagagaguuuucaaggagaaaguggacacccgcacucccaaggcaaaaagggguacggcucagauuauggaaguaacagcccgauggcuuuggggcuuucugagccggaacaagaagccgagaauauguaccagggaggaguucacucgcaaagugcguucuaaugcagccaucggggcugucuuuguggacgagaaccaauggaacucagccaaggaggcgguugaagaugagcgguucugggaccucgugcauagagaaagggagcugcacaaacagggaaagugcgcaaccugcgucuacaacaugaugggcaaacgcgaaaagaaguugggugaguuugggaaagccaagggaagucgagcuauuugguauauguggcugggcgcccgguuccucgaguuugaagcacuuggcuucaugaaugaggaucacugguucuccagagaaaacagccugucugggguggagggagaggguuuacauaaacugggcuacaucuugagggacauuucgaagaucccugggggaaauauguaugcugaugacacagccggcugggauacgcgcauaaccgaagacgaucuccagaacgaggcuaaaaucacugacauuauggaaccagagcacgcccugcuagcaaaggcgaucuuuaaacuuacauaccagaauaagguaguuagagugcaacggcccgccaagaacgguaccgucauggaugugauuucaaggcgugaccagcgagggagcggacaggugggcacuuauggccugaauacauucaccaacauggaagcucagcucauccgccaaauggaguccgaggggauauuuaguccuucugaacuggagacaccaaacuuggccgaaagagcauuagauuggcuggagaaauacggagucgaacggcucaagaggauggcuauuagcggugacgacuguguugugaaacccaucgaugaccgcuucgccacugcacuuaccgcccugaaugauaugggcaagguaagaaaagacaucccgcagugggagccuuccaagggguggaacgauuggcaacaggugcccuuuugcucacaucacuuccaccaacuaauuaugaaggacggacgggagauagucgugccauguaggaaucaggaugaacugguuggccgagcgcgugugagucagggugcuggguggucucucagagagacggccugcuugggaaaaagcuaugcacagauguggcaacugauguacuuucaucgccgggaccuuaggcuggccgcuaacgccaucuguuccgcagucccuguggauuggguacccaccucaagaacaacuuggagcauucacgcucaucaccaguggaugaccacagaagacaugcucucuguuuggaaucgcguguggaucgaggaaaacccauggauggaggauaagacucauauuuccaguugggaggacguccccuacuuaggcaaacgggaagaccaguggugcggcagccugaucggguugaccgccagggcgacgugggcuacaaauauacaaguggccaucaaccagguucgaagacugauuggaaaugagaacuaucucgauuacaugaucucgaugaagcgguucaaaaaugaauccgacccugagggugcacuuugguga

SEQ ID NO: 13588 - RNA, 9879 nt, Artificial Sequence
  derived and/or modified CDS sequence (opt3) from DENV-1__FJ024435__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuaccgcucuguuucuggcacaugccauuggcacgucgaucacucagaagggcauuaucuucauacucuuaaugcuggugacaccaucaauggcuaugcgcugcgucgggaucggaagcagagauuuuguggagggucuuaguggcgccaccuggguagacguuguguuggagcacggguccugugucacuacaauggcgaaggauaaacccacccuggacauugaacuacucaagacggaggugaccaacccugcagugcugaggaaacuuugcaucgaagccaagauuucuaauacaacuaccgauagccgguguccaacacaaggagaggcuacucuggucgaagaacaagacgccaacuucguuugccgccgaaccuuuguggauagaggcugggguaauggguguggauuguucggcaaaggcucccucaucacaugcgcaaaguuuaagugcguaaccaaacuggaggggaagauagugcaguacgaaaacuuaaaauauucagucauugugacuguucacacgggagaccagcaucaaguggguaaugagaguacagaacacggcaccacugcuaccaucacaccccaggccccuaccacugagauucagcugacagacuacggggcgcucacgcuugauuguagcccaaggaccggacuggacuucaacgaaauggucuugcuaacuaugaaggagaaaucuuggcuggugcauaagcagugguuucucgaucugccgcuucccuggacauccggcgccucaaccagccaagagacauggaaucggcaggaccuguugguaacuuucaaaaccgcacacgcuaagaagcaggaaguugugguccucgguagucaagagggggccaugcacacggcucugaccggcgccacagaaauccagacuucuggaaccacaacuaucuuugcaggccauuuaaaaugccgucugaagauggauaaacuaacccucaaggggauguccuaugugauguguacggguagcuucaaacuggagaaggaacuugccgagacacagcacggaaccgucuuggugcagauuaaguacgagggcacugacgcuccuugcaaaauaccauucucgacacaagaugaaaaggggguuacccagaacggacgccugaucacugcgaaucccauugugaccgacaaagagaagccuguaaacaucgaagcagagccacccuuuggcgagucuuauauagucauuggugccggggaaaaagcucucaagcuguccugguucaagaaaggcucaaguaucggaaagauguuugaggccacagcaagaggcgccaggcggauggcuauccuuggggauacggccugggacuucggaagcauugguggcguguuuaccuccguugggaaacuggugcaucagaucuucggaacugcauacggcgucuuguuuucuggugugagcuggacaaugaagauugggauaggcguacuccugaccugguuaggacuaaauucacgaaguacaucccuaagcaugacuuguaucgcggugggccucguuacccuguaccuuggggucauggugcaggcugauucuggaugcgugauuaacuggaaaggccgcgaauugaagugugguucagggaucuucgucacgaaugagguucacacauggaccgaacaauauaaguuucaggccgacaguccgaaaagacugagcgcagccaucggaaaggcuugggaggagggcgugugcgguauuagguccgccacucggcucgaaaacauaauguggaaacagaucucuaacgagcugaaucauauuuuacuggaaaacgacaugaaguucaccgugguagucggcgauguggcagggauccuugcucagggcaagaagaugauucgcccucaacccauggagcacaaauacucguggaaaagcuggggcaaggccaagaucauaggggcggacguucagaauacaacuuuuaucauugauggaccaaacaccccugaaugucccgacgaucagagagccuggaauaucugggagguggaggacuauggcuucgguauuuuuacaacgaacaucugguugaagcucagggauuccuacacccaggucugcgaccaccgucugaugucagcugcaauaaaagauaguaaggccgugcaugcugacaugggguauuggauugaaucugagaaaaaugaaacuuggaagcuagcccgggccuccuucaucgagguuaagacauguauuuggccaaaaucccacacccuguggucaaacggagugcucgaaagcgagaugaucauacccaagaucuacggcgguccuauuucucaacauaauuaucgaccaggcuacuucacucagacagcggggccguggcaccugggaaaacuugaguuggauuuugaccugugcgaaggcaccacgguagucguggaugagcacugcgggaacagaggacccuccuuaaggacuaccacagugaccggcaagaucauuuacgaaugguguugccgcaguuguacucucccuccacugcgguucagaggugaggacgggugcugguauggaauggagaucaggcccgucaaagaaaaggaggaaaaucuuguuaagagcauggugucugccggcuccggugagguagacucauuuagucugggcuugcucuguauaagcauuaugaucgaagaggugaugcgcucgcgauggucccggaaaaugcugaugacagggacccuagcugucuucuuucugcucaucgugggacagcugacauggaacgaucuuauucguuugugcaucaugguuggcgccaaugcaucugacagaauggggaugggaacuaccuaccuggcuuuaauggccacguucaagaugaggccuauguuugcagugggccuccuguuccgccggcuuacaagcagagagguccugcuacucaccauuggucugucauugguggccaguguugaacugccaaacuccuuagaggaacucggggauggacuggcuaugggcauaaugauccuuaaacuguugacugacuuucaaucucaucagcucugggcgacccugcuaagccugacauucauuaagacuaccuuuucccuucacuaugccuggaaaacgauggcaauggugcucucagucguaagccuguuccccuugugucugaguacaaccucucagaagacuacaugguuaccggugcuccugggcucccuugggugcaagccucugaccauguuuuugaucgcugagaauaaaauuuggggaaggcgaagcuggccacucaacgaagguaucauggccguuggcauagugucgauccugcuaucaucucugcuuaagaacgaugucccccucgccgggccucugauugcuggaggcauguugaucgcauguuacgugauuagugguuccagcgccgacuuaucucuggagaaagcggcugagguaagcugggaagaggaagccgagcauuccggggcaucacacaauauccucguggaaguccaggaugacggaacuaugaagauaaaagaugaggagcgcgacgauacacugaccauucuucugaaggccacguugcuagcuguuaguggcguguauccccugagcaucccagcaacucucuucgugugguacuucuggcagaagaagaagcagcggucuggcguccugugggacaccccuucacccccagaaguggagagagccguucuugaugacgggaucuauaggauuaugcagcguggauuacugggucgcagccagguaggcgugggggucuuucaagaaaacguguuccauacaauguggcacguuacccggggagcggugcucauguaccagggcaaaagauuggagccgaguugggcuagcgucaagaaagaccugauauccuacggugggggauggaggcuccagggcucuuggaauacaggcgaggaagugcagguaaucgccgucgagccugggaagaaccccaaaaaugugcaaacugcaccaggaaccuuuaagacgcccgaaggugagguuggcgccauugcucuggauuucaagccugggacaucgggaagcccaaucgugaaccgagaaggcaaaauugucggucuuuaugggaauggagugguuacuaccucaggcacauacguguccgccaucgcacaggcuaaggccagucaggagggcccccugccugagauagaagacgaggucuuucggaaacgcaacuugaccaucauggaucuacacccggggucuggaaagacuagaagguaucugccagcgauugugcgggaagccaucaaacgaaagcucagaaccuuaauucuggcacccacacgcguaguggcuagcgagauggccgaagcucuuaaggguaugccuaucagguaccaaacgacugcaguuaaauccgagcauaccggcaaggagauagucgaccugaugugccacgccacauucaccaugcgucucuugucaccagugcgggugcccaauuauaacaugauuaucauggaugaagcccauuuuacugacccuucuagcaucgcugcgagaggguacauuaguacaagggucggaaugggcgaggcagccgcuaucuucaugaccgccacgccgcccgguuccguagaagcauuuccacagagcaaugccgugauacaggaugaggaacgcgacauuccugagcgaucuuggaacucaggguaugaguggaucacugauuuccccggaaaaacaguuugguuugugccauccauuaagaguggcaaugacaucgcuaacugucugaggaaaaauggcaagcgggucauacagcucagcaggaagaccuucgauaccgaauaccagaaaacuaagaacaacgacugggacuacgugguuacaaccgauauuucggagaugggggcgaauuuccgcgccgaccgugugaucgauccuagacggugccugaaacccgucauccuuaaggacggaccagaaagggugauucuagcagguccgaugccuguaacaguggcuucugccgcacagcgccgaggcagaaucgggcggaaccacaauaaagagggagaucaguauauuuacaugggccagccccugaacaaugacgaggaucaugcccacuggacugaagcuaagauguuguuagacaacauaaauacgccagaggguaucauucccgcccuguuugaaccugagagggaaaaguccgcggcaaucgauggggaguaucgccucagaggcgaggccaggaaaaccuucguugaacugaugcggcguggagaccuuccagucuggcugagcuacaagguggcuucagagggcuuucaauauagugaucgccgauggugcuucgacggggaaagaaacaaucaggugcucgaggaaaacauggaugucgagaucuggacaaaagagggagaaaggaagaaauugcggccccgcuggcuggacgccagaacuuacucugacccucuagcucugagggaguuuaaggaguucgcagccggucggcgauccguuagcggcgaucucauucuugagauagggaaacugccgcagcacuuaacccagagagcucaaaaugccuuggacaaccuggugaugcuccauaauucagaacagggaggccgcgcauauaggcacgcgauggaggagcugccagauacaaucgaaacccuuaugcugcucgccuugauugcuguacugacugguggggugacguuauuuuuccuaaguggccggggacugggcaagaccagcaucgggcuccuuugugucauggccuccucugugcuguuguggauggcaagcguugagccccauuggauugcugccuccaucauacuggaauuuuuccucauggugcugcuuaucccugagcccgaccgucagagaacaccacaggauaaccaacucgcauacgucguaauuggacuguuguuuaugauccugacuguggccgcuaaugagauggguuuacuagaaaccacaaagaaagaccugggcauugggcacguugcgguggagaaccaccaucacgccgcaaugcucgaugucgaccuucauccugcuucagccuggacccuguacgccguggcaacuacaaucauaacgcccaugaugaggcacaccauugaaaacacuacagcuaauaucucuuugaccgccauugcgaaccaggcugccauccugaugggacucgauaagggcuggccaauaaguaaaauggacaucggugucccucugcuugcauuagggugcuauucgcaagugaauccgcugacccucacagccgcuguuuugaugcugguggcacauuacgccauuaucggccccggacuacaagcgaaggcuacucgcgaggcccagaaacggacggcagccggcauuaugaagaacccaaccguagaugggaucguggcuauagaccuggauccugucguuuaugacgccaaguucgaaaaacagcucggacagauuaugcuucugaucuuguguacaagccaaauccugcucaugcgaacuaccugggcacugugcgaguccauuacauuagcuaccggcccccuuacuacgcugugggaggguucuccagggaaguuuuggaauacaaccaucgccgugucaauggcgaacauauucagaggaagcuaccucgccggcgcaggucuagcuuucucccugaugaaaaguuugggcgggggaaggcgcggcacuggggcccagggagaaacccugggcgagaaguggaaacggcagcucaaucagcuuucuaagagcgaauuuaacacauauaagagaucagguauuauggaggucgaccguuccgaagcaaaagaggggcugaagaggggagagacuaccaaacacgcugugagucggggcacagccaaguugcgcugguucguagaacgaaaucuggugaaaccugaggguaagguuaucgaucucggcugugggagaggaggcuggagcuacuauugcgccggguuaaagaaagugacggaagucaagggauacaccaaaggcggucccgggcacgaggaaccgauuccaauggcgacuuacggauggaaccuggugaaacuucauucuggcaaagacgucuuuuucaucccucccgagaagugugauacacugcuaugcgacauaggcgaguccucaccaaaucccaccaucgaagaggggaggacucuccgggugcugaaaaugguugaaccuugguugcgcggaaaccaauuuuguauuaagauccugaauccguauaugcccagcguaguggagacacucgagcagaugcagagaaagcacgguggcaugcuugucaggaacccacugucgcgaaauucuacccaugaaauguacugggugaguugcgggacgggaaacauuguuuccgcugugaauaugaccagccggauguuacugaaccguuucacaauggcacacagaaaaccuacuuaugagcgcgaugucgacuugggcgccgguaccaggcacguggcuguagaacccgagguggccaaccucgauaucauugggcagcggaucgaaaauauaaagcaugagcacaaaucaacauggcauuacgacgaggauaacccuuauaagacuugggcauaccacggauccuaugaaguuaaaccaucuggcagcgccaguuccauggucaauggcguggugaagcugcuaaccaagcccugggacgucauuccuaugguuacacaaaucgcuaugaccgauacuacgccauuugggcagcagagaguguucaaagagaagguagacacacgcacccccaaagcgaagaggggaacugcccaaaucauggaagugaccgcaaaauggcuuugggguuuucugagccgaaacaagaagccgcggauuuguacaagagaggaguucacgaggaaaguccgcucuaaugcugccauaggcgcaguguuuguugacgagaaccaguggaacucagccaaggaggcuguggaagaugagcguuucugggaccucguccaucgggaaagagagcugcacaaacaggggaagugcgcaaccugcguguacaacaugaugggaaaaagggaaaagaaguugggcgaguuugguaaagcgaaggggagucgcgcaaucugguacauguggcugggagcccgauuccucgaguucgaagcucuuggcuuuaugaaugaggaucacugguucucccgggaaaacagccugucuggcguagagggggagggauuacauaaacuggguuauauuuugagagacaucucgaagauuccuggcgggaauauguacgccgaugacacugcaggaugggauacaaggaucaccgaagacgaucuccagaacgaggcucgcauaacugacaucauggaaccagagcacgcccugcuagcuaaaucaauuuuuaaacuuacauaucaaaauaaaguugugagaguccagcggcccgccaagaacggcaccgugauggaugugaucagcaggcgugaccagcgagguuccgggcaggucggaacauacggccugaauacuuucaccaacauggaagcacaacucauucgccagauggagagugagggcaucuuuucuccuagcgaacuggagacgccaaacuuggcggaaagaguuuuagauuggcuggagaaguaugggguggaacggcucaaaaggauggccauauccggagacgacuguguagugaagcccauugaugaccgcuucgcuaccgcccuuacagcacugaaugauauggguaaagucagaaaggacaucccgcagugggagccuucaaaaggcuggaacgauuggcagcaagugcccuuuugcagucaucacuuccaccagcuaaucaugaaggacgggcgggagauuguugugccauguaggaaucaggaugaacuggucggacgagcucgugugucucagggcgccgguuggagccucagagagacugcaugcuuggggaaguccuacgcccaaauguggcagcugauguauuuucaucgccgggaccuuaggcuggcggcuaacgccauauguucagcaguaccuguugauuggauccccaccagcagaacaacuuggucuauucacgcccaucaccaguggaugaccacggaagacaugcucuccguguggaaucgcgucuggaucgaggaaaacccauggauggaggauaaaacacauauuaguagcuggggagacgugcccuacuuaggcaagcgggaggaccaauggugcggcucgcugaucggguugaccgcuagggccacuugggcaacaaauauacagguugcuaucaaccaggugcgaagacugauuggaaaugaaaacuaccucgauuauaugaccuccaugaaacgguucaagaaugagucugacccugaaggugcccuuugguga

SEQ ID NO: 13589 - RNA, 9879 nt, Artificial Sequence
  derived and/or modified CDS sequence (opt3) from DENV-1__FJ024436__SS-prME
agcgugacaaugcugcucaugcuuaugcccacagcacuggcuuuccacuugacuacgagaggaggggagccucauaugaucgucuccaagcaggaaagggggaaaucuuuacuguuuaagaccucagccgguguuaacaugugcacauuaauugcaauggaccucggcgagcugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaauacggcacgacagccaccauuacuccccaggcgccuagcaccgagauccagcugacagacuauggggcccucacccuugauuguucuccaaggacuggacuggacuucaacgaaauggucuugcuaacaaugaaggagaaauccuggcuggugcacaagcagugguuucucgaucugccgcuucccuggacgucaggcgcaagcaccagucaagagacuuggaaucggcaggaccuguugguaacauucaaaaccgcucaugccaagaagcaggaaguugugguccucgguucucaagagggggcuaugcacacagcccugacuggcgcaaccgaaauccagacguccggaaccacaacuauuuuugccggccacuuaaaaugccgucugaagauggauaaacuaacccucaaggggaugagcuacgugauguguacaggaucguucaaacuggagaaggaagucgcugagacucagcaugguaccgugcuuguucagauaaaguaugagggcacggacgcgccuugcaaaaucccauucucuacacaagaugaaaagggggugacccagaacggacgcuugauuacugcaaaucccaucguaacagacaaagagaagccugucaacauagaagccgagccacccuuuggcgaguccuacauugugaucggugcuggggaaaaagcccugaagcucucaugguucaagaaaggcaguagcaucggaaagauguuugaggcaaccgccagaggcgcuaggcggauggccauucugggggauacugcaugggacuucggauccaucgguggcguuuuuaccucuguggggaaacuuguccaccagauuuucggaacagcguacggcgugcuguuuagcgguguaucauggacgaugaagauagggaucggcguguugcucaccuggcugggauuaaauagucgauccacuagccugucuaugacauguauugcuguuggccuagucacccucuaucugggggugauggugcaggccgauucaggaugcgucaucaacuggaaaggccgcgaacuuaagugugguagugggaucuucguuacaaaugaggugcauacuuggaccgaacaauacaaguuucaggcagacagcccgaaaagauuguccgccgcuauuggaaaggccugggacgagggcgugugcgguauaaggucugcaacgcggcuggagaacaucauguggaaacagauuucgaacgaacucaaucacauccuguuagagaacgauaugaaguucacaguagucgugggcgacguugcugggauucuggcccagggcaagaagaugauccgcccucaacccauggaauauaaauacagcuggaaguccuggggcaaggcgaaaauaaucggggccgaugugcagaauaccacuuuuauuaucgacggaccaaacaccccugagugucccgaugaccagagagcuuggaauauuugggaagucgaggauuauggcuucgguaucuuuacaacuaacauauggcuuaaguugagggacucauacacccaggugugcgaucaucgucucaugagugcagccauuaaagacucuaaggcuguucacgccgauaugggguauuggaucgagagcgagaaaaaugagacauggaagcuggcacgggcguccuucauugaagugaagacguguaucuggccaaaaucacacacccuauggagcaacggaguacuggagucugaaaugauaauccccaagauuuacggcgguccuaucucccaacauaauuaccgaccaggcuauuucacucagacagccgggccguggcaccucggaaaacuggagcuugacuuuaacuugugcgagggcaccacugucgugguggaugaacauugcgggaauagaggacccagucugaggacaaccacggucacuggcaagauuauccacgagugguguugccgcagcuguaccuuaccuccacuccgguucaaaggugaagacgggugcugguacggaauggagauaagacccguuaaggagaaggaagagaaccuggugaaaucuaugguauccgcuggcucaggugaaguggacaguuuuagccuuggccuguuguguauuucgaucaugaucgaggaagucaugaggucccgcuggucucgaaagaugcucaugacagggacccuggccguguucuuucuacugauuaugggacagcucacuuggaaugaucugauccggcuuugcauuaugguuggcgcaaacgcuagcgaccguauggggaugggaacaaccuauuuggcccugauggcaacauucaaaaugagaccuauguuagccgugggccuccuguuuaggcgccuuacuucacgggagguccugcuacucaccauaggucugaguuugguggcuuccguugagcugccaaauucuuuagaagaacucggggauggacuggcgaugggcaucaugauucuuaagcuguugacggacuuccaaagccaccagcucugggccacacugcuaucccugaccuuuaucaaaacuaccuacucacuucauuaugcauggaagacaauggcuauggugcucagcauugucagucuguuccccuugugucugucuacuaccucccagaagacgacaugguuaccgguacuccugggcagccuugggugcaaaccucugaccauguuuuugaucgccgaaaacaagauauggggaagaaaaucguggccacucaacgaggguaucauggccgugggcauuguuucaauccugcuaucuagucugcuuaagaaugaugugccccucgcugggccucugauugcaggaggcauguugaucgccuguuacgucauauccgguagcucugcggacuuaagccuggaaaaagcugccgagguguccugggaggaagaggcagaacacucaggggccagucauaacauucucguagaggugcaggaugacggaacuaugaagaucaaagaugaagagagggacgauacacugaccauccuucugaaggcuacuuugcuagcagucagcggcguuuauccccugucuauuccagccacacucuucgugugguacuuuuggcaaaagaaaaagcagcgauccggcgugcugugggacaccccuucacccccagaggucgaacgcgcggugcuugaugacgggauauaccggaucaugcagagaggauuacuggguaggagucagguuggcguagggguguuccaagagaaugucuuccacacgauguggcaugugacucguggagcuguucucauguaucagggcaaacgcuuggaaccgagcugggccuccgugaagaaagaccugauuucuuacggugggggauggcggcuccagggcucguggaacaccggcgaggagguccaggugaucgcaguagaaccugggaagaaucccaagaacguccaaacagccccaggaaccuuuaaaacaagcgagggugaagugggcgcuauugcccuggauuucaagcccgggacuucaggauccccuaucguuaauagagagggcaaaauagugggucuuuaugggaacggagucgugaccacgaguggcacauacguuucugcaaucgcucaggccaaggcgagccaggaaggcccacugcccgagauugagaaugaaguguuuaggaaacgaaacuugacuaucauggaccuacacccuggguccggaaagacccggcgcuaucugccggccauugucagagaggcaaucaagaggaaacuccggacauuaauacuggcuccaacccgagugguagccucagaaauggcugaggcacuuaaggguaugcccauuagauaccaaacuaccgccgugaaaucugaacacacaggcaaggagaucguugaucugaugugccaugccacguucacuaugcgccucuugagcccugucagggugccaaauuauaacaugaucauuauggacgaggcucacuuuaccgaucccaguuccaucgcggcacguggguacauaagcacacgggugggaaugggcgaagccgcugccauuuucaugaccgcaacuccuccggguucugucgaggccuuuccccagucaaaugcuguaauccaggacgaagagagagauauuccagaaagguccuggaacaguggguacgaguggaucacagacuucccuggaaaaaccgugugguuuguucccagcauaaagucgggcaaugauauugcgaacugucugcgcaagaacggcaaacgagugauccagcucucuagaaagacguucgacacugaguaucagaaaacaaagaauaacgauugggacuacgucgugaccaccgacaucuccgaaaugggggccaauuuucgggcagauaggguuauugacccacgccguugccugaaaccugugauccuuaaggauggacccgagagagucauucuagcugguccaaugccggugacuguagccagcgcagcccagcggaggggccgcauagggcgaaaccauaauaaggaaggagaccaguauaucuacaugggccagccucugaacaaugaugaggaccacgcucauuggacagaggccaaaauguuguuagauaacauuaauacccccgaagguaucaucccagcgcuguucgagcccgaaagagagaagucagcagccauugacggggaauaucggcucaggggcgaggcucgcaaaacauucguggagcugaugagaaggggagaucuuccuguuuggcugaguuacaaggucgccucugaaggcuuucaauauuccgaccggcguuggugcuucgauggggagcgcaacaaucaggugcucgaagagaacauggacguggaaauauggacuaaagagggagagcgaaagaaauugagaccaagguggcuggaugcucggacguacagcgacccccuagcacugcgcgaauuuaaggaguucgccgcugguagaaagucagucaguggcgaccucauccuugaaauugggaaacugccucagcacuuaacccagagggcccaaaaugcauuggauaaccugguuaugcuccacaauagcgagcagggaggccgggcguaccgacaugccauggaggaacugccggacacaaucgagacucuuaugcugcucgcuuugauugccgugcugaccggugggguaacauuauuuuuccuauccggcagaggacugggcaagaccucuaucgggcuccuuugugugauggcaagcuccguccuguuguggauggcuucaguggaaccacacuggauagccgcaucuaucauucuggaguuuuuccucaugguucugcuuauccccgaaccugaucgccagaggacuccccaggacaaccaacucgccuauguggucauuggacuguuguuuaugauccugacgguagcugcgaacgagauggguuuacuagagaccaccaaaaaggaucugggcauagggcauguggccguugaaaaucaccaccaugcagcuaugcucgacguggaucuucacccagccagugccuggacucuguacgcagucgcuaccacaauuaucaccccuaugaugcggcauacuauugagaacacaacggccaauaucucguugaccgcgauagcuaaccaggccgcaauccugaugggacucgacaaaggcuggcccauuagcaagauggauaucggugugccacugcuugccuuagggugcuauucccaggucaauccucugacucucacagcugcaguguugaugcugguugcccacuacgcgauuaucggcccgggacuacaagcuaaggccacccgugaagcacagaaaagaaccgccgcuggcauaaugaagaaccccacaguggacgggauuguagccaucgaucuggacccaguggucuaugaugcaaaauucgagaagcagcucggacagaucaugcuucugauuuuguguacuucucaaauccugcucaugaggacgaccugggcucugugcgaaucaauaacauuagccacuggcccucuuaccacacugugggaggguagccccgggaaauuuuggaauaccacuauugcgguuuccauggccaacaucuuccgcggaaguuaccucgcaggcgcuggucuagccuuuucucugaugaaaagccuaggcgggggacggcgaggcacgggggcacagggagagacacugggcgaaaaguggaaaagacagcucaaucagcuuucaaaguccgaguucaacaccuauaaaaggagugguauuauggaaguggaccgcagcgaggcuaaggaagggcugaaacggggagagacuaccaagcaugccgucucuagaggcacagccaaguugcguugguucguggagaggaaucugguaaaaccagaagguaaggugaucgaccucggcugugggcggggaggcugguccuacuacugcgcgggguugaaaaagguuacugaggugaaaggauauaccaagggcgguccugggcacgaggagcccauaccgauggcuacauacggauggaaccuggucaaacuucacucaggcaaggauguguuuuucaucccaccugaaaagugugacacgcugcuaugcgauauuggcgagagcucgcccaauccaaccaucgaggaagggcgcacucuccgaguccugaaaaugguggagcccugguugagaggaaaccaauuuuguauuaagauccugaauccuuauaugccgucuguuguagaaacacucgagcagaugcagaggaaacaugguggcaugcuugugcggaacccccugagucgcaauuccacccacgagauguacugggucagcugcgggacuggaaacauugugucagcaguuaacaugacauccagaauguuacugaauagguucaccauggcccaucgaaagccaacguaugaacgggacguggauuugggcgcugguacccgucacgucgccguggagccugaaguagcaaaccucgacaucauagggcagagaauugagaauaucaaacacgaacauaagucuacauggcacuacgaugaggacaaccccuauaagacuugggccuaccauggaagcuacgaggugaaaccuaguggcuccgcuagcucuaugguuaauggcgucgugaagcugcuaaccaaaccaugggaugugauccccauggucacacaaauugcgaugacugacaccacaccuuuugggcagcagcgcguuuucaaggaaaaaguggauaccaggacuccaaaggccaagcggggaacggcacaaauaauggagguaacagcuaaauggcuuugggguuuucugucaagaaacaagaaaccccgcaucuguaccagggaagaguucacucgaaaggugcggaguaaugccgcaauuggcgccgucuuuguggacgaaaaccaguggaacuccgcuaaagaggccguugaggacgaaagauucugggaucucgugcacagggagcgcgaacugcauaagcaggggaagugcgcgaccugcgucuauaacaugaugggaaaacgugagaagaaauugggcgaauuugguaaggcaaaagggagccgggccaucugguacauguggcugggagcuagauuccucgaguuugaggcccuuggcuucaugaaugaagaccacugguucucuagggagaacucgcugucaggcguggaaggggagggauuacacaagcuggguuauauuuugcgcgauaucagcaaaauaccgggcgggaauauguacgcagacgauacagcuggaugggacacgcgaaucaccgaggaugaccuccagaacgaagccaagauuacugauaucauggagccugaacaugcucugcuagccaaguccauuuuuaaacuuacauaucaaaauaagguaguucgggugcagagaccagccaaaaauggcaccgucauggacgugaucaguaggcgcgaucagagagguucuggacaggugggaacuuacggccugaacacauucaccaauauggaggcgcaacucauacggcagauggaaagcgagggcauauuuucccccucagagcuggaaacaccuaacuuggccgggagggucuuagacuggcuggagaagcacggaguugaacgucucaaacgaauggcuaucaguggugaugacugugugguaaagccaaucgacgaucgcuucgccacugcacuuaccgcucugaaugacaugggcaaggugagaaaagauauuccccagugggagccgucuaagggguggaacgacuggcagcaagucccuuuuugcagccaucacuuccaccagcuaauaaugaaagauggacgggaaaucgugguucccuguaggaaucaggacgagcuggugggccgcgccagagucucccagggugcaggguggucacuccgggagacggccugcuugggaaagagcuaugcgcaaauguggcagcugauguacuuucauaggcgagaucuucgucuggcugccaacgcaauuuguucugccgugccaguagacuggguuccuaccuccagaacaacuuggaguauccacgcucaucaccaguggaugaccacagaagauaugcucagcguguggaaucgcgucuggauugaggaaaaccccuggauggaggacaaaacucauaucucguccuggggcgaugugccauacuuaggcaagcgggaagaccaauggugcgggucucugauaggauugaccgccagggcaacgugggcuacaaauauccagguugccauuaaccaggugagacgccugaucgguaaugagaacuaucucgacuacaugaccucaaugaagcgguucaaaaaugagagcgaucccgaaggcgcgcuuugguga

SEQ ID NO: 13590 - RNA, 9879 nt, Artificial Sequence
  derived and/or modified CDS sequence (opt3) from DENV-1__FJ024472__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccgugggaaaggcuugggaggagggcgugugcgguauuagguccgccacccggcucgaaaacauaauguggaaacagaucucuaacgagcugaaucauauuuuacuggaaaacgacaugaaguucacuguagucgugggcgauguugcagggauccuugcucagggcaagaagaugauucgcccucaacccauggaguacaaauauucguggaaaagcuggggcaaggccaagaucauaggggcggacgugcagaauaccacauuuaucauugauggaccaaacacuccugaaugucccgacgaucagagagccuggaauaucugggaggucgaggacuacggcuucgguauuuuuaccacaaacaucugguugaagcucagggauuccuauacacaggugugcgaccaccgucugaugucagcugcaauaaaagauaguaaggccguucacgcugacaugggguacuggauugaaucugagaaaaaugaaaccuggaagcuagcccgggcauccuucaucgaggugaagacuuguauuuggccaaaaucccauacacuguggucaaacggaguacucgaaagcgagaugaucauacccaagaucuauggcgguccuauuucucaacacaauuaccgaccaggcuacuucacccagacugcggggccguggcaucugggaaaacuugaguuggauuuugaccugugcgaaggcacaaccgucgugguggaugagcacugcgggaacagaggacccuccuuaaggacgacuaccgucacaggcaagaucauucacgaaugguguugccgcaguuguacccucccuccacugcgguucagaggugaggacgggugcugguauggaauggagaucaggcccguuaaagaaaaggaggaaaaucuuguaaagagcaugguaucugccggcuccggugagguggacucauuuagucugggcuugcucuguauaagcauuaugaucgaagaggucaugcgcucgcgauggucccggaaaaugcugaugacugggacacuagcugugaucuuccugcucauuaugggacagcugaccuggaacgaucuuauccguuugugcauuaugguuggcgccaaugcaucugacagaauggggaugggaacaacuuaccuggcuuuaauggccaccuuuaagaugaggccuauguucgcagugggccuccuguuucgccggcuuacgagcagagagguccugcuacucacaauaggucugucauugguggccaguguugaacugccaaacuccuuagaggaacucggggauggacuggcuaugggcaucaugauucuuaaacuguugaccgacuuccaaucucaucagcucugggcgacucugcuaagccugaccuuuaucaagacaacuuucucccuucacuaugccuggaaaaccauggcaauggugcucucaauugucagccuguuucccuugugucugaguacgacaucucagaagaccacuugguuaccgguacuccugggcucccuugggugcaagccucugacaauguucuugaucgcugagaauaaaauauggggaaggcgaagcuggccacucaacgaagguaucauggccgugggcauuguuucgauccugcuaucaucucugcuuaagaacgaugugccccucgccgggccucugauugcuggaggcauguugaucgcauguuacgucauaagugguuccagcgccgacuuaucucuggagaaagcggcugaggugagcugggaagaggaagccgagcauuccggggcaucacacaauauucucguagaagugcaggaugacggaaccaugaagaucaaagaugaggagcgcgacgauacucugacaauccuucugaaggccaccuugcuagcugucaguggcguuuauccccugagcauuccagcaacgcucuuugugugguacuucuggcagaagaagaagcagcggucuggcgugcugugggacacuccuucacccccagaagucgagagagccgugcuugaugacgggauauauaggaucaugcagcguggauuacugggucgcagccagguuggcguagggguguuccaagaaaacgucuuucauaccauguggcacgugacacggggagcgguucucauguaccagggcaaaagauuggagccgaguugggcuagcgugaagaaagaccugauuuccuacggugggggauggaggcuccagggcucuuggaauaccggcgaggaaguccaggugaucgccguagagccugggaagaaccccaaaaauguccaaacagcaccaggaacuuucaagacccccgaaggugaggugggcgccauugcucuggauuuuaagccugggacgucgggaagcccaaucguuaaccgagaaggcaaaauagugggucuuuaugggaauggagucgugacaacuucaggcaccuacguuuccgccaucgcacaggcuaaggccagucaggagggcccccugccugagauugaagacgagguguuccggaaacgcaacuugacaaucauggaucuacacccggggucuggaaagaccagaagguaucugccagcgauuguccgggaagccaucaaacgaaagcucagaacuuuaauacuggcacccacccgcgugguagcuagcgagauggccgaagcucuuaaggguaugccuauuagguaccaaacaacggcagugaaauccgagcauacuggcaaggagaucguugaccugaugugccacgccaccuuuacaaugcgucucuugucaccaguccgggugcccaauuauaacaugaucauuauggaugaagcccauuucaccgacccuucuagcaucgcugcgagaggguacauaaguacuagggugggaaugggcgaggcagccgcuauuuuuaugacagccaccccgcccgguuccgucgaagcauucccacagagcaaugccguaauccaggaugaggaacgcgacauuccugagcgaucuuggaacucaggguaugaguggaucacggauuuucccggaaaaacugugugguucguuccauccauaaagaguggcaaugacauugcuaacugucugaggaaaaauggcaagcgggugauccagcucagcaggaagacauuugauaccgaauaccagaaaaccaagaacaacgacugggacuacgucgugacuacagauaucucggagaugggggcgaauuuccgcgccgaccguguuauugauccuagacggugccugaaacccgugauccuuaaggacggaccagaaagggucauucuagcagguccgaugccugugaccguagcuucugccgcacagcgccgaggcagaauagggcggaaccacaauaaagagggagaucaguauaucuacaugggccagccccugaacaaugacgaggaucaugcccacuggacagaagcuaagauguuguuagacaacauuaauacuccagaggguaucauccccgcccuguucgaaccugagagggaaaaguccgcggcaauugauggggaguaucgccucagaggcgaggccaggaaaacguuuguggaacugaugcggcguggagaccuuccaguuuggcugagcuacaaggucgcuucagagggcuuccaauauagugaucgccgauggugcuuugacggggaaagaaacaaucaggugcucgaggaaaacauggauguggagauauggaccaaagagggagaaaggaagaaauugcggccccgcuggcuggacgccagaacauacucugacccucuagcucugagggaguucaaggaauuugcagccggucggcgauccgucagcggcgaucucauccuugagauugggaaacugccgcagcacuuaacucagagagcucaaaaugccuuggacaaccugguuaugcuccauaauucagaacagggaggccgcgcauauaggcacgcgauggaggagcugccagauaccaucgaaacacuuaugcugcucgccuugauugcugugcugaccggugggguaacuuuauucuuucuaaguggccggggacugggcaagacgagcaucgggcuccuuugugugauggccuccucuguccuguuguggauggcaagcguggagccccauuggauagcugccuccaucauucuggaguucuuucucaugguucugcuuaucccugagcccgaccgucagagaaccccacaggauaaccaacucgcauacguggucauuggacuguuguucaugauccugacaguagccgcuaaugagauggguuuacuagaaacuaccaagaaagaccugggcauagggcacguggcgguugagaaccaccaucacgccgcaaugcucgauguggaccuucauccugcuucagccuggacacuguacgccgucgcaaccacuauuaucacacccaugaugaggcacacgauugaaaacaccacugcuaauaucucuuugacagccauagcgaaccaggcugccauccugaugggacucgauaagggcuggccaauuaguaaaauggacaucggugugccucugcuugcauuagggugcuauucgcaggucaauccgcugacccucaccgccgcuguguugaugcugguugcacauuacgccauuaucggccccggacuacaagcgaaggcuacacgcgaggcccagaaacggacugcagccggcauaaugaagaacccaacgguggaugggauuguagcuaucgaccuggauccuguggucuaugacgccaaguuugaaaaacagcucggacagaucaugcuucugauuuuguguaccagccaaauccugcucaugcgaacaacuugggcacugugcgaguccauaaccuuagcuacaggcccccuuaccacucugugggaggguucuccagggaaguucuggaauacgacaauugccguuucaauggcgaacaucuuuagaggaagcuaccucgccggcgcaggucuagcuuucucccugaugaaaaguuugggcgggggaaggcgcggcaccggggcccagggagaaacucugggcgagaaguggaaacggcagcucaaucagcuuucuaagagcgaguucaacaccuauaagagaucagguauuauggagguggaccguuccgaagcaaaagaggggcugaagaggggagagacaacuaaacacgcugucagucggggcaccgccaaguugcgcugguuuguggaacgaaaucugguaaaaccugaggguaaggugaucgaucucggcugugggagaggaggcuggagcuacuauugcgccggguuaaagaaaguuacagaagugaagggauacacgaaaggcggucccgggcacgaggaaccgauaccaauggcgaccuacggauggaaccuggucaaacuucauucuggcaaagacguguucuuuaucccucccgagaagugugauacucugcuaugcgacauuggcgaguccucaccaaaucccacaaucgaagaggggaggacccuccggguccugaaaaugguggaaccuugguugcgcggaaaccaauucuguauuaagauccugaauccguauaugcccagcguuguagagacucucgagcagaugcagagaaagcacgguggcaugcuugugaggaacccacugucgcgaaauucuacacaugaaauguacugggucaguugcgggaccggaaacauuguguccgcuguuaauaugacgagccggauguuacugaaccguuuuaccauggcacacagaaaaccuacauaugagcgcgauguggacuugggcgccgguacuaggcacgucgcuguggaacccgagguagccaaccucgauaucauagggcagcggauugaaaauaucaagcaugagcacaaaucaaccuggcauuacgacgaggauaacccuuauaagacaugggcauaccacggauccuaugaagugaaaccaucuggcagcgccaguuccaugguuaauggcgucgugaagcugcuaacuaagcccugggacgugaucccuauggucacccaaauugcuaugacagauaccacuccauucgggcagcagagaguuuuuaaagagaagguggacacgcgcacacccaaagcgaagaggggaaccgcccaaauaauggaaguaacugcaaaauggcuuugggguuuccugagccgaaacaagaagccgcggaucuguaccagagaggaauuuacaaggaaagugcgcucuaaugcugccauuggcgcagucuucguggacgagaaccaguggaacucagccaaggaggcuguugaagaugagcguuuuugggaccucgugcaucgggaaagagagcugcacaaacaggggaagugcgccacgugcgucuacaacaugaugggaaaaagggaaaagaaguugggcgaguucgguaaagcgaaggggagucgcgcaaucugguacauguggcugggagcccgauuucucgaguucgaagcucuuggcuucaugaaugaggaucacugguuuucccgggaaaacagccugucuggcguggagggggagggauuacauaaacuggguuauauuuugagagacaucucgaagauaccuggcgggaauauguacgccgaugacaccgcaggaugggauacuaggaucacagaagacgaucuccagaacgaggcucgcauuaccgacaucauggaaccagagcacgcccugcuagcuaaaucaauuuucaaacuuacuuaucaaaauaaaguaguuagagugcagcggcccgccaagaacggcacagucauggaugugaucagcaggcgugaccagcgagguuccggacaggugggaaccuacggccugaauacauuuacuaacauggaagcacaacucauacgccagauggagagugagggcauuuucucuccuagcgaacuggagaccccaaacuuggcggaaagagucuuagauuggcuggagaaguaugggguugaacggcucaaaaggauggccaucuccggagacgacugugugguaaagcccaucgaugaccgcuuugcuacggcccuuaccgcacugaaugauauggguaaagugagaaaggacauuccgcagugggagccuucaaaaggcuggaacgauuggcagcaaguccccuucugcagucaucacuuucaccagcuaauaaugaaggacgggcgggagaucgugguuccauguaggaaucaggaugaacuggugggacgagcucgugucucucagggcgccgguuggagccucagagagacagcaugcuuggggaaguccuacgcccaaauguggcagcugauguauuuccaucgccgggaccuuaggcuggcggcuaacgccauuuguucagcagugccuguagauuggauccccacuagcagaaccacauggucuauucacgcccaucaccaguggaugacuaccgaagacaugcucuccguuuggaaucgcguguggaucgaggaaaacccauggauggaggauaaaacgcauauaaguagcuggggagacguccccuacuuaggcaagcgggaggaccaauggugcggcucgcugaucggguugacagcuagggccaccugggcaacuaauauucagguggcuaucaaccagguucgaagacugauuggaaaugaaaacuaccucgauuauaugacauccaugaaacgguuuaagaaugagucugacccugaaggugcccuuugguga

SEQ ID NO: 13591 - RNA, 9879 nt, Artificial Sequence
  derived and/or modified CDS sequence (opt3) from DENV-1__FJ024439__SS-prME
agcgugaccaugcugcucaugcuuaugcccacagcccuggcuuuccacuugacuacgagaggaggggagccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauuaucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccuccuucagcaugacauguaucgcggugggccugguuacucuauaccucggggucauggugcaggcugauucuggaugcgugaucaacuggaaaggccgcgaacugaagugugguucagggauuuuugucaccaaugagguucacacguggacagaacaauauaaguuccaggccgacaguccgaaaagacuuagcgcagccauaggaaaggcuugggaggagggcgugugcgguaucagguccgccacccgguuggaaaacauuauguggaaacagaucucuaacgagcugaaucauauucuccuggaaaacgacaugaaguuuacugugguagucggcgauguggcagggaucuuagcucagggcaagaagaugauacgcccucaacccauggaguacaaauauucguggaaaagcuggggcaaggccaagaucauuggggcggacguucagaauaccacauucaucauugauggaccaaacacuccugaaugucccgacgaucagagagccuggaauaucugggagguggaggacuacggcuuugguauauucaccacaaacauuuggcugaaacuuagggauuccuauacgcaggucugcgaccaccguuugaugucagcugcaaucaaagauaguaaggccgugcacgcugacaugggguacuggauugaaucugagaaaaaugaaaccuggaagcucgcccgggcauccuucaucgagguuaagacuuguauauggccaaaaucccauacacuguggucaaacggagugcuagaaagcgagaugaucauucccaagaucuauggcgguccuauuucucaacacaauuaccgaccaggcuacuuuacccagacugcggggccguggcaucugggaaaacucgagcuggauuucgaccuuugcgaaggcacaaccguagucguggaugagcacugcgggaacagaggacccuccuugaggacgacuaccgugacaggcaagaucauacacgaaugguguugccgcaguuguacccugccuccauuacgguuuagaggugaggacgggugcugguauggaauggagauuaggcccgucaaagaaaaggaggaaaaucucguuaagagcauggugucugccggcuccggugagguagacucauucagucugggccuucuguguaucagcaucaugauugaagaggugaugcgcucgcgauggucccggaaaauguugaugacugggacacucgcugucuuuuuccugcuaaucaugggacagcugaccuggaacgaucucauucgucugugcauaauggugggcgccaaugcaucugacagaauggggaugggaacaacuuaccuugcuuugauggccaccuuuaagaugaggccuauguucgcaguuggccuguuauuucgccggcucacgagcagagaggugcugcuucugacaaucggucuaucacucgucgccaguguggaacugccaaacuccuuggaggaacugggggauggauuagcuaugggcauuaugauccucaaacugcuuaccgacuuccaaucucaucagcugugggcgacuuugcucagccugaccuuuauuaagacaacuuucucccuacacuaugccuggaaaaccauggcaaugguucugucaaucgugagccuuuuuccccucugucugaguacgacaucucagaagaccacuugguugccgguccuguuaggcucccucgggugcaagccucugacaauguuccuuauagcugagaauaaaaucuggggaaggcgaagcuggccacugaacgaagguauuauggccguaggcaucgugucgauuuugcucucaucucugcuaaagaacgauguuccccuggccgggccucuuaucgcuggaggcaugcucauagcauguuacgugauuagugguuccagcgccgaccugucuuuggagaaagcggcugaggucagcugggaagaggaagccgagcauuccggggcaucacacaauaucuuaguggaaguacaggaugacggaaccaugaagaucaaagaugaggagcgcgacgauacucugacaauucuccugaaggccacccuucuggcugugaguggcgucuaucccuugagcauaccagcaacgcuauucguuugguacuuuuggcagaagaagaagcagcggucuggcgugcugugggacacuccuucacccccagaaguggggagagccguccucgaugacggaaucuauaggauuaugcagcguggucugcuuggccgcagccagguggggguuggaguauuccaagagaacguguuucauaccauguggcacgucacacggggcgcgguguuaauguaccaggguaaaagacuggaaccgaguugggcuagcguuaagaaagaccucaucuccuacgggggaggcuggagguugcagggcucuuggaauaccggggaggaggugcaggucauugccguggaaccuggaaagaaccccaaaaauguacaaacagcaccagguacuuucaagacccccgagggcgaagucggggccaucgcucuggauuuuaagccuggaacgucgggcagcccaauagugaaccgagaggguaaaaucguugggcucuauggaaauggcguggucacaacuucaggcaccuacguguccgccauugcacaggcuaaggccagucaggaagggccccugccugagaucgaggacgaaguuuuccggaaacgcaaccuuacaauuauggaucugcacccgggaucugguaagaccagaagguauuugccagcgaucgugcgggaggccauaaaacgaaagcuaagaacucugauucucgcacccacccgcgucguggcuagcgaaauggccgaggcuuuaaagggcaugccuaucagguaccaaacaacggcaguaaaauccgaacauacugggaaggagaucguggaccugaugugccacgccaccuuuacaaugcgucuucugucaccaguucggguccccaauuauaacaugauuaucauggaugaggcccauuucaccgacccuucuagcauagcugcgagaggauacauuaguacuagggugggcaugggugaagcagccgcuaucuuuaugacagccaccccgcccggguccguggaggcauucccacagagcaaugccgucauucaggaugaagaacgcgacaucccugaacgaucuuggaacucaggauaugaguggauaacggauuuucccggcaaaacuguaugguucgugccauccauuaagaguggcaaugacaucgcuaacugucucaggaaaaaugggaagcggguuauccaguugagcaggaagacauucgauaccgaguaccagaaaaccaagaacaacgacugggacuacguggucacuacagauauuucggaaaugggagcgaauuuucgcgccgaccgugugaucgauccuagacggugccugaaacccguuauucucaaggacgguccagagagggugauacuggcaggcccgaugccugucaccguggcuucugccgcacagcgccgagggagaaucggacggaaccacaauaaagaaggcgaucaguauauuuacaugggucagccccuuaacaaugacgaggaucaugcccacuggacagaggcuaagaugcuacuggacaacaucaauacuccagaagggaucauucccgccuuguucgagccugaaagggagaaguccgcggcaauagauggcgaauaucgcuuaagaggagaggccaggaaaacguuuguagagcugaugcggcguggcgaccucccaguguggcugagcuacaagguugcuucagaaggguuccaauauagugaucgccgauggugcuuugacggagagagaaacaaucagguccuugaagagaacauggauguggaaaucuggaccaaagagggugagaggaagaaacugcggccccgcuggcucgacgccagaacauacucugacccuuuggcucugagggaguucaaggaguuugcagccggccggcgauccgugagcggggaucuaauucuggaaaucggaaaacucccgcagcaccuuacucagagagcucaaaaugcccuggacaacuuagucauguugcauaauucagagcagggcggucgcgcauauaggcaggcgauggaggaacugccagauaccauugagacacucaugcugcuugcccugaucgcuguucucaccgggggcgugacuuuguucuuucugaguggacggggcuuagggaagacgagcauaggacuacuguguguaauggccuccucugugcuccuuuggauggcaagcgucgaaccccacuggaucgcugccuccauuauccuggaguucuuuuugauggugcugcucauuccugaacccgaccgucagagaaccccacaagauaaccagcuggcauacguugugaucggucuucucuucaugauacugacagucgccgcuaaugagaugggcuugcuggagacuaccaagaaagacuuagggauuggacauguagcgguggaaaaccaccaccaugccgcaaugcuagauguugaccugcacccugcuucagccuggacacucuacgccguggcaaccacuaucauuacacccaugaugaggcauacgaucgagaacaccacugcuaauauaucucuuacagccaucgcgaaccaggcugccauucugaugggcuuggauaaggguuggccaaucaguaaaauggacauuggggucccucugcucgcacugggcugcuauucgcaagugaauccgcuuaccuuaaccgccgcuguccugaugcucguggcacacuacgccaucauaggacccggcuugcaggcgaaggcuacacgcgaagcccagaaacggacugcagccgggauuaugaagaacccaacgguugauggaaucguggcuaucgaccuggauccuguaguguaugacgccaaguuugagaaacagcuaggccaaauuaugcugcucauccuuuguaccagccagauacuguugaugcgaacaacuugggcacugugcgaauccauuacccucgcuacagguccccugaccacuuuaugggaggggucuccaggaaaguucuggaauacgacaaucgccgucucaauggcgaacauuuucagaggcagcuaccuugccggugcaggccuggcuuuuucccucaugaaaagucuagggggaggcaggcgcgggaccggagcccagggcgagacucugggugaaaaguggaaacggcaguugaaucaacugucuaagagcgaguucaacaccuauaagagaucagggaucauggaaguugaccguuccgaggcaaaagaaggacucaagaggggcgagacaacuaaacaugcugugagucgggguaccgccaaacuucgcugguuugucgagcgaaaucuggugaaaccugaaggcaagguaauagauuugggguguggaagaggcggguggagcuacuauugcgccggacugaagaaagugacagagguuaagggcuacacgaaaggugggcccggacacgaggaaccgaucccaauggcgaccuacggcuggaaccucgugaaguuacacucuggcaaagacgucuucuuuauuccucccgaaaagugugauacucugcuuugcgacaucggggaguccucaccaaaucccacaauugaggaaggaaggacccugcgggugcuaaaaauggucgagccuuggcuccgcgguaaccaguucuguaucaagauucugaauccguauaugcccagcgugguugaaacuuuggagcagaugcagagaaagcauggcgggaugcugguaaggaacccacucucgcgaaauucuacacacgagauguacugggugaguugcggaaccggcaacaucgucuccgcugugaauaugacgagccggaugcuucugaaccguuuuaccauggcacauagaaaaccuacauaugaacgcgauguugacuuaggugccgggacuaggcacguggcugucgagcccgaaguggccaaccuggauauaauuggacaacggaucgagaauaucaagcacgaacauaaaucaaccuggcacuacgacgaggauaacccuuauaagacaugggcauaccauggcuccuaugagguaaaaccaucuggcagcgccaguuccauggugaaugggguugucaaguugcucacuaagcccugggacgugauuccuauggugacccagauagcuaugacagauaccacuccauucggacagcaaagagucuuuaaagaaaagguugacacgcgcacacccaaagcgaagagggguaccgcccagaucauggaggugacugcaaaauggcuguggggcuuccuaagccgaaacaagaagccgcggauuuguaccagagaagaguuuacaaggaaaguacgcucuaaugcugccaucggggcaguguucgucgacgaaaaccaguggaacucagccaaggaggcuguggaggaugaacguuuuugggaccuuguucaccgggagagagaacugcauaaacagggaaagugcgccacgugcguguacaacaugaugggcaaaagggagaagaagcucggugaguucgggaaagcgaagggaagucgcgcaauuugguacauguggcugggcgcccgauucuuggaguuugaggcucugggcuucaugaaugaagaucacugguuuucccgggagaacagccucucuggggucgaaggagagggucuucacaaacugggcuauaucuuaagagacauaucgaauaucccugggggaaacauguacgccgaugacaccgcaggcugggauacuaggauuacagaggacgaucugcaaaaugaagcucgcaucaccgacauuauggagccagaacaugccuugcucgcuaagucaaucuucaaacugacuuaucagaacaaggugguaagaguucagcggcccgccaaaaaugguacagugauggaugucauaagcaggcgugaccagcgaggguccggacaagugggcaccuacggccuaaacacauuuacuaacauggaggcacagcuuauucgccagauggaaagugaggggaucuucucuccuagcgagcuggaaaccccaaaucucgcggagagagugcuggauugguuggaaaaguauggagucgagcgguuaaagaggauggccaucuccggugacgacuguguugugaaacccauugaugaccgcuuugcuacggcccugaccgcacucaacgauaugggcaagguaagaaaagacauaccgcagugggaaccuucaaagggguggaaugauuggcaacaggugcccuucugcagucaccauuuucaccagcuuaucaugaaagacggacgggagauugucgugccauguaggaaccaggaugagcugguuggccgagcucgugugucucaaggugccggguggagccuaagagaaacagcaugccugggaaaguccuacgcccagauguggcagcucauguauuuccaccgccgggacuugaggcuggcggcuaaugccaucuguucagcagucccuguggauuggauucccacuagcagaaccacauggucuauccaugcccaccaucaauggaugacuaccgaggacaugcuuuccguauggaaccgcguuuggauagaagagaauccauggauggaagauaagacgcacaucaguagcuggggcgacgugcccuaccugggcaaacgggaggaccaguggugcgggucgcucauuggauuaacagcuagggccaccugggcaacuaacauccaggucgcuauuaaucaggugcgaagacugaucgguaacgagaauuacuuggauuauaugacauccaugaagcgguuuaaaaacgaaucugacccugagggcgcccugugguga

SEQ ID NO: 13592 - RNA, 9879 nt, Artificial Sequence
  derived and/or modified CDS sequence (opt3) from DENV-1__FJ024441__SS-prME
agcgugaccaugcugcucaugcuuaugcccaccgcccuggcuuuccacuugacuacgcggggcggggaaccucauaugaucgucuccaagcaggaaaggggaaagucuuuacuguuuaagaccucagccgguguuaauaugugcacacuaauugccauggaccucggcgaacugugugaagauacuaugaccuacaagugcccacggauaacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaggcagauccagcggguggaaaccugggcccuccgccacccuggauucacaguuauugcucuguuucuggcacaugccaucggcaccucgauuacgcagaaaggcaucauauucauccucuuaaugcuggugacuccaucaauggcuaugagaugcgucgggauuggaagcagggauuuuguggagggucuuaguggcgccacauggguagacguuguguuggagcacggguccugugucaccacuauggcgaaggauaagcccacacuggacaucgaacuacucaaaaccgaggugacgaacccugcagugcugcggaaacuuugcauugaagccaaaaucucuaauaccacaacugauagccgcuguccaacccaaggagaggcuacacuggucgaagaacaggacgccaacuucguuugccgaagaacuuuuguggauaggggcugggguaauggguguggauuguucggcaagggcucccucauaaccugcgcaaaauuuaagugcguaacaaagcuggaggggaaaauugugcaguacgaaaacuuaaaguauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccacggacgggacuggacuucaacgaaauggucuugcuaaccaugaaagagaagucuuggcuggugcauaaacagugguuucucgaucugccgcuucccuggacuuccggcgccucaacaagccaagagaccuggaaucgucaggaccuguugguaacauucaagacugcacacgcuaaaaagcaggaaguugugguccucgguagucaagagggggccaugcacaccgcucugacgggcgccaccgaaauccagacaucuggaacuaccacaauuuuugcaggccauuuaaagugccgccugaaaauggauaagcuaacucucaaagggauguccuaugugauguguaccgggagcuucaagcuggagaaagaagucgccgagacgcagcacgguacagugcuuguucagauaaaguacgagggcaccgacgcuccuugcaagaucccauucucgacucaagaugaaaaaggggugacacagaacggaagauugauuaccgcgaaucccaucguaacugacaaggagaaaccugucaacauagaagcagagccacccuuuggcgagucuuauauuaccaucggugccggggaaaaggcucugaaacucuccugguucaagaagggcucaaguaucggaaaaauguuugaggccacagcaaggggcgcccggcgaauggcuauucugggggauacggccugggacuucggaagcaucgguggcguguuuaccuccguugggaaacuugugcaucagauuuucggaacugcauacggcguccuguuuucuggugugagcuggacaaugaaaauagggaucggcguauugcucaccuggcugggauuaaauucacgcaguacaucccugagcaugacuuguauugcggugggccuaguuacccucuaccugggggucauggugcaggcugauucuggaugcgugaucaacuggaagggcagagaacuuaaaugugguucagggaucuucgucacgaaugagguucacacauggaccgaacaauauaaguuucaggccgacaguccgaagagguugagcgcagccauuggaaaggcuugggaggagggcgugugcgguauacgguccgccacucgccuggaaaacaucauguggaagcagauuucuaacgagcucaaucauauccuguuagaaaacgacaugaaauucaccgugguagucggcgauguggcagggauucuggcucagggaaagaaaaugaucagaccucaacccauggaguacaaguauucguggaaaagcuggggcaaggccaagauaaucggggcggacguucagaauacaacuuuuauuaucgauggaccaaacaccccugaaugucccgacgaucagagggccuggaauauuugggagguggaggacuacggcuucgguaucuuuacaacgaacauauggcuuaaauugcgugauuccuauacccaggucugcgaccaccggcucaugucagcugcaauuaaggauaguaaagccgugcacgcugacaugggguacuggaucgaaucugagaagaaugaaacuuggaaacuggcccgagccuccuucauugagguuaagacauguguguggccaaagucccauacccuauggucaaacggaguacuggaaagcgagaugaucauacccaaaaucuauggcgguccuauuucucaacacaauuacagaccaggcuacuucacucagacagcggggccguggcaucucggaaagcuggagcuugauuuugacuugugcgaaggcaccacggucgugguggaugagcacugcgggaacaggggacccucccugcgcacuaccacagucaccggcaaaaucauucacgaaugguguugccggaguuguacuuuaccuccacucagauucaggggugaggacgggugcugguauggaauggagauccgccccguuaaggaaaaagaggaaaaucugguaaagagcaugguaucugccggcuccggugagguggacucauuuagucuuggccuguuguguauaagcauuaugaucgaagaggucaugcgaucgcgguggucccguaagaugcucaugacagggacccuggcuguguucuuucuacugaucaugggacagcucacauggaacgaucugauuagacuuugcaucaugguuggcgccaaugcaucugacaggauggggaugggaacuaccuacuuggcucugauggccacguucaaaaugcgcccuauguuugcagugggcuuacucuuccggagacugacaagcagggagguccuucugcuaaccauuggucucucacugguggccaguguugaauugccaaacucccuggaggaauuaggggauggacucgcuaugggcauaaugauccugaaacuucugacugacuuucaaucucaucaguugugggcgacccuccugagccuaacauucauuaaaacuaccuuuucccugcacuaugccuggaagacgauggcaauggugcuuucaaucgucagccucuucccccuguguuugaguacaaccucucagaaaacuacauggcugccgguauuacucggcucccuggggugcaagccucuuaccauguuucugauugcugagaauaagaucuggggacgacgcagcuggccauugaacgaagguauaauggccgugggcaucguuucgauucuccugucaucucuacugaaaaacgaugugccccuugccgggccucucaucgcuggaggcaugcugauugcauguuacgucaucagugguuccagcgccgacuugucuuuagagaaggcggcugaggugagcugggaagaggaagccgagcauuccggggcaucacacaauauacugguagaagugcaggaugacggaacuaugaaaauuaaggaugaggagcgggacgauacacucaccauccugcuuaaagccacgcuguuggcugucaguggcguuuauccccuaagcaucccagcaacucuguucgugugguacuucuggcaaaagaaaaagcagagaucuggcgugcucugggacaccccuucacccccagaagucgagagggccgugcuggaugacgggauuuaucguauaaugcagcgcggacuuuuaggucggagccagguuggcguagggguguuucaagaaaacgucuuccauacaauguggcacgugaccagaggagcgguucugauguaccagggcaagaggcucgagccgaguugggcuagcgugaaaaaggacuugaucuccuacggugggggauggcgacugcagggcucuuggaauacaggcgaggaaguccaggugauugccguagagccugggaaaaaccccaagaauguccaaacugcaccaggaaccuuuaaaacgcccgaaggugaggugggcgccaucgcucucgauuucaagccugggacaucgggaagcccaauuguuaaccgggaaggcaagaucgugggucuguaugggaauggagucgugacuaccucaggcacauacguuuccgccauagcacaggcuaaagccagucaggagggcccccuuccugagaucgaagacgagguguuucgcaagagaaaccugaccauuauggauuugcacccggggucuggaaaaacuaggcgguaucuaccagcgaucguccgagaagccauuaagagaaaacugcgcacccucaucuuagcacccacaagggugguagcuagcgagauggccgaagcucugaaggguaugccuauacguuaccaaacgacugcagugaaguccgagcauaccggcaaagagauuguugaccuuaugugccacgccacauucaccaugcggcugcucucaccagucagagugcccaauuauaacaugaucaucauggaugaagcccauuuuacugacccuucuagcauugcugcgaggggguacaucaguacacgcgugggaaugggcgaggcagccgcuauauucaugaccgccacgccgcccgguuccgucgaagcauuuccacagagcaaugccguaauucaggaugaggaacgagacaucccugagagaucuuggaacucaggguaugaguggauuacugauuuccccggaaagacagugugguuuguuccauccaucaaaaguggcaaugacauagcuaacuguuugcggaagaauggcaaaagggugauucagcugagccgcaagaccuucgauaccgaauaccaaaagacuaaaaacaacgacugggacuacgucgugacaaccgauaucucggagaugggggcgaauuuccgugccgacagaguuaucgauccucggaggugccucaagcccgugauucugaaagacggaccagaacgcgucauccuugcagguccgaugccugugacaguagcuucugccgcacagcgaagaggccggauugggaggaaccacaauaaggagggagaucaguauauauacaugggccagccccuaaacaaugacgaggaucaugcccacuggacugaagcuaaaaugcuguuggacaacaucaauacgccagaggguauuauccccgccuuauuugaaccugagcgcgaaaaguccgcggcaaucgauggggaguauagacugaggggcgaggcccggaagaccuucguggaacucaugcgucgcggagaccugccaguuuggcuuagcuacaaagucgcuucagagggcuuucaauauagugaucgaagauggugcuucgacggggaaaggaacaaucaggugcuggaggaaaacauggauguggagauuuggacaaaggagggagaacggaaaaagcuccgccccagaugguuggacgccaggacuuacucugacccucuggcucuacgggaguuuaaagaguucgcagccggucgaagauccgucagcggcgaucugauacucgagaucgggaaacuuccgcagcaccugacccagcgcgcucaaaaugccuuagacaacuugguuaugcugcauaauucagaacagggaggcagggcauaucggcacgcgauggaggagcucccagauacaauugaaacccugaugcuucuggcccucaucgcuguguugacuggugggguaacgcuguuuuucuuaaguggccguggacuaggcaaaaccagcauugggcugcucugugugauggccuccucuguccuucuguggauggcaagcguggagccccauuggaucgcugccuccauaaucuuggaauuuuuccugaugguucuccugauuccugagcccgacagacagaggacaccacaggauaaccaacuugcauacguggucaucggacuccuguuuaugauuuugacuguagccgcuaaugagaugggucuguuagaaaccacaaagaaggaccuaggcaucgggcacguggcgguugagaaccaccaucacgccgcaaugcuggauguggaccuccauccugcuucagccuggacccuuuacgccgucgcaacuacaauaauuacgcccaugaugcgccacaccaucgaaaacacuacagcuaauauuucucugaccgccaucgcgaaccaggcugccauauugaugggacuggauaaaggcuggccaaucaguaagauggacauuggugugccucuccuggcacuugggugcuauucgcaggucaauccguuaacccugacagccgcugugcucauguugguugcacauuacgccaucauuggccccggacugcaagcgaaagcuacucgggaggcccagaagcgaacggcagccggcaucaugaaaaacccaaccguggaugggauaguagcuauugaccuagauccuguggucuaugacgccaaguucgaaaagcagcugggacagaucaugcuccuuauccuguguacaagccaaauuuugcugaugagaacuaccugggcacucugcgaguccaucacacuggcuaccggccccuuaacuacgcuuugggaggguucuccagggaaauuuuggaauacaaccauagccguuucaauggcgaacauuuucaggggaagcuaccuggccggcgcaggucucgcuuucucccuaaugaagagucugggcgggggacgccggggcacuggggcccagggagaaaccuugggcgagaaauggaagagacagcugaaucagcucucuaaaagcgaauuuaacacauauaagcguucagguaucauggagguggacagguccgaagcaaaggaggggcuuaaacggggagagacuaccaagcacgcugucagucgcggcacagccaaacugcgaugguucguggaaagaaauuugguaaagccugaggguaaagugauugaucugggcugugggaggggaggcuggagcuacuauugcgccgggcucaagaagguuacggaagugaaaggauacaccaagggcggucccgggcacgaggaaccgaucccaauggcgacuuacggauggaacuuagucaaacugcauucuggcaaggacguguuuuucauaccucccgagaaaugugauacacuucugugcgacaucggcgaguccucaccaaaucccaccauugaagaggggcggacucuacgcguccucaagaugguggaaccuuggcugagaggaaaccaauuuuguaucaaaauuuugaauccguauaugcccagcguuguagagacacuggagcagaugcagaggaagcacgguggcaugcucgugcgaaacccacuuucgagaaauucuacccaugaaauguacugggucaguugcgggacgggaaacaucguguccgcuguuaauaugaccagccguaugcuguuaaacagauucacaauggcacaccgcaagccuacuuaugagagggauguggaccugggcgccgguacccggcacgucgcuguggaacccgagguagccaacuuggauauuaucgggcagagaauagaaaauauuaaacaugagcacaagucaacauggcauuacgacgaggauaacccuuauaaaacuugggcauaccacggauccuaugaagugaagccaucuggcagcgccaguuccaugguuaauggcgucgugaaacuccugaccaagcccugggacgugaucccuauggucacacaaaucgcuaugaccgauacuacgccauuugggcagcagcgcguuuucaaggagaaaguggacacaaggacccccaaggcgaaacgaggaacugcccaaauuauggaaguaaccgcaaaguggcuaugggguuuucuuagccggaacaaaaagccgagaauauguacaagggaggaguucacgcgcaaggugcguucuaaugcugccaucggcgcagucuuuguggacgagaaccaguggaacucagccaaagaggcuguugaagaugagcgguucugggaccuggugcauagagaaagggagcuccacaagcaggggaaaugcgcaaccugcgucuacaacaugaugggaaagcgcgagaagaagcugggcgaguuugguaaggcgaaagggagucgagcaauuugguacaugugguugggagcccgguuccuggaguucgaagcucucggcuuuaugaaugaggaucacugguucuccagagaaaacagccuuucuggcguggagggggagggacugcauaaguuagguuauauccugagggacauuucgaaaaucccuggcgggaauauguacgccgaugacacugcaggaugggauacacgcauaaccgaagacgauuugcagaacgaggcuagaaucacugacauuauggaaccagagcacgcccuccuggcuaagucaaucuuuaaacuaacauaucaaaauaagguaguucgggugcagaggcccgccaaaaacggcaccgucauggaugugauuagccgucgagaccagcgcgguuccggacaggugggaacauacggccuuaauacuuucaccaacauggaagcacaacugaucagacagauggagagugagggcauauuuucuccuagcgaacucgagacgccaaaccuggcggaacgggucuuggauugguuagagaaguaugggguugaaaggcugaagcgcauggccauuuccggagacgacugugugguaaaacccaucgaugacagauucgcuaccgcccucacagcacuuaaugauauggguaaggugcggaaagacaucccgcagugggagccuucaaagggcuggaacgauuggcagcaaguccccuuuugcagucaucacuuccaccagcugauuaugaaagacgggagggagauagugguuccaugucgaaaucaggaugagcuagugggacgugcuagagucucucagggcgccgguuggagccugcgcgagacugcaugccucgggaaguccuacgcccaaauguggcaguugauguauuuucaucggagggaccugagacuugcggcuaacgccaucuguucagcagugccuguagauuggauucccaccagccgcacaacuuggucuauccacgcccaucaccaguggaugaccacggaagacaugcuguccguuuggaaucggguguggauugaggaaaacccauggauggaggauaagacacauaucaguagcuggggagacguccccuaccucggcaaaagggaggaccaauggugcggcucguuaauagggcugaccgcucgagccacuugggcaacaaauauccagguggcuauuaaccagguuagacgguugaucggaaaugaaaacuaccuggauuauaugaccuccaugaagagguucaaaaaugagucugacccugaaggugcccucugguga

SEQ ID NO: 13593 - RNA, 9879 nt, Artificial Sequence
  derived and/or modified CDS sequence (opt3) from DENV-1__FJ024442__SS-prME
agcgugaccaugcugcucaugcuuaugcccacagcccuggcuuuccacuugacuacgagaggaggggaaccucauaugaucgucuccaagcaggaaagggggaaaucuuuacuguuuaagaccucagccgguguuaacaugugcacacuaauugccauggaccucggcgaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauuaucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaaaaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccagacugcggggccguggcaucucggaaaacuggagcuugauuuuaacuugugcgaaggcacaaccguagucguggacgagcacugcgggaauagaggacccucccugaggacgacuaccgugacaggcaagaucauacacgaaugguguugccgcaguuguaccuuaccuccacuccgguucagaggugaggaugggugcugguauggaauggagauuaggcccgucaaagaaaaggaggaaaaccugguuaagagcauggugucugccggcuccggugagguagacucauuuagucuuggccuguuguguaucagcaucaugauugaagaggugaugcgcucgcgauggucccggaaaaugcucaugacugggacacuggcugucuucuuucuacugaucaugggacagcucaccuggaaugaccugauucgucuuugcauaauggugggcgccaacgcaucugauagaauggggaugggaacaacuuacuuggcucugauggccaccuucaagaugaggccuauguuugcaguuggcuuacucuuccgccggcugacgagcagagaggugcuucugcuaacaaucggucucucacuggucgccaguguggaauugccaaauucccuggaggaauuaggggacggacucgcuaugggcauuaugauccugaaacuucugaccgauuuucaaucucaucaguugugggcgacucuccugagccuaaccuucauuaagacaacuuuuucccugcacuaugccuggaaaaccauggcaaugguucuuucaaucgugagccucuucccccuguguuugaguacgacaucucagaagaccacuuggcugccggucuuacucggcucccuggggugcaagccucuuacaauguuucugauagcugagaacaaaaucuggggaaggcgaagcuggccauugaacgaagguauuauggccguaggcaucgugucgauucuccugucaucucuacugaagaaugacguuccccuugccgggccucucaucgcuggaggcaugcugauagcauguuacgugauuagugguuccagcgccgauuugucuuuagagaaagcggcugaggucagcugggaagaggaagccgagcauuccggggcaucacacaacauccugguggaaguacaggacgauggaaccaugaagaucaaagacgaggagcgcgaugacacucucacaauucugcuuaaggccacccuguuggcugugaguggcgucuauccccuaagcauaccagcaacgcuguucguuugguacuucuggcagaaaaagaagcagcggucuggcgugcucugggauacuccuucacccccagaaguggagagagccguccuggacgaugggaucuauaggauuaugcagcguggacuuuuaggucgcagccaggugggcguugggguauuucaagaaaauguguuccauaccauguggcacgucacacggggagcggugcugauguaccagggcaaaagacucgagccgaguugggcuagcguuaagaaagacuugaucuccuacggugggggauggaggcugcagggcucuuggaacaccggcgaggaagugcaggucauugccguggagccugggaagaaucccaaaaacguacaaacagcaccaggaacuuuuaagacccccgaaggugaggucggcgccaucgcucucgacuucaagccugggacgucgggaagcccaauagugaaucgagaaggccggaucguuggucuguaugggaacggaguggucacaacuucaggcaccuacguguccgccauugcacaggcuaaagccagucaggagggcccccuuccugagaucgaagaugagguuuuucgcaagagaaaucugacaauuauggacuugcacccggggucuggaaaaaccaggcgguaucuaccagcgaucgugcgagaagccauaaagagaaaacugcgcacucucauuuuagcacccaccagggucguggcuagcgagauggccgaagcucugaaggguaugccuauccguuaccaaacaacggcaguaaaguccgagcauacuggcaaagagaucguggaucuuaugugccacgccaccuucacaaugcggcugcucucaccaguuagaguccccaacuauaauaugauuaucauggacgaagcccauuuuaccgauccuucuagcauagcugcgaggggguacauuaguacucgcgugggaaugggcgaggcagccgcuaucuucaugacagccaccccgcccgguuccguggaagcauuuccacagagcaacgccgucauucaggacgaggaacgagauaucccugagagaucuuggaauuugggguaugaguggauaacggacuuccccggaaagacuguaugguuugugccaucaauuaaauccggcaacgauaucgcuaauugucugcggaagaacggcaaaaggguuauccagcucagucgcaagacauucgacaccgaauaccaaaagaccaaaaacaaugauugggacuacguggucacuacagacauuagcgagaugggggcgaacuuccgugccgauagagugaucgacccucggaggugccugaagcccguuauucuuaaagauggaccagaacgcgugauacuagcagguccgaugccugucaccguggcuucggccgcacagcgaagaggccggaucgggaggaaucacaacaaggagggagaccaguauauuuacaugggccagccccugaauaacgaugaggaccaugcccacuggacagaagcuaaaauguuguuagauaauaucaacacuccagaggguaucauucccgcccuguuugaaccugagcgcgaaaagucugcggcaauagacggggaguauagacucaggggcgaggcccggaagacguucguagaacugaugcgucgcggagaucuuccaguguggcuguccuacaaaguugcuagcgagggcuuucaauauucagaccgaagauggugcuucgauggggaaaggaauaaccagguccucgaggaaaauauggacguggagaucuggaccaaggagggagaacggaaaaaguugcgccccagauggcuggaugccaggacauacagugacccucuagcucugcgggaguuuaaagaguucgcagccggucgaagaucuguguccggcgaccucauucuugagaucgggaagcugccgcagcacuuaacucagcgcgcucaaaacgccuuggauaaucuggucaugcuccauaacagcgaacagggaggcagggcauaucggcacgcgauggaggagcugccagacaccauugaaacacuuaugcugcucgccuugaucgcuguucugaccgguggggugacuuuauuuuuccuaucaggccguggacugggcaaaacgaguauagggcuccuuuguguaauggccagcuccgugcuguuguggauggcaucugucgagccccauuggaucgcugccagcauuauccuggaauuuuuccucauggugcugcuuauuccugagcccgauagacagaggaccccacaggacaaucaacucgcauacguugugaucggacuguuguuuaugauacugacagucgccgcuaacgagauggguuuacuagaaacuaccaagaaggaucugggcauugggcacguagcgguggagaaccaccaucacgccgcaaugcucgacguugaucuucauccugcuuccgccuggacacuguacgccguggcaaccacuaucauuacacccaugaugcgccacacgaucgaaaauaccacugcuaacauaucauugacagccaucgcgaaucaggcugccauucugaugggacucgacaaaggcuggccaaucucuaagauggauauuggugucccucugcuugcauuagggugcuauagucaggugaacccgcugacccucaccgccgcugucuugaugcugguggcacauuacgccaucauaggccccggacuacaagcgaaagcuacacgggaggcccagaagcgaacugcagccggcauuaugaaaaauccaacgguugacgggaucguggcuaucgaucuggacccuguaguguaugaugccaaguucgaaaagcagcucggacagauuaugcuucugaucuuguguaccucgcaaauacugcucaugagaacaacuugggcacugugcgagagcauuaccuuagcuacaggcccccuuaccacucugugggaggguuccccagggaaauuuuggaacacgacaaucgccgucucuauggcgaauauuuucaggggaucauaccucgccggcgcaggucuagcuuucagccugaugaaguccuugggcgggggacgccggggcaccggggcccagggagaaacucugggcgagaaauggaagagacagcucaaccagcuuaguaaaucugaauuuaauaccuauaagcguagcgguaucauggagguugacaggucagaagcaaaggaggggcugaaacggggagagacaacuaagcacgcugugucccgcggcaccgccaaauugcgaugguucgucgaaagaaaccuggugaagccugaggguaaaguaauagaccucggcugugggaggggaggcuggaguuacuauugcgccggguuaaagaaggugacagaaguuaaaggauacacgaagggcggucccgggcacgaggaaccgaucccaauggcgaccuacggauggaaucuggugaaacuucauagcggcaaggaugucuuuuucauuccucccgagaaaugugacacucugcuaugcgauaucggcgagucuuccccaaaccccacaauugaagaggggcggacccuccgcgugcugaagauggucgaaccuugguugagaggaaaucaauuuuguaucaaaauucugaacccguauaugcccucagugguugagacucucgagcagaugcagaggaagcacgguggcaugcuuguacgaaauccacugagccggaacucgacacaugaaauguacugggugucuugcgggaccggaaauaucgucagugcugugaacaugacgucccguauguuacugaacagauucaccauggcacaccgcaagccuacauaugagagggacguugauuugggcgccgguacucggcacguggcugucgaacccgagguggccaaucucgacauaauugggcagagaaucgaaaacaucaaacaugagcacaagagcaccuggcauuacgaugaggacaauccuuauaaaacaugggcauaccacggaucauaugaaguaaagccauccggcucugccagcaguauggugaacggcguugucaaacugcuaacuaagcccugggaugugauuccuauggugacccaaauagcuaugacagacaccacuccauuugggcagcagcgcgucuucaaggagaaaguugauacgaggacacccaaggcgaaacgaggaaccgcccaaaucauggaagugacugcaaaguggcuuugggguuuucugucccggaauaaaaagccgagaauuuguaccagggaggaguucacacgcaagguacguagcaacgcugccaucggcgcaguguuugucgacgagaaucaguggaacucugccaaagaggcuguggaagacgagcgguucugggaucucguucauagagaaagggagcugcacaagcaggggaaaugcgccacgugcguguacaauaugaugggaaagcgcgagaaaaaguugggcgaguuugguaaggcgaaagggucacgagcaauuugguacauguggcugggagcccgguuccucgaguucgaagcucuuggcuuuaugaacgaggaccacugguucaguagagaaaauucccugagcggcgucgagggggagggauuacauaagcuggguuauaucuugagggauauaucuaaaaucccuggcgggaacauguacgccgacgauaccgcaggaugggacacucgcauuacagaagaugaccuccagaaugaggcuagaaucaccgauauuauggaaccagagcacgcccugcuagcuaagucgaucuuuaaacuuacuuaucaaaacaaggugguacggguucagaggcccgccaaaaauggcacagugauggacgucauaucacgucgagaucagcgcgguagcggacaggugggaaccuacggccugaacacauucacuaacauggaagcacaacucauuagacagauggaguccgagggcaucuuuaguccuucugaacuggagaccccaaauuuggcggaacggguguuagacuggcuggagaaguauggggucgaaaggcucaagcgcauggccaucagcggagaugacuguguugugaaacccauugacgauagauucgcuacggcccuuaccgcacugaacgacauggguaagguacggaaagauauaccgcagugggagccuuccaagggcuggaaugacuggcagcaagugcccuuuugcucacaucacuuccaccagcuaaucaugaaagaugggagggagauugucgugccaugucgaaaccaggacgaacugguuggacgugcuagagugagucagggcgccgguuggucucuccgcgagacagcaugcuugggaaagagcuacgcccaaauguggcagcugauguauuuucaucggagggaucuuagacuggcggcuaaugccaucuguuccgcagucccuguggacuggauucccacuucacgcaccacauggagcauccacgcccaucaccaguggaugacuaccgaagauaugcucucuguauggaaccggguuuggauagaggaaaauccauggauggaggacaagacgcauaucuccaguuggggagaugugcccuacuuaggcaaaagggaggaccaauggugcggcagccugauuggguugacagcucgagccaccugggcaacuaacauccaggucgcuauuaaucaggugagacggcugaucggaaacgaaaauuaccucgacuauaugacaucgaugaagagguucaaaaacgagggugauccugaaggcgcccuuugguga

SEQ ID NO: 13594 - RNA, 9879 nt, Artificial Sequence
  derived and/or modified CDS sequence (opt3) from DENV-1__FJ373296__SS-prME
agcgugacaaugcugcucaugcuuaugcccaucgcacuggcuuuccacuugacaacuagaggaggggaaccucauaugauugucuccaagcaggaaaggggaaaaucuuuacuguuuaagacgucagccgguguuaacaugugcaccuuaauagccauggaccucggcgaacugugugaagauacaaugacuuacaaaugcccacggaucaccgaggcggaaccggacgauguggacuguuggugcaaugcuacagauaccuggguaacuuaugggacauguagucaaaccggagagcaccgccgagacaagcguagcguggcccuugcaccccaugucggccuggguuuggagacgagaacugaaaccuggauguccucugagggggccuggaaacagauucagaggguggaaacaugggcucuccggcacccuggauucacuguuaucgcacuguuucuggcccaugcuauuggcaccucgaucacacagaagggcauaaucuucauucucuuaaugcuggugaccccaucaauggccaugcgcugcgucgggaucggaagcagagauuuuguggagggucuuaguggcgcgacguggguagacguuguguuggagcacggguccugugucacuacaauggcaaaggauaaacccacccuggacauugaauugcucaagacugaggugacaaacccugccgugcugaggaaacuuugcaucgaagcuaagauaucuaauaccacgaccgauagccgguguccaacacaaggagaggccacucuggucgaagaacaggacgcaaacuucguuugccgccgaaccuuuguggauagaggcugggguaauggguguggauuguucggcaaaggcucccucauuacaugcgcuaaguuuaagugcguaacuaaacuggaggggaagaucgugcaguacgaaaacuuaaaauauucagucauugugaccguucacacaggagaccagcaucaaguggguaaugagaguaccgaacacggcacuacggccacaaucacaccccaggcgccuacuaccgagauccagcugacagacuacggggcccucacccuugauuguagcccaaggacuggacuggacuucaacgaaauggucuugcuaacaaugaaggagaaaucuuggcuggugcauaagcagugguuucucgaucugccgcuucccuggacguccggcgcaucaaccagccaagagacuuggaaucggcaggaccuguugguaacauucaaaaccgcucacgccaagaagcaggaaguugugguccucgguagucaagagggggcuaugcacacagcccugacuggcgcaaccgaaauucagacgucuggaaccacaacuauauuugccggccauuuaaaaugccgucugaagauggauaaacuaacccucaaggggauguccuaugugauguguacaggaucguucaaacuggagaaggaagucgcugagacucagcacgguaccgugcuuguucagaucaaguacgagggcacggacgcgccuugcaaaauuccauucucgacacaagaugaaaagggggcaacccagaacggacgcuugaucacugccaaucccauagugacagacaaagagaagccuguaaacauugaagcugagccacccuuuggcgagucuuauaucgucaucggugccggggaaaaagcacugaagcucuccugguucaagaaaggcucaaguauuggaaagauguuugaggccaccgcuagaggcgccaggcggauggcaauccugggggauacugcgugggacuucggaagcauugguggcguguuuaccuccguugggaaacuugugcaucagauauucggaacagcuuacggcguccuguuuucuggugugagcuggacgaugaagaucgggauuggcguauugcucaccuggcugggauuaaauucacgaaguacuucccugagcaugacauguaucgccgugggccuaguuacccucuaccugggggucauggugcaggcagauucuggaugcgugaucaacuggaaaggccgcgaacuuaagugugguucagggauuuucgucacaaaugagguucacacuuggaccgaacaauauaaguuucaggccgacaguccgaaaagauugagcgcugccauaggaaaggcaugggaggagggcgugugcgguaucagguccgcuacgcggcuggaaaacauuauguggaaacagaucucuaacgagcucaaucauauucuguuagaaaacgacaugaagcugacagugguagucggcgauguggccgggauccuuggacagggcaaaaagaugauacgcccucaacccauggaguacaaauauucguggaaaagcugggggaaggcgaaaaucauuggagccgacgcucagaauaccacuuucaucauugauggcccaaacaccccugaaugucccgacgaucagagagcauggaauaucugggagguugaggacuacgguuuugggauauucacaacuaacauuugguugaagcucagggauuccuauacccaggugugcgaccaccgucugaugucagccgcuaucaaagauaguaaggccguccacgcagacaugggauacuggauugaaucugagaaaaaugaaacauggaagcuagcgcgggccagcuuuaucgaggugaagacguguauauggccaaaaucccauacccuguggucaaacggcguucucgaaagcgagaugaucauucccaagaucuaugguggcccuauuucucaacacaauuaccgaccaggguacuucacucagacagcuggaccguggcaucugggcaaacuugaguuggauuucgaccugugcgaagggaccacugugguagucgaugagcacugcggaaacagaggccccuccuuaaggacaaccacggugacugguaagaucauacacgaaugguguugccgcaguuguacccucccuccacugcgguuuagaggggaggacggaugcugguauggcauggagauuaggcccgugaaagaaaaggaggaaaaucuugucaagagcaugguuucugccgguuccggcgagguggacucauucagucugggguugcucuguaucagcaucaugauugaagagguaaugcgcucgcgauggucccggaaaaugcugaugacaggaacccuagcaguguuuuuccugcucaucaugggccagcugacuuggaacgaucuuauucguuugugcauaauggucggggcuaaugccucugacagaaugggaaugggcacaaccuaccuggcauuaauggccacauuuaagaugaggccuauguucgcugugggucuccuguuucgccggcuuacuagcagagagguucugcuacucaccaucgggcugucauugguggcgagugucgaacugccaaacuccuuagaggaacucggagauggccuggccaugggcauuaugauccuuaaacuguugacggacuuccaaucucaucagcucugggcaacacugcuaagccugaccuuuauuaagacuaccuucucccuucacuaugcuuggaaaacaauggccauggugcucucaaucguuagccuguuucccuugugucugaguacuaccucucagaagacgacaugguuaccggugcuccuggggucccuuggaugcaagccucugaccauguucuugauagccgagaauaaaaucugggguaggaaguccuggccacucaacgaaggcauuauggcugucgggaucguaucgauucugcuaucaucucugcuuaaaaacgaugugccccucgcaggaccucugaucgccggcgguauguugauagcguguuacguuauuaguggguccagcgcugacuuaucucuggagaaggccgcagaggugagcugggaagaggaagccgagcauuccggagcuucacacaauauccucgucgaagugcaggaugacggcacuaugaaaaucaaggaugaggagcgagacgauacacugaccauucuucugaaagcaacuuugcuagccguaaguggcguguauccccugagcauaccagcgacacucuuugucugguacuucuggcaaaagaagaaacagcgcucugggguucugugggacaccccuucacccccagaaguggagcgggcugugcuugaugacggaaucuauagaauuaugcagagggguuuacugggccguagccaggucggggugggaguuuuccaagaaaacguauuucauacgauguggcacgugacucgcggcgccguccucauguaccaggguaagcgguuggagccgaguugggcaagcgugaaaaaggaccugaucuccuacgggggaggcuggagacucaggggcucuuggaauaccggggaggaaguucaggugauugccgucgagccuggcaaaaaucccaagaaugugcagacagcuccagguaccuucaagacacccgaaggcgagguaggggccaucgcacuggauuuuaaaccuggaacuucgggcagcccaauagucaaccgagaagguaagaucguggggcuuuauggaaauggcguugugaccacgucaggcacauacgucuccgcuauugcccaagcgaaagccagucaggaggggccccugccugagaucgaagacgagguguuccggaagcgcaacuugacuauuauggaucuacacccgggaucugguaaaaccagaagguaucugccagcaaucguucgggaagcuauaaagcgaaagcucagaacauuaauucuggcccccacccgcguggucgcuagcgagauggcagaagcccuuaaaggcaugccuaucagguaccagacuaccgccgugaaguccgagcauacagggaaagagaucguagaccugaugugccacgcuacguuuacuaugcgucucuugucaccagugcggguucccaauuauaacaugauuaucauggaugaagcgcauuucaccgacccuucuagcauagcagccagaggauacauuaguacaagggucggcaugggugaggcugccgcaaucuuuaugaccgccacuccgcccggguccguggaggcuuucccacaaagcaaugcggugauucaggaugaggaacgcgacaucccugagcgaucuuggaacucaggauaugaguggauaacagauuuucccggcaagaccgucugguucguaccauccauuaaaaguggcaaugacaucgccaacugucugagaaagaaugggaagcgggugauccagcucagcaggaaaacguuugauacugaauaccagaagaccaaaaacaacgacugggacuacguugugaccaccgauauuucggagaugggagcaaauuuccgcgcugaccgugucaucgauccuagacggugccugaagcccgugauucuuaaagacgguccagaaaggguuauacuagccggcccgaugccugugacugucgcaucugccgcucaacgccgagggagaaucggacggaaccacaauaaggagggcgaucaguauauuuacaugggucagccccugaacaaugacgaggaucaugcccacuggacagaagcgaagauguuguuagacaacaucaauaccccagaggggaucauucccgcacuguucgaaccugagagggaaaaauccgccgcuguggauggcgaguaucgccucagaggagaggccaggaagacauuuguagaacugaugcggcguggcgaccuuccaguguggcugagcuacaaaguugcuucagagggguuccaguauagugaucgccgauggugcuuugacggagaaagaaacaaucaaguccucgaggaaaacauggauguggagauauggacuaaggagggugaaaggaaaaaguugcggccccgcuggcuggacgcaagaacguacucugacccucuagcccugagggaguucaaagaauuugcugccggccggcgauccgugagcggggaucucauccuugagauuggaaagcugccgcagcacuuaacccagagagcacagaaugcguuggacaaccuggucaugcuccauaauucagaacaaggcggucgcgccuauaggcacgcuauggaggagcugccagauacaaucgaaacucuuaugcugcucgccuugauugcaguucugaccgggggcgugacauuauucuuucuaaguggacggggccuggggaagaccagcaucggacuccuuuguguaauggcuuccucugugcuguuguggauggccagcgucgagccccauuggauagcagccuccaucauucuggaguucuuucucauggugcugcuuaucccugagcccgaccgucagagaacuccacaggauaaccagcucgcuuacguugugauuggucuguuguucaugauccugacggucgcggccaaugagaugggcuuacuagaaaccaccaaaaaggaccuggggauaggacacguagcaguggagaaccaccaucacgcugccaugcucgauguugaccuucauccugccucagcauggacucuguacgcuguggccaccacaauuaucacccccaugaugaggcacacuauugaaaacacaacggcgaauaucucuuugaccgcuauagccaaccaagcagccauccugaugggccucgauaaagguuggccaauuaguaagauggacaucggggucccucugcuugcuuuaggcugcuauagccaggugaauccgcugacucucacagcagccgucuugaugcugguggcgcauuacgcuauuaucggacccggccuacaggccaaagcaacccgcgaggcccaaaagcggaccgcugccgggauaaugaagaacccaacaguugauggaauuguggcaaucgaccuggauccuguaguguaugacgcuaaauuugaaaagcagcucggccagaucaugcuucugauuuuguguacuagccagauccugcucaugcgaacgaccugggcccugugcgaguccauaacauuagcgacugguccccuuaccacacugugggaggggucuccaggaaaauucuggaauaccacuauugccgucucaauggcaaacaucuuuagaggcagcuaccucgcuggugccggccuagcauucucccugaugaagagucuagggggaggcaggcgcgggacgggagcucaaggcgaaacacugggugagaaauggaagcggcagcucaaucagcuuucuaagagcgaguucaacaccuauaaaagaucagggauuauggagguugaccguuccgaagccaaggagggacugaaaaggggcgagacuaccaagcacgccgugagucgggguacagcgaaauugcgcugguuugucgaacgaaaucuggugaagccugagggcaagguaaucgaucucggguguggaagaggcggguggagcuacuauugcgcuggacuaaagaaggugacugaaguuaaaggcuacaccaagggugggcccggacacgaggaaccgauaccaauggcaacauacggcuggaaccuggugaaacuucauucuggcaaggacgucuucuuuaucccucccgagaaaugugauacgcugcuaugcgacauuggggaguccucaccaaaucccaccaucgaagagggaaggacucuccgggugcugaagauggucgaaccuugguugcgcgguaaccaguucuguauuaagauccugaauccguauaugcccagcgugguugagacacucgagcaaaugcagagaaaacacggcgggaugcuuguaaggaacccacugucgcgaaauucuacccaugaaauguacugggugaguugcggaacuggcaacauugucuccgccgugaauaugacaagccggauguuacugaaccguuuuaccauggcucacagaaagccuacguaugagcgcgauguugacuuggguaccgggacaaggcacguggccgucgaacccgagguggcaaaccucgauaucauaggacagcggauugaaaauaucaaacaugagcacaagucaacuuggcauuacgacgaggauaacccuuauaaaaccugggccuaccacggcuccuaugaaguaaagccaucuggcagcgcuaguuccauggugaaugggguugucaagcugcuaacaaaacccugggacgugaucccuauggugacucagauugcgaugaccgauacaaccccauucggacaacagagagucuuuaaggagaaaguugacacucgcacgcccaaggccaaaagggguacagcacagauaauggaagugaccgcucgauggcuuuggggcuuccugagccggaacaagaagccgagaaucuguacuagggaggaauuuacccgcaaaguacguucuaaugccgcaauuggggccguguucgucgacgagaaccaauggaacucagcuaaggaggccguggaagaugagcgguuuugggaccucguucauagagaaagggagcugcacaaacagggaaagugcgcgacaugcguguacaacaugaugggcaaacgcgaaaagaaguugggugaguucgggaaagcaaagggaagucgagccaucugguacauguggcugggcgcucgguuucucgaguucgaagcccuuggcuucaugaaugaggaucacugguuuuccagagaaaacagccugucuggggucgagggagaggguuuacauaaacugggcuauauuuugagggacaucucgaagauaccugggggaaauauguacgcagaugacacggcuggcugggauacccgcaucacugaagacgaucuccagaacgaggccaaaauuacagacaucauggaaccagagcacgcucugcuagccaaggcaauuuucaaacuuaccuaucagaauaaggugguaagaguucaacggcccgcgaagaacgguacugugauggaugucaucucaaggcgugaccagcgagggagcggacaggugggcacauacggccugaauaccuuuacaaacauggaagcccagcucauacgccaaauggaguccgaggggauuuucaguccuucugaacuggagacuccaaacuuggcugaaagagccuuagauuggcuggagaaauauggaguggaacggcucaagaggauggcaaucagcggugacgacugugucguuaaacccaucgaugaccgcuuugcuaccgcccuuacggcacugaaugauaugggcaaggugagaaaagacauuccgcagugggagccuuccaagggguggaacgauuggcagcagguacccuucugcucacaucacuuucaccaacuaauaaugaaggacggacgggagaucguggucccauguaggaaucaggaugaacuggugggccgagcccguguuagucagggugcgggguggucucucagagagaccgcuugcuugggaaaaagcuacgcccagauguggcaacugauguauuuccaucgccgggaccuuaggcuggcagccaacgcuauuuguuccgccgugccugucgauugggugcccacaucaagaacuaccuggagcauccacgcacaucaccaguggaugacaacugaagacaugcucucuguauggaaucgcguuuggauugaggaaaacccauggauggaggauaagacccauaucuccaguugggaggacgugcccuacuuaggcaaacgggaagaccaguggugcggcagccugauaggguugacggcuagggccacaugggcgaccaauauccaagucgcuauuaaccaggugcgaagacugaucggaaaugagaacuaccucgauuauaugacuucgaugaagcgguuuaaaaaugaauccgacccugagggugcccuuugguga

SEQ ID NO: 13595 - RNA, 9879 nt, Artificial Sequence
  derived and/or modified CDS sequence (opt3) from DENV-1__FJ182018__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauuaucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaaaaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauucccacacgcaggucugcgaccaccgucucaugucagcugcaaucaaagauaguaaggccgugcaugcugacaugggguauuggauugaaucugagaaaaaugaaaccuggaagcuggcccgggcauccuucaucgagguuaagacuuguauauggccaaaaucccacacacuauggucaaacggagugcuggaaagcgagaugaucauucccaagaucuacggcgguccuauuucucaacauaauuaucgaccaggcuacuucacccagacugcggggccguggcaccucggaaaacuggagcuugauuuugacuugugcgaaggcacaaccguagucguggaugagcacugcgggaacagaggacccucccugaggacgacuaccgugacaggcaagaucauacaugaaugguguugccgcaguuguaccuuaccuccacuccgguucagaggugaggacgggugcugguacggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuucuuucuacugaucaugggacagcucaccuggaacgaucugauucgucuuugcauaauggugggcgccaaugcaucugacagaauggggaugggaacaacuuauuuggcucugauggccaccuucaagaugaggccuauguuugcaguuggcuuacucuuccgccggcugacgagcagagaggugcuucugcuaacaaucggucucucacuggucgccaguguggaauugccaaacucccuggaggaauuaggggauggacucgcuaugggcauuaugauccugaaacuucugaccgacuuucaaucucaccaguugugggcgacucuccugagccuaaccuucauuaagacaacuuuuucccugcauuacgccuggaaaaccauggcaaugguucuuucaaucgugagccucuucccccuguguuugaguacgacaucucagaagaccacuuggcugccggucuuacucggcucccuggggugcaagccucuuacaauguuucugauagcugagaauaaaaucuggggaaggcgaagcuggccauugaacgaagguauuauggccguaggcaucgugucgauucuccugucaucucuacugaagaacgauguuccccuugccgggccucucaucgcuggaggcaugcugauagcauguuaugugauuagugguuccagcgccgacuugucuuuagagaaagcggcugaggucagcugggaagaggaagccgagcacuccggggcaucacauaauauccugguggaaguacaggaugacggaaccaugaagaucaaagaugaggagcgcgacgauacucucacaauucugcuuaaggccacccuguuggcugugaguggcgucuacccccuaagcauaccagcaacgcuguucguuugguauuucuggcagaaaaagaagcagcggucuggcgugcucugggacacuccuucacccccagaaguggagagagccguccuggaugacgggaucuacaggauuaugcagcguggacuuuuaggucgcagccaggugggcguugggguauuucaagaaaacguguuccacaccauguggcacgucacacggggagcggugcugauguaucagggcaaaagacucgagccgaguugggcuagcguuaagaaagacuugaucuccuacggugggggauggaggcugcagggcucuuggaauaccggcgaggaagugcaggucauugccguggagccugggaagaaccccaaaaauguacaaacagcaccaggaacuuuuaagacccccgaaggugaggucggcgccaucgcucucgauuucaagccugggacgucgggaagcccaauagugaaccgagaaggcaaaaucguuggucuguacgggaauggaguggucacaacuucaggcaccuauguguccgccauugcacaggcuaaggccagucaggagggcccccuuccugagaucgaagacgagguuuuucggaaacgcaaccugacaauuauggauuugcauccggggucuggaaagaccagaagguaccuaccagcgaucgugcgggaagccauaaaacgaaagcugagaacucucauuuuagcacccacccgcgucguggcuagcgagauggccgaagcucugaaggguaugccuaucagguaucaaacaacggcaguaaaauccgagcacacuggcaaggagaucguggaccuuaugugccaugccaccuucacaaugcgucugcucucaccaguucggguccccaauuacaacaugauuaucauggaugaagcccacuuuaccgacccuucuagcauagcugcgagaggguauauuaguacuagggugggaaugggcgaggcagccgcuaucuucaugacagccaccccgcccgguuccguggaagcauuuccacagagcaaugccauuauccaggaugaggaacgcgacauaccugagcgaucuuggaacucaggguacgaguggauuacggauuuccccggaaaaacugucugguuuguaccauccaucaagaguggcaaugacaucgcuaacuguuugaggaaaaauggcaagcgggugauucagcugagcaggaagacauucgauaccgaauaucagaaaaccaagaacaacgacugggacuacguugugacuacagauaucucggagaugggggcgaauuuccgcgccgaccgugucauugauccuagacggugccucaaacccgugauacugaaggacggaccagaaaggguuauccuugcagguccgaugccugugaccgucgcuucugccgcacagcgccgaggcagaauugggcggaaccauaauaaagagggagaucaguacaucuauaugggccagccccuaaacaaugacgaggaucacgcccacuggacagaagcuaagaugcuguuggacaacaucaauacuccagaggguauuauacccgccuuauuugaaccugagagggaaaaguccgcggcaaucgauggggaguaccgccugagaggcgaggccaggaaaacguucguggaacucaugcggcguggagaccugccaguauggcuuagcuauaagguggcuucagagggcuuucaauacagugaucgccgauggugcuucgacggggaaagaaacaaucagguucuggaggaaaacauggaugucgagauuuggaccaaagagggagaaaggaagaaacuccggccccgcugguuggacgccagaacauauucugacccucuggcucuaagggaguuuaaggaguucgcagccggucggcgauccgugagcggcgaucugauccucgagauugggaaacuuccgcagcaucugacucagagagcucaaaaugccuuagacaacuuggugaugcugcacaauucagaacagggaggccgcgcauacaggcaugcgauggaggagcucccagauaccaucgaaacacugaugcuucuggcccucauagcugucuugaccggugggguuacucuguuuuucuuaaguggccggggacuaggcaagacgagcaucgggcugcucugugugauggccuccucuguacuucuguggauggcaagcguggagccccacuggauugcugccuccaucauuuuggaauuuuuccugaugguccuccugaucccugagcccgaccgucagagaaccccacaggauaaccaacuugcauaugugguuauaggacuccuguuuaugauuuugacaguggccgcuaaugagaugggucuguuagaaacuaccaagaaagaccuaggcaucgggcacgucgcgguagagaaccaucaccaugccgcaaugcuggauguggaccuccacccugcuucagccuggacacuuuacgccguugcaaccacuauuaucacacccaugaugaggcauacgauagaaaacaccacugcuaauaucucucugacagccauugcgaaccaggcugccaucuugaugggacuggauaagggcuggccaauuaguaaaauggacaucggugugccucuccuggcacuugggugcuacucgcaggucaauccguuaacccugaccgccgcugugcucauguuggucgcacacuaugccauaauuggccccggacugcaagcgaaggcuacacgcgaggcccagaaacggacugcagccggcaucaugaagaacccaacgguggaugggaucguugcuauugaccuagauccugugguauacgacgccaaguucgaaaaacagcugggacagaucaugcuccuuauacuguguaccagccaaauuuugcugaugcgaacaacuugggcacucugcgaguccaucacccuggcuacaggccccuuaaccacucuuugggaggguucuccagggaaguuuuggaauacgacaauugccgugucaauggcgaacaucuucagaggaagcuaucuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuacaagagaucagguauaauggaggucgaccguuccgaagcaaaagaggggcuuaagaggggagagacaacuaaacacgcuguuagucggggcaccgccaagcugcgcugguucguggaacgaaauuuggucaaaccugaggguaaggugaucgaucugggcugugggagaggaggcuggagcuauuacugcgccgggcucaagaaaguaacagaagugaagggauauacgaaaggcggucccgggcaugaggaaccgauuccaauggcgaccuacggauggaacuuaguuaagcugcacucuggcaaagacguguuuuucaucccucccgagaagugugauacucuucugugcgacauuggcgaguccucaccaaaucccacaaucgaagaggggaggacccuacggguccucaaaaugguggaaccuuggcugcgcggaaaccaauuuuguauuaagaucuugaauccguacaugcccagcgucguggagacucuggagcagaugcagagaaagcaugguggcaugcucguuaggaacccacuuucgcgaaauucuacacacgaaauguauuggguaaguugcgggaccggaaacauaguguccgcugucaauaugacgagccggaugcuguuaaaccguuucaccauggcacacagaaaaccuacauacgagcgcgauguggaccugggcgccgguacuaggcauguugcuguggaacccgaggucgccaacuuggauauuaucgggcagcggaucgaaaauauuaagcacgagcauaaaucaaccuggcacuaugacgaggauaacccuuacaagacaugggcauaucauggauccuacgaagugaaaccaucuggcagcgccaguuccaugguaaauggcgugguuaagcuccugacuaagcccugggacgucauaccuauggugacccaaaucgcuaugacagauaccacuccauuugggcagcagagaguguucaaagagaaggucgacacgcgcacacccaaagcgaagaggggaaccgcccaaauuauggaaguuacugcaaaauggcuaugggguuuucuuagccgaaacaagaagccgcggaucuguaccagagaggaguucacaaggaaagugcgcucuaaugcugccauuggcgcaguauuuguggacgagaaccaguggaacucagccaaggaggcugucgaagaugagcguuucugggaccuggugcaccgggaaagagagcuccacaaacaggggaagugcgccacgugcguuuauaacaugaugggaaaaagggaaaagaagcugggcgaguuugguaaagcgaaggggagucgcgcaaucugguacaugugguugggagcccgauuccuggaguucgaagcucucggcuuuaugaaugaggaucauugguucucccgggaaaacagccuuucuggcguggagggggagggacugcacaaauuagguuacauacugagagacaucucgaagauuccuggcgggaauauguaugccgaugacaccgcaggaugggauacuaggaucacagaagacgauuugcagaacgaggcucgcauuaccgacaucauggaaccagagcaugcccuccuggcuaaaucaauauuuaagcuaacuuaccaaaauaaagucgugagaguacagcggcccgccaagaacggcacaguuauggaugugauuagcaggcgugaccagcgagguuccgggcaggucggaaccuauggccuuaauacauucacuaacauggaagcacaacugauccgccagauggagagugagggcaucuuuucuccuagcgaacucgagaccccaaaccuggcggaaagaguguuggauugguuagagaaguacgggguggaacggcugaaaaggauggccauuuccggagacgacugugucguuaagcccauagaugaccgcuucgcuacggcccucaccgcacuuaaugauauggguaaagugagaaaggacaucccgcagugggagccuucaaaaggcuggaacgauuggcagcaaguacccuuuugcagucaccacuuccaucagcugauuaugaaggacgggcgggagaucguggucccauguaggaaucaggaugagcuagugggacgagcucguguuucucagggcgccgguuggagccugagagagacagcaugccucgggaaguccuaugcccaaauguggcaguugauguacuuucaccgccgggaccugaggcuugcggcuaacgccauuuguucagcagugccugucgauuggauccccacuagcagaaccacauggucuauacaugcccaccaucaguggaugacuaccgaagacaugcuguccguguggaaucgcguauggaucgaggaaaacccauggauggaggauaaaacgcacauuaguagcuggggagacguucccuaucucggcaagcgggaggaccaauggugcggcucguuaaucgggcugacagcuagggccaccugggcaacuaauauucagguggcuaucaaccagguccgaagauugauuggaaaugaaaacuaccuggauuacaugacauccaugaaacgguucaagaaugagggugacccugaaggcgcccucugguga

SEQ ID NO: 13596 - RNA, 9879 nt, Artificial Sequence
  derived and/or modified CDS sequence (opt3) from DENV-1__FJ410287__SS-prME
agcgugaccaugcugcucaugcuuaugcccacggcacuggcuuuccacuugacuacgagaggaggggaaccucauaugaucgucuccaagcaggaaagagggaaaucuuuacuguuuaagaccucagccgguguuaauaugugcacacucauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacugcucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuaccagccaggcccccacaaccgagauccagcugacugacuacggggcgcucacacuugauuguucuccuaggacgggacuggacuucaacgaaauggucuugcuaaccaugaaggagaaauccuggcuggugcauaagcagugguuucucgaucugccacuuccguggacuucaggcgccagcacaagucaagagaccuggaaucggcaggaccuguugguaacauucaaaacugcacacgcuaagaagcaggaaguugugguccucgguucucaagagggggccaugcacaccgcucugacgggcgccaccgaaauccagacauccggaacuaccacaauuuuugcaggccauuuaaaaugccgucugaagauggauaaacuaacucucaaggggaugagcuaugugauguguaccggaucguucaaacuggagaaggaagucgccgagacgcagcacgguacagugcuuguucagauaaaguacgagggcaccgacgcucccugcaaaaucccuuucuugacucaagaugaaaagggggugacacagaacggacgccugauuaccgcgaauccaaucguaacugacaaagagaagcccgucaacauagaagcagagccuccauuuggcgagucuuauauuaucaucggugccggggaaaaagcucucaagcuguccugguucaagaaaggcucaaguauuggaaagauguuugaggccaccgcaagaggcgccaggcggauggcuauccuuggggauacagccugggacuucggaagcauugguggcguguuuacguccguugggaaacuggugcaucagauauucggaaccgcauacggcgucuuguuuucuggugugagcuggacuaugaagaucgggauuggcguacuccugacaugguuaggacuaaauucacgaaguaccucccuaagcaugacauguaucgcggugggccucguuacucuguaccuuggggucauggugcaggcugauucuggaugcgugaucaacuggaaaggccgcgaauugaagugugguucagggauuuucgucaccaaugagguucacacguggacagaacaauauaaguuucaggccgacagucccaaaagacugagcgcagccauaggaaaggcuugggaggagggcgugugcgguaucagguccgccacccggcucgaaaacauuauguggaaacagaucucuaacgagcugaaucauauuuuacuggaaaacgacaugaaguucacugugguagucggcgauguggcagggauccuugcucagggcaagaagaugauacgcccgcaaccuauggaguacaaauauucguggaaaagcuggggcaaggccaagaucauuggggcggacguucagaauaccacauuuaucauugauggacccaacacuccagaauguccugacgaucagagagccuggaauaucugggagguggaggacuacggcuucgguauauuuaccacaaacauuugguugaagcucagggauuccuauacgcaggucugcgaccaccgucugaugucagcugcaaucaaagauaguaaggccgugcacgcugacaugggguacuggauugaaucugagaaaaaugaaaccuggaagcuagcccgggccucguucaucgagguuaagacuuguauauggcccaaaucccauacacuguggucaaacggagugcucgaaagcgagaugaucauuccaaagaucuauggcggucccauuucucaacacaauuaccgaccuggcuacuucacccagacugcggggccauggcaucugggaaaacuugaguuggauuuugaccugugcgaaggcacaaccguagucguggaugagcacugcgggaacagaggaccguccuuaaggacgacuaccgugacaggcaagaucauacacgaaugguguugccgcaguuguacccuacccccucugcgguucagaggugaggacgggugcugguauggaauggagauuaggccagucaaagaaaaggaggaaaaucuuguuaagagcauggugucugccggcuccggugagguagacucauuuagucugggcuugcucuguaucagcaucauuaucgaagaggugaugcgcucgcgauggucccggaaaaugcugaugacugggacacuagcugucuucuuucugcucauuaugggacagcugaccuggaacgaucuuauacguuugugcaucauggugggcgccaaugcaucugacagaauggggaugggaacaacuuaccuggcuuuaauggccaccuucaagaugaggcccauguuugcaguuggccuccuguuccgccggcuuacgagcagagaggugcugcuacucacaauuggucugucauuggucgccaguguggaacugccuaacuccuuagaggaacucggggauggacuggcuaugggcaucaugauucuuaaacuguugaccgacuuucaaucucaucagcucugggcgacucugcuaagccugaccuucaucaagacaacuuuuucccuucacuaugccuggaaaaccauggcaaugguucucucaauagugagccuguucccauugugucugaguacgacaucucagaagaccacuugguuacccguccuccugggcucccuugggugcaagccgcugacaauguuuuugaucgcugagaauaaaauuuggggaaggcgaagcuggccucucaacgaagguaucauggccguaggcauugugucgauccugcuaucaucucugcuuaagaacgauguuccacucgccgggccccugauagcuggaggcauguugauugcauguuacgugaucagugguuccagcgccgacuuaucucuggagaaagcggcugaggucagcugggaagaggaagccgagcauuccggggcaucacacaauauccucguggaaguacaggaugacggaaccaugaagauuaaagaugaggagcgcgacgauacucugacaauacuucugaaggccaccuugcuagcugugaguggcgucuauccucugagcauccccgcaacacucuucguuugguacuucuggcagaagaagaagcagcggucuggcgugcugugggacacuccauccccucccgaaguggagagagccguccuugaugacgggauuuauaggaucaugcagcguggauuacugggucgcucacaggugggcguugggguauuucaagaaaacguguuccauaccauguggcacgucacacggggagcggugcucauguaccagggcaaaagauuggagccaaguugggcuagcguuaagaaagaccugauuuccuacggugggggauggaggcuccagggcucuuggaauaccggcgaggaagugcaggucaucgccguggagccggggaagaacccuaaaaauguacaaacagcacccggaacuuuuaagaccccagaaggugaggucggcgccauagcucuggauuucaagcccgggacgucgggaagcccuaucgugaaccgagaaggcaaaauuguuggucuuuaugggaauggaguggucacaacuucaggcaccuacguguccgccaucgcacaggcuaaggccagucaggagggcccacugcccgagauugaagacgagguuuuucggaaacgcaacuugacaaucauggaucuacacccugggucuggaaagaccagaagguaucugccggcgauagugcgggaagccauuaaacgaaagcucagaacuuuaauccuggcaccaacccgcgucguggcuagcgagauggccgaagcucuuaaggguaugcccaucagguaccaaacaacggcaguaaaauccgagcauacuggcaaggagauuguggaccugaugugccacgccaccuucacaaugcgucucuugucaccuguucgggucccaaauuauaacaugaucauaauggaugaagcccauuuuaccgaccccucuagcauugcugcgagaggguacaucaguacuagggugggaaugggcgaggcagccgcuauuuucaugacagccaccccuccggguuccguggaagcauuuccccagagcaaugccgucauccaggaugaggaacgcgacauaccagagcgaucuuggaacucaggguaugaguggauuacggauuucccuggaaaaacuguaugguuugugcccuccaucaagaguggcaaugacaucgcuaacugucugaggaaaaauggcaagcggguuauucagcucagcaggaagacauucgauaccgaauaccagaaaaccaagaacaacgacugggacuacguggucacuacagauaucucggagaugggggcgaauuuccgcgccgaccgugugauugauccaagacggugccugaaaccuguuauacuuaaggacggacccgaaagggugauccuagcagguccaaugccggucaccguggcuucugccgcacagcgccgaggcagaauugggcggaaccacaauaaagagggagaucaguauaucuacaugggccagccucugaacaaugacgaggaucaugcccacuggacagaagcuaagauguuguuagacaacaucaauacucccgaggguauuauaccagcccuguuugaacccgagagggaaaaguccgcggcaaucgauggggaguaucgccucagaggcgaggccaggaaaacguucguagaacugaugcggcguggagaccuuccuguguggcugagcuacaagguugcuucagagggcuuucaauauagugaucgccgauggugcuucgacggggaaagaaacaaucagguccucgaggaaaacauggauguggagauuuggaccaaagagggagaaaggaagaaauugcggccacgcuggcuggacgccagaacauacucugacccccuagcucugagggaguuuaaggaguucgcagccggucggcgauccgugagcggcgaucucauccuugagauugggaaacugccucagcacuuaacucagagagcucaaaaugccuuggacaaccuggucaugcuccauaauucagaacagggaggccgcgcauauaggcacgcgauggaggagcugccggauaccaucgaaacacuuaugcugcucgccuugauagcuguucugaccgguggggugacuuuauuuuuccuaaguggccggggacugggcaagacgagcaucgggcuccuuuguguaauggccuccucugugcuguuguggauggcaagcgucgagccacauuggauugcugccuccaucauucuggaauuuuuccucauggugcugcuuauccccgagccugaccgucagagaacaccccaagauaaccaacucgcauacguugugauaggacuguuguuuaugauucugaccgucgccgcuaaugagauggguuuacuagaaacuaccaagaaagaccugggcaucgggcacguagcgguggagaaccaccaucacgccgcaaugcucgauguugaccuucauccagcuucagccuggacacuguacgccguggcaaccacuauuaucacaccuaugaugaggcacacgauagaaaacaccacugcuaauaucucuuugacagccauugcgaaccaggcugccauccugaugggacucgauaagggcuggcccauuaguaaaauggacaucggugucccacugcuugcauuagggugcuauagccaggugaauccucugacccucaccgccgcugucuugaugcugguggcacauuacgccauaauuggcccgggacuacaagcgaaggcuacacgcgaggcccagaaacggacugcagccggcaucaugaagaaccccacgguugaugggaucguggcuauugaccuggauccaguaguguaugacgccaaguucgaaaaacagcucggacagaucaugcuucugauauuguguaccagccaaauucugcucaugcgaacaacuugggcacugugcgaguccaucaccuuagcuacaggcccucuuaccacucugugggaggguucucccgggaaguuuuggaauacgacaauugccgucucaauggcgaacaucuucagaggaagcuaccucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuauaagagaucagguauaauggagguugaccguuccgaagcaaaagaggggcugaagaggggagagacaacuaaacacgcugugagucggggcaccgccaaguugcgcugguucgucgaacgaaaucuggugaaaccagaggguaagguaaucgaucucggcugugggagaggaggcuggagcuacuauugcgccggguuaaagaaagugacagaaguuaagggauacacgaaaggcgguccugggcacgaggaacccauuccgauggcgaccuacggauggaaccuggugaaacuucauucuggcaaagacgucuuuuucaucccaccugagaagugugauacucugcuaugcgacauuggcgaguccucacccaauccaacaaucgaagaggggaggacccuccgggugcugaaaauggucgaacccugguugcgcggaaaccaauuuuguauuaagauccugaauccuuauaugccgagcgugguugagacucucgagcagaugcagagaaagcacgguggcaugcuuguaaggaacccccugucgcgaaauucuacacaugaaauguacugggugaguugcgggaccggaaacauagucuccgcugugaauaugacgagccggauguuacugaaccguuucaccauggcacacagaaaaccaacauaugagcgcgauguugacuugggcgccgguacuaggcacguggcugucgaaccugagguggccaaccucgauauuaucgggcagcggaucgaaaauauuaagcaugagcacaaaucaaccuggcauuacgacgaggauaaccccuauaagacaugggcauaccacggauccuaugaaguaaaaccuucuggcagcgccaguuccauggugaauggcguugucaagcugcuaacuaagccaugggacgugauacccauggugacccaaaucgcuaugacagauaccacuccuuuugggcagcagagagucuucaaagagaagguugacacgcgcacaccaaaagcgaagaggggaaccgcccaaauuauggaagugacugcaaaauggcuuugggguuuucugagccgaaacaagaagccccggaucuguaccagagaggaguucacaaggaaaguacgcucuaaugcugccauuggcgcaguguuugucgacgagaaccaguggaacucagccaaggaggcuguggaagaugagcguuucugggaccucguucaucgggaaagagagcugcacaaacaggggaagugcgccacgugcguguacaacaugaugggaaaaagggaaaagaaguugggcgaguuugguaaagcgaaggggagucgcgcaaucugguacauguggcugggagcccgauuccucgaguucgaagcucuuggcuuuaugaaugaggaucacugguucucccgggaaaacagccugucuggcgucgagggggagggauuacauaaacuggguuauauauugagagacaucucgaagauuccgggcgggaauauguacgccgaugacaccgcaggaugggauacuaggaucacagaagacgaucuccagaacgaggcucgcauuaccgacaucauggaaccugagcacgcccugcuagcuaaaucaauauuuaaacuuacuuaucaaaauaaagugguaagaguucagcggccagccaagaacggcacagugauggaugucauuagcaggcgugaccagcgagguuccggacaggugggaaccuacggccugaauacauucacuaacauggaagcacaacucauccgccagauggagagugagggcaucuuuucucccagcgaacuggagaccccuaacuuggcggaaagaguguuagauuggcuggagaaguauggggucgaacggcucaaaaggauggccauuuccggagacgacuguguugugaagccaauagaugaccgcuucgcuacggcccuuaccgcacugaaugauauggguaaaguaagaaaggacaucccccagugggagccgucaaaaggcuggaacgauuggcagcaagugccuuuuugcagucaucacuuccaccagcuaauuaugaaggacgggcgggagaucgucgugcccuguaggaaucaggaugaacugguuggacgagcucgugugucucagggcgccgguuggagccucagagagacagcaugcuuggggaaguccuacgcccaaauguggcagcugauguauuuucaucgccgggaccuuaggcuggcggcuaacgccauuuguucagcagucccaguggauuggaucccuacuagcagaaccacauggucuauacacgcccaucaccaguggaugacuaccgaagacaugcucuccguauggaaucgcguuuggaucgaggaaaaccccuggauggaggauaaaacgcauauuaguagcuggggagacgugccauacuuaggcaagcgggaggaccaauggugcggcucgcugaucggguugacagcuagggccaccugggcaacuaauauucaggucgcuaucaaccaggugcgaagacugauuggaaaugaaaacuaccucgauuauaugacauccaugaaacgguucaagaaugagggugaccccgaaggcgcccuuugguga

SEQ ID NO: 13597 - RNA, 9879 nt, Artificial Sequence
  derived and/or modified CDS sequence (opt3) from DENV-1__FJ432719__SS-prME
uccgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccgcggagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggucguucaaacuggagaaggaacuugcugagacccagcacgguacggucuuggugcagauaaaguacgagggcacagacgcgccuugcaaaaucccauucucgacccaagaugaaaaggggguuacucagaacggacgccugauuacagcaaaucccaucgugaccgacaaagagaagccuguaaacauagaagccgagccacccuuuggcgagucuuauauugucaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguguuuacauccguugggaaacuggugcaucagauuuucggaacggcguacggcgucuuguuuucuggugugagcuggaccaugaagauagggaucggcguacuccugacuugguuaggacuaaauucacgaaguacaucccuaagcaugaccuguauugcugugggccucguuacacuguaccuuggggucauggugcaggccgauucuggaugcgugaucaacuggaaaggccgcgaauugaagugugguucagggaucuucgucacuaaugagguucacaccuggacggaacaauauaaguuucaggcagacaguccgaaaagacugagcgccgcuauuggaaaggccugggaggagggcgugugcgguauaagguccgcaacacggcucgaaaacaucauguggaaacagauuucuaacgagcugaaucauaucuuacuggaaaacgacaugaaguucaccgugguagucggcgauguggcugggauucuugcccagggcaagaagaugauccgcccucaacccauggaguacaaauauucguggaaaagcuggggcaaggcgaagauaaucggggccgacguucagaauacuaccuuuauuaucgauggaccaaacacaccugaaugucccgacgaucagagagcuuggaauauuugggagguggaggacuacggcuucgguaucuuuacuaccaacauaugguugaagcucagggauuccuauacacaggucugcgaccaccgucugaugucagcagccauuaaagauaguaaggcugugcacgccgacaugggguacuggaucgaaucugagaaaaaugaaacguggaagcuagcacgggcgagcuucauugagguuaagaccuguaucuggccaaaaucccauacucuguggucaaacggagugcucgaaagcgagaugauaauccccaagauuuauggcgguccuaucucucaacacaauuaccgaccaggcuacuucacacagaccgccgggccguggcaucugggaaaacuugaguuggauuuugaccugugcgaaggcacuacaguagucguggaugagcacugcgggaacagaggacccuccuuaaggaccacgacugugaccggcaagauuauccacgaaugguguugccgcaguuguacacucccuccacugcgguucagaggugaggacgggugcugguauggaauggagauaaggcccgucaaagaaaaggaggaaaaucuuguuaagagcauggugucugcuggcuccggugagguagacucauuuagucugggcuugcucuguauuagcaucaugaucgaagaggugaugcgcucgcgauggucccggaaaaugcugaugaccgggacucuagccgucuucuuucugcucauuaugggacagcugacauggaacgaucuuauccguuugugcauuauggugggcgcaaaugcuucugacagaauggggaugggaaccacauaccuggccuuaauggcaacuuucaagaugaggccuauguuugccguuggccuccuguuccgccggcuuaccagcagagaggugcugcuacucacgauaggucugucauuggucgcuaguguggaacugccaaacuccuuagaggaacucggggauggacuggcgaugggcaucaugauucuuaaacuguugacagacuuucaaucucaucagcucugggccacccugcuaagccugacuuucaucaagaccacauuuucccuucacuaugcauggaaaacuauggcuaugguucucucaauugugagccuguuccccuugugucugaguaccacgucucagaagacaaccugguuaccgguccuccugggcucccuugggugcaagccucugacuauguuuuugaucgccgagaauaaaauauggggaaggcgaagcuggccacucaacgaagguaucauggccguaggcauugugucgauccugcuaucaucucugcuuaagaacgauguuccccucgcugggccucugauugcaggaggcauguugaucgccuguuacgugauaagugguuccagcgcggacuuaucucuggagaaagcugccgaggucagcugggaagaggaagcagagcauuccggggccucacacaauauucucguggaaguacaggaugacggaacaaugaagaucaaagaugaggagcgcgacgauacccugacuauccuucugaaggcuacauugcuagcagugaguggcgucuauccccugagcauuccagccacccucuucguuugguacuucuggcagaagaagaagcagcggucuggcgugcugugggacacgccuucacccccagaaguggagagagcgguccuugaugacgggauauauaggaucaugcagcguggauuacugggucgcagccaggugggcguugggguauuucaagaaaacguguuccauacuauguggcacgucacccggggagcugugcucauguaccagggcaaaagauuggagccgaguugggccagcguuaagaaagaccugauuuccuacggugggggauggaggcuccagggcucuuggaauacaggcgaggaagugcaggucaucgcaguggagccugggaagaaccccaaaaauguacaaaccgccccaggaacauuuaagacucccgaaggugaggucggcgcuauugcccuggauuucaagccugggaccucgggaagcccaaucgugaaccgagaaggcaaaauaguuggucuuuaugggaauggaguggucacgacaucaggcacuuacguguccgcaaucgcucaggccaaggcgagucaggagggcccccugccugagauugaagacgagguuuuucggaaacgcaacuugaccaucauggaucuacacccggggucuggaaagacaagaagguaucugccagccauugugcgggaagcaaucaaacgaaagcucagaaccuuaauacuggcucccacucgcgucguggccagcgagauggcugaagcacuuaaggguaugccuauuagguaccaaaccacagccguaaaauccgagcauacgggcaaggagaucguggaccugaugugccacgccacuuucaccaugcgucucuugucaccaguucggguccccaauuauaacaugaucauuauggaugaagcucauuuuacagacccuucuagcaucgcggcaagaggguacauaaguaccagggugggaaugggcgaggccgcugccauuuucaugacugcaacaccgcccgguuccguggaagccuuuccacagagcaaugcugucauccaggaugaggaacgcgacauuccugagcgaucuuggaacucaggguaugaguggaucaccgauuuccccggaaaaacgguaugguuugugccauccauaaagaguggcaaugacauugcgaacugucugaggaaaaauggcaagcggguuauccagcucagcaggaagacuuucgauacagaauaccagaaaaccaagaacaacgacugggacuacguggucaccacugauaucucggagaugggggccaauuuccgcgcagaccgugugauugauccuagacggugccugaaacccguuauccuuaaggacggaccagaaagggugauucuagcugguccgaugccugucacaguggccucugcagcccagcgccgaggcagaauagggcggaaccacaauaaagagggagaucaguauaucuacaugggccagccccugaacaaugacgaggaucaugcucacuggaccgaagccaagauguuguuagacaacauuaauacaccagaggguaucauccccgcgcuguuugaaccugagagggaaaaguccgcagccauugauggggaguaucgccucagaggcgaggcuaggaaaacuuucguagaacugaugcggcguggagaccuuccaguguggcugagcuacaagguugccucagagggcuuucaauauagugaucgccgauggugcuucgacggggaaagaaacaaucagguccucgaggaaaacauggauguggagauauggacgaaagagggagaaaggaagaaauugcggccccgcuggcuggacgcuagaaccuacucugacccucuagcacugagggaguuuaaggaguucgccgcuggucggcgauccgugagcggcgaucucauccuugagauugggaaacugccgcagcacuuaacacagagagcccaaaaugcauuggacaaccuggucaugcuccauaauucagaacagggaggccgcgcguauaggcacgccauggaggagcugccagauacuaucgaaacccuuaugcugcucgcuuugauugccguucugacagguggggugaccuuauuuuuccuaaguggccggggacugggcaagacuagcaucgggcuccuuuguguaauggcauccucugugcuguuguggauggcuagcgucgagccccauuggauagccgcauccaucauucuggaauuuuuccucauggugcugcuuaucccugagcccgaccgucagagaacgccacaggauaaccaacucgccuacguugugauuggacuguuguuuaugauccugaccgucgcugcgaaugagauggguuuacuagaaacaacuaagaaagaccugggcauagggcacguagccguggagaaccaccaucacgcagcuaugcucgauguugaccuucauccugccucagccuggacccuguacgcaguggcuacaaccauuaucacucccaugaugaggcacacaauugaaaacacgaccgccaauaucucuuugacugcgauagcuaaccaggccgcaauccugaugggacucgauaagggcuggccaauuaguaaaauggacaucggugucccucugcuugccuuagggugcuauagccaggugaauccgcugacacucaccgcugcagucuugaugcugguggcccauuacgcgauuaucggccccggacuacaagcuaaggccacccgcgaggcacagaaacggacagccgcuggcauaaugaagaacccaacuguugaugggauuguggccaucgaccuggauccuguaguguaugacgcaaaguucgaaaaacagcucggacagaucaugcuucugauuuuguguacgagccaaauccugcucaugcgaaccacaugggcucugugcgaguccauaacuuuagccaccggcccccuuacaacccugugggaggguucuccagggaaguuuuggaauacuacgauugcggucucaauggccaacaucuucagaggaagcuaccucgcaggcgcuggucuagccuucucccugaugaaaaguuugggcgggggaaggcgcggcacaggggcacagggagaaacccugggcgagaaguggaaacggcagcucaaucagcuuucuaagagcgaauuuaacacuuauaagagaucagguauuauggagguugaccguuccgaagcuaaagaggggcugaagaggggagagaccacaaaacacgccgugagucggggcacugccaaguugcgcugguucgucgaacgaaaucuggugaaaccugaggguaagguaaucgaucucggcugugggagaggaggcuggagcuacuauugcgcgggguuaaagaaagugaccgaaguuaagggauacacaaaaggcggucccgggcacgaggaaccgauaccaauggcuacguacggauggaaccuggugaaacuucauucuggcaaagacgucuuuuucaucccucccgagaagugugauacccugcuaugcgacauuggcgaguccucaccaaaucccacuaucgaagaggggaggacacuccgggugcugaaaauggucgaaccuugguugcgcggaaaccaauuuuguauuaagauccugaauccguauaugcccagcgugguugagacccucgagcagaugcagagaaagcacgguggcaugcuuguaaggaacccacugucgcgaaauucuacucaugaaauguacugggugaguugcgggacaggaaacauugucuccgcagugaauaugaccagccggauguuacugaaccguuucacgauggcccacagaaaaccuaccuaugagcgcgauguugacuugggcgcugguacaaggcacguggccgucgaacccgagguggcaaaccucgauaucauagggcagcggauugaaaauaucaagcaugagcacaaaucaacuuggcauuacgacgaggauaacccuuauaagaccugggccuaccacggauccuaugaaguaaaaccaucuggcagcgcuaguuccauggugaauggcguugucaagcugcuaacaaagcccugggacgugaucccuauggugacucaaauugcgaugaccgauacaaccccauuugggcagcagagagucuucaaagagaagguugacacucgcacgcccaaagccaagaggggaacagcacaaauaauggaagugaccgcuaaauggcuuugggguuuucugagccgaaacaagaagccgcggaucuguacuagagaggaguucaccaggaaaguacgcucuaaugccgcaauuggcgccguguuugucgacgagaaccaguggaacucagcuaaggaggccguggaagaugagcguuucugggaccucguucaucgggaaagagagcugcacaaacaggggaagugcgcgacaugcguguacaacaugaugggaaaaagggaaaagaaguugggcgaguuugguaaagcaaaggggagucgcgccaucugguacauguggcugggagcucgauuccucgaguucgaagcccuuggcuuuaugaaugaggaucacugguucucccgggaaaacagccugucuggcgucgagggggagggauuacauaaacuggguuauauuuugagagacaucucgaagauaccuggcgggaauauguacgcagaugacacggcuggaugggauaccaggaucacugaagacgaucuccagaacgaggcccgcauuacagacaucauggaaccagagcacgcucugcuagccaaaucaauuuuuaaacuuaccuaucaaaauaaagugguaagaguucagcggcccgcaaagaacggcacugugauggaugucaucagcaggcgugaccagcgagguuccggacaggugggaacauacggccugaauaccuucacaaacauggaagcgcaacucauacgccagauggagagugagggcauauuuucuccuagcgaacuggagacuccaaacuuggccgaaagaguguuagauuggcuggagaaguauggggucgaacggcucaaaaggauggcuaucuccggagacgacuguguugugaagcccaucgaugaccgcuucgccaccgcacuuacggcucugaaugauauggguaaaguaagaaaggacauuccgcagugggagccuucaaaaggcuggaacgauuggcagcaagugcccuuuugcagucaucacuuccaccagcuaauaaugaaggacgggcgggagaucgucgugccauguaggaaucaggaugaacugguuggacgagcccgugugucucagggcgcagguuggagccucagagagaccgccugcuuggggaaguccuacgcgcaaauguggcagcugauguauuuucaucgccgggaccuuaggcuggcugccaacgcaauuuguucagccgucccuguggauuggauccccacaagcagaacuaccuggucuauucacgcucaucaccaguggaugacaacugaagacaugcucuccguauggaaucgcguuuggaucgaggaaaacccauggauggaggauaaaacccauauaaguagcuggggagacgugcccuacuuaggcaagcgggaggaccaauggugcggcucgcugaucggguugacggccagggcaacaugggcuaccaauauucaggucgccaucaaccaggugcgaagacugauuggaaaugaaaacuaccucgauuauaugacuuccaugaaacgguucaagaaugagucugacccugaaggugcgcuuugguga

SEQ ID NO: 13598 - RNA, 9879 nt, Artificial Sequence
  derived and/or modified CDS sequence (opt3) from DENV-1__FJ182020__SS-prME
agcgugacaaugcugcuaaugcuuaugcccacagcacuggcuuuccacuugacuacgcgaggcggggaaccucauaugaucgucuccaagcaggaaagggggaaaucuuuacuguuuaagacaucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucugcaacgcgguuggaaaacaucauguggaagcagauuucgaacgagcugaaucauauccuccuggaaaacgacaugaaauuuacaguagucgugggcgauguugcugggauuuuagcccagggaaagaaaaugauccgcccucagcccauggaguacaaguauagcuggaaguccuggggcaaagcgaagauaaucggggccgacgugcaaaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaggauucuaaagcuguucacgccgacaugggguacuggaucgaaagcgagaagaaugaaacauggaagcucgcacgggcguccuucauugaggugaaaacguguaucuggccaaagucacauacccuguggagcaacggaguacuagaaucugagaugauaauccccaaaauuuauggcgguccuaucucccagcacaauuaccgaccaggcuacuuuacucaaacagccgggccguggcaucugggaaagcucgagcuggauuucgaccuuugcgaaggcaccacugucgugguggaugagcacugcgggaacagaggacccaguuugaggacaaccacggucacuggcaaaauuauccacgaaugguguugccgcagcuguacccugccuccauuacgguuuaagggugaggacgggugcugguauggaauggagauaagacccguuaaggaaaaagaggaaaaucucgugaagucuaugguauccgcuggcucaggugagguggacaguuucagccugggccuucuguguauuucgaucaugaucgaagaggucaugaggucccgcuggucucgaaaaauguugaugacagggacccucgccguguuuuuccugcuaauuaugggacagcugacuuggaacgaucucauccggcugugcauuaugguuggcgcaaaugcuagcgaccguauggggaugggaacaaccuaccuugccuugauggcaacauuuaagaugagaccuauguucgccgugggccuguuauuuaggcgccucacuucacgggagguccugcuucugaccauaggucuaagucucguggcuuccguugaacugccaaacucuuuggaggaacugggggauggauuagcgaugggcaucaugauucucaaacugcuuacggacuuccagagccaucaacugugggccacauugcucucccugaccuuuaucaagacuaccuucucacuacacuaugcauggaagacaauggcuauggugcugagcauugucagucuuuuuccccucugucugucuacuaccucccagaaaacgacaugguugccgguacuguuaggcagccucgggugcaagccucugaccauguuccuuaucgccgagaauaaaauauggggaagaaagucguggccacugaacgaagguaucauggccgugggcauuguuucaaucuugcucucuagucugcucaagaaugaugugccccuggcugggccucuuauugcaggaggcaugcucaucgccuguuacgucauauccgguagcucugcggaccugagcuuggagaaggcugccgagguguccugggaagaggaagcagagcauucaggggccagucacaauauuuuaguagaagugcaggaugacggaacuaugaaaaucaaggaugaggagagggacgauacacugaccauccuccugaaggcuacucuucuggcagucagcggcguuuaucccuugucuauuccagccacacuauucgugugguacuuuuggcagaaaaagaaacaacgauccggcgugcugugggacaccccuucacccccagaagucgagcgcgcggugcucgaugacgggauauaucggaucaugcagagaggacugcuugguaggagucagguuggcguagggguguuccaggaaaacgucuuucauacgauguggcacgugacucguggagcuguuuuaauguaccaaggcaagcgccuggagccgagcugggccuccgugaaaaaggaccucauuucuuacggugggggauggcgguugcagggcucguggaauaccggcgaggaaguccaggugaucgcaguagagccugggaagaaccccaaaaauguccagacagccccaggaaccuucaagacaagcgaaggugaggugggcgcuauugcccuggauuuuaaacccgggacuucaggauccccuaucguuaacagagaaggcaagauagugggucucuaugggaauggagucgugaccacgaguggcacauacguuucugcaaucgcucaagccaaagcgagccaggagggcccacugcccgagauugaagacgagguguucaggaagcgaaaccuuacuaucauggaucugcacccuggguccggaaagacccggcgcuauuugccggccauugucagagaagcaaucaaaaggaagcuacggacacugauacucgcuccaacccgagugguagccucagagauggcugaagcauuaaaagguaugcccauuagauaccagacuaccgccgugaagucugagcauacaggcaaagagaucguugaccugaugugccacgccacguuuacuaugcgccuucugagcccugucagggugccaaauuauaacaugaucauuauggaugaagcucauuucaccgaccccaguuccaucgcggcacguggguacauaagcacacgggugggaaugggcgaggccgcugccauuuuuaugaccgcaacuccuccggguucugucgaagccuucccccaaucaaaugcuguaauccaggaugaggaaagagacauuccagagagguccuggaacaguggguaugaguggaucacagauuuuccuggaaagaccgugugguucguucccagcauaaagucgggcaaugacauugcgaacugucuccgcaaaaauggcaagcgagugauccaguugucuagaaaaacguucgauacugaauaccagaagaccaagaacaacgacugggacuacgucgugaccaccgauaucuccgagaugggggccaauuuucgggcagacaggguuauugauccacgccguugccugaagccugugauccucaaggacggacccgaaagagucauucuggcugguccaaugccggugacuguagccagcgcagcccaacggaggggccgcauagggcgaaaccacaauaaagagggagaucaguauaucuacaugggccagccucuuaacaaugacgaggaucaugcucacuggacagaagccaagaugcuacuggacaacauuaauacccccgaggguaucaucccagcguuguucgaacccgagagagaaaaaucagcagccauugauggggaguaucgguuaaggggcgaggcucgcaagacauuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauauggacuaaggagggagaaaggaaaaagcugagaccaagauggcucgacgcucggacguacagcgaccccuuggcacugcgcgaguucaaggaauuugccgcugguagaaggucagucaguggcgaucuaauccuggagauugggaaacucccucagcaccuuacccagcgggcccagaaugcacuggacaacuuaguuauguugcauaauagcgaacaaggaggccgagcguauagacacgccauggaggagcugccggauacaaucgaaacucucaugcugcuugcucugauugccgugcucaccggugggguaacauuguucuuucuguccggccgcggauuaggcaagaccucuaucgggcuacugugugugauggcaagcuccguccuccuuuggauggcuucaguggagccacauuggauagccgcaucuaucauucuggaguucuuuuugaugguucugcucauccccgagccugacaggcagcggacuccccaggauaaccagcuggccuacguggucauuggacuucucuucaugauccugacgguagcugcgaaugagauggguuugcuggaaaccaccaaaaaggacuuaggcauagggcacguggccguugagaaccaccaucacgcagcuaugcuagauguggaccugcauccagccagugccuggacucucuacgcagucgcuaccacaauuaucaccccuaugaugcgucacacuauugaaaacacaacggccaauaucucgcuuaccgcgauagcuaaccaagccgcaauccugaugggauuggauaaaggcuggcccauuagcaagauggacaucggugugccacugcucgcccuggggugcuauucccaggucaauccucuuacuuuaacagcugcagugcugaugcucguugcccauuacgcgauuaucggcccgggauugcaggcuaaggccaccagagaggcacagaaaaggaccgccgcuggcauaaugaagaaccccacaguggaugggauuguagccaucgaccuggauccaguggucuaugacgcaaaauuugaaaagcagcuaggacagaucaugcugcucauucuuuguacuucucagauccuguugaugcgcacgaccugggcucugugcgagucaauaacacucgccacuggcccucugaccacauuaugggaggguagccccgggaaauucuggaauaccacuauugcgguuuccauggccaacaucuuccggggaaguuaccuugcaggcgcuggucuggccuuuucucucaugaaaagccuaggcgggggacgaagaggcacgggggcacaaggagaaacacugggcgagaaguggaaaaggcaguugaaucagcugucaaaguccgaguucaacaccuauaaacgcagugguauuauggagguggaccggagcgaagcuaaggaggggcucaaaagaggagagacuaccaagcacgccgucucucguggcacagccaaacuuaggugguuuguggaacggaaucugguaaaaccagaggguaaggugaucgauuugggcugugggcgcggaggcugguccuacuauugcgcggggcugaaaaagguuacugaagugaaaggauacaccaagggcgguccugggcacgaggaacccauaccgauggcuacauacggauggaaccucgucaaauuacauucaggcaaggacguguucuuuaucccaccugagaagugugauacgcugcuuugcgacauuggcgagagcucgcccaauccaaccaucgaagaggggcgaacucugagaguccuaaaaaugguggaacccuggcucaggggaaaccaguucuguauuaagauccugaauccuuauaugccgucuguuguagagacauuggagcaaaugcagcggaaacacgguggcaugcuggugcgcaacccccucaguagaaauuccacccaugaaauguacugggucagcugcgggacuggaaacauugugucagcaguuaauaugacauccaggaugcuucugaaccgauuuaccauggcccaccggaagccaacguaugagcgugauguggacuuaggcgcugguaccagacacgucgccguggaaccugagguagcaaaccuggauaucauagggcagcgcauugaaaauaucaaacaugagcacaagucuacauggcauuacgacgaggauaaccccuauaagacuugggccuaccacggaagcuaugaagugaaaccuaguggcuccgcuagcucuaugguuaauggcgucgugaaguugcucaccaaaccaugggacgugauccccauggucacacagauugcgaugacugauaccacaccuuucgggcaacagaggguuuuuaaggagaaaguggacacccggacuccaaaggccaagagaggaacggcacagauaauggaaguaacagcuaaauggcugugggguuuccuaucacgcaacaagaaacccaggaucuguacccgagaggaauuuacucggaaggugagaaguaaugccgcaauuggcgccgucuucguggacgagaaccaauggaacuccgcuaaagaggccguugaagaugagagguuuugggaccuugugcaucgcgaacgugagcugcacaagcaggggaagugcgcgaccugcgucuacaacaugaugggaaaacgggaaaagaaacucggcgaguucgguaaggcaaaagggagcagagccaucugguacauguggcugggagcuagguucuuggaguuugaagcccugggcuucaugaaugaggaucacugguuuucucgcgaaaacucgcucucaggcguggagggggagggacuucauaagcuggguuauauuuuacgagacaucagcaaaauaccgggcgggaauauguacgcagaugacacagcuggaugggauacgcggaucaccgaagacgaucugcagaacgaggccaagauuacugacaucauggaaccugagcacgcuuugcucgccaaguccauuuucaaacugacauaucagaauaagguaguuagagugcaaaggccagccaaaaacggcaccgucauggaugugaucagucgcagagaccagcgggguucuggacaggugggaacuuacggccuaaauacauuuaccaacauggaagcgcagcuuauaaggcaaauggagagcgagggcauuuucucccccucagaacuggagacaccuaaccucgccgggcguguccuggauugguuggaaaagcauggaguugagcgauuaaaacgcauggcuaucaguggugacgacugugugguaaagccaaucgaugacagauuugccacugcacugaccgcucucaaugauaugggcaaggugcggaaagacauuccccagugggaaccgucuaagggguggaacgauuggcagcaggucccuuucugcagccaccacuuucaucaacuuauaaugaaagacggaagggagaucgugguucccugucgcaaucaggaugagcuggugggcagagcccgggucucccagggugcaggguggucacuaagggaaacggccugccugggaaagagcuaugcgcagauguggcaacucauguacuuccaccgacgugacuugagacuggcugccaacgcaauuuguucugccgugccaguagauuggguuccuaccucccgcacaacuuggaguauccaugcucaccaucaguggaugaccacagaggacaugcuuagcguguggaaucgggucuggauugaagagaaccccuggauggaagauaaaacucacaucucguccuggggcgacgugccauaucugggcaagagggaggaccaguggugcgggucucucauaggauuaaccgccagagcaacgugggcuacaaauauccaaguugccauuaaccaggugcgccggcugaucgguaaugagaacuacuuggauuacaugaccucaaugaagagguuuaaaaaugaaagcgaccccgagggcgcgcugugguga

SEQ ID NO: 13599 - RNA, 9879 nt, Artificial Sequence
  derived and/or modified CDS sequence (opt3) from DENV-1__FJ182022__SS-prME
agcgugaccaugcugcucaugcuuaugcccaccgcccuggcuuuccacuugacuacgcggggcggggaaccucauaugaucgucuccaagcaggaaaggggaaagucuuuacuguuuaagaccucagccgguguuaauaugugcacgcuaauugccauggaccucggcgaacugugugaagauacuaugaccuacaaaugcccacggauuacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucuccgcgggauguccuaugugauguguaccgggagcuucaagcuggagaaagaagucgccgagacgcagcacgguacagugcuuguucagauaaaguacgagggcaccgacgcuccuugcaagaucccauucucgacucaagaugaaaaaggggugacacagaacggaagauugauuaccgcgaaucccaucguaacugacaaggagaaaccugucaacauagaagcagagccacccuuuggcgagucuuauauugugaucggugccggggaaaaggcucugaaacucuccugguucaagaagggcucaaguaucggaaaaauguuugaggccaccgcaaggggcgcccggcgaauggcuauucugggggauacagccugggacuucggaagcaucgguggcguuuuuacguccguggggaaacuuguccaucagauuuucggaaccgcauacggcgugcuguuuucugguguaagcuggacuaugaaaauagggaucggcguguugcucacauggcugggauuaaauucacgcaguaccucccugagcaugacauguauugcgguuggccuagucacucucuaccugggggugauggugcaggcugauucuggaugcgucaucaacuggaagggcagagaacuuaaaugugguucagggaucuucguuaccaaugaggugcacacguggacagaacaauauaaguuucaggccgacaguccgaagagguugagcgcagccauuggaaaggcuugggaggagggcgugugcgguauacgguccgccacccgccuggaaaacaucauguggaagcagauuucuaacgagcucaaucauauccuguuagaaaacgacaugaaauucacuguagucgugggcgauguugcagggauucuggcucagggaaagaaaaugaucagaccucaacccauggagcacaaguacucguggaaaagcuggggcaaggccaagauaaucggggcggacgugcagaauaccacauuuauuaucgauggaccaaacacuccugaaugucccgacgaucagagggccuggaauauuugggaggucgaggacuauggcuucgguaucuuuaccacaaacauauggcuuaaauugcgugauuccuacacacaggugugcgaccaccggcucaugucagcugcaauuaaggauaguaaagccguucaugcugacaugggguauuggaucgaaucugagaagaaugaaaccuggaaacuggcccgagcauccuucauugaggugaagacuuguaucuggccaaagucccacacacuauggucaaacggaguacuggaaagcgagaugauaauccccaaaauuuacggcgguccuaucucucaacauaauuauagaccaggcuacuucacccagacugcggggccguggcaccucggaaagcuggagcuugauuuugacuugugcgaaggcacaaccgucgugguggaugagcacugcgggaacaggggacccucccugcgcacgacuaccgucacaggcaaaauuauccaugaaugguguugccggaguuguaccuuaccuccacucagauucaggggugaggacgggugcugguacggaauggagauacgccccguuaaggaaaaagaggaaaaucugguaaagagcaugguaucugccggcuccggugagguggacucauuuagucuuggccuguuguguauuagcaucaugaucgaagaggucaugcgaucgcgguggucccguaagaugcucaugacugggacacuggcuguguucuuucuacugauuaugggacagcucaccuggaacgaucugaucagacuuugcauuaugguuggcgccaaugcaucugacaggauggggaugggaacaacuuauuuggcucugauggccaccuucaaaaugcgcccuauguuugcagugggcuuacucuuccggagacugacgagcagggagguccuucugcuaacaauaggucucucacugguggccaguguugaauugccaaacucccuggaggaauuaggggauggacucgcuaugggcaucaugauucugaaacuucugaccgacuuucaaucucaccaguugugggcgacucuccugagccuaaccuucaucaaaacaacuuuuucccugcauuacgccuggaagaccauggcaauggugcuuucaauugucagccucuucccccuguguuugaguacgacaucucagaaaaccacuuggcugccgguauuacucggcucccuggggugcaagccucuuacaauguuucugaucgcugagaauaagauauggggacgacgcagcuggccauugaacgaagguaucauggccgugggcauuguuucgauccuccugucaucucuacugaaaaacgaugugccccuugccgggccucucauugcuggaggcaugcugaucgcauguuaugucauaagugguuccagcgccgacuugucuuuagagaaggcggcugaggugagcugggaagaggaagccgagcacuccggggcaucacauaauauucugguagaagugcaggaugacggaaccaugaaaaucaaggaugaggagcgggacgauacucucacaauccugcuuaaagccacccuguuggcugucaguggcguuuacccccuaagcauuccagcaacgcuguucgugugguauuucuggcaaaagaaaaagcagagaucuggcgugcucugggacacuccuucacccccagaagucgagagggccgugcuggaugacgggauauaccguaucaugcagcgcggacuuuuaggucggagccagguuggcguagggguguuucaagaaaacgucuuccacaccauguggcacgugacaagaggagcgguucugauguaucagggcaagaggcucgagccgaguugggcuagcgugaaaaaggacuugauuuccuacggugggggauggcgacugcagggcucuuggaauaccggcgaggaaguccaggugaucgccguagagccugggaaaaaccccaagaauguccaaacagcaccaggaacuuuuaaaacccccgaaggugaggugggcgccauugcucucgauuucaagccugggacgucgggaagcccaaucguuaaccgggaaggcaagauagugggucuguacgggaauggagucgugacaacuucaggcaccuauguuuccgccaucgcacaggcuaaagccagucaggagggcccccuuccugagauugaagacgagguguuucgcaagagaaaccugacaaucauggauuugcauccggggucuggaaaaaccaggcgguaccuaccagcgauuguccgagaagccaucaagagaaaacugcgcacucucauauuagcacccaccagggugguagcuagcgagauggccgaagcucugaaggguaugccuauucguuaucaaacaacggcagugaaguccgagcacacuggcaaagagaucguugaccuuaugugccaugccaccuucacaaugcggcugcucucaccagucagagugcccaauuacaacaugaucauuauggaugaagcccacuuuaccgacccuucuagcaucgcugcgaggggguauauaaguacucgcgugggaaugggcgaggcagccgcuauuuucaugacagccaccccgcccgguuccgucgaagcauuuccacagagcaaugccguaauccaggaugaggaacgagacauuccugagagaucuuggaacucaggguacgaguggaucacggauuuccccggaaagacugugugguuuguuccauccauaaaaaguggcaaugacauugcuaacuguuugcggaagaauggcaaaagggugauccagcugagccgcaagacauucgauaccgaauaucaaaagaccaaaaacaacgacugggacuacgucgugacuacagauaucucggagaugggggcgaauuuccgugccgacagaguuauugauccucggaggugccucaagcccgugauccugaaagacggaccagaacgcgucauucuugcagguccgaugccugugaccguagcuucugccgcacagcgaagaggccggauagggaggaaccauaauaaggagggagaucaguacaucuauaugggccagccccuaaacaaugacgaggaucacgcccacuggacagaagcuaaaaugcuguuggacaacauuaauacuccagaggguaucauccccgccuuauuugaaccugagcgcgaaaaguccgcggcaauugauggggaguacagacugaggggcgaggcccggaagacguucguggaacucaugcgucgcggagaccugccaguuuggcuuagcuauaaagucgcuucagagggcuuucaauacagugaucgaagauggugcuucgacggggaaaggaacaaucaggugcuggaggaaaacauggauguggagauauggaccaaggagggagaacggaaaaagcuccgccccagaugguuggacgccaggacauauucugacccucuggcucuacgggaguuuaaagaguucgcagccggucgaagauccgucagcggcgaucugauccucgagauugggaaacuuccgcagcaucugacucagcgcgcucaaaaugccuuagacaacuugguuaugcugcacaauucagaacagggaggcagggcauaccggcaugcgauggaggagcucccagauaccaucgaaacacugaugcuucuggcccucauugcuguguugaccggugggguaacucuguuuuucuuaaguggccguggacuaggcaaaacgagcaucgggcugcucugugugauggccuccucuguccuucuguggauggcaagcguggagccccacuggauagcugccuccaucauuuuggaauuuuuccugaugguucuccugaucccugagcccgacagacagaggaccccacaggauaaccaacuugcauauguggucauuggacuccuguuuaugaucuugacaguagccgcuaaugagaugggucuguuagaaacuaccaagaaggaccuaggcauagggcacguggcgguugagaaccaucaccaugccgcaaugcuggauguggaccuccacccugcuucagccuggacacuuuacgccgucgcaaccacuauuaucacacccaugaugcgccauacgauugaaaacaccacugcuaauaucucucugacagccauagcgaaccaggcugccaucuugaugggacuggauaaaggcuggccaauuaguaagauggacaucggugugccucuccuggcacuugggugcuacucgcaggucaauccguuaacccugaccgccgcugugcucauguugguugcacacuaugccauuaucggccccggacugcaagcgaaagcuacacgggaggcccagaagcgaacugcagccggcauaaugaaaaacccaacgguggaugggauuguagcuaucgaccuagauccuguggucuacgacgccaaguucgaaaagcagcugggacagaucaugcuccuuauucuguguaccagccaaaucuugcugaugagaacaacuugggcacucugcgaguccauaacccuggcuacaggccccuuaaccacucuuugggaggguucuccagggaaauuuuggaauacgacaauugccguuucaauggcgaacaucuucaggggaagcuaucuggccggcgcaggucucgcuuucucccuaaugaagagucugggcgggggacgccggggcaccggggcccagggagaaacuuugggcgagaaauggaagagacagcugaaucagcucucuaaaagcgaauuuaacaccuacaagcguucagguauuauggagguggacagguccgaagcaaaggaggggcuuaaacggggagagacaacuaagcacgcugucagucgcggcaccgccaaacugcgaugguucguggaaagaaauuugguaaagccugaggguaaagugaucgaucugggcugugggaggggaggcuggagcuauuacugcgccgggcucaagaagguuacagaagugaaaggauauacgaagggcggucccgggcaugaggaaccgauaccaauggcgaccuacggauggaacuuagucaaacugcacucuggcaaggacguguuuuucaucccucccgagaaaugugauacucuucugugcgacauuggcgaguccucaccaaaucccacaaucgaagaggggcggacccuacgcguccucaagaugguggaaccuuggcugagaggaaaccaauuuuguauuaaaaucuugaauccguacaugcccagcguuguagagacucuggagcagaugcagaggaagcaugguggcaugcucgugcgaaacccacuuucgagaaauucuacacacgaaauguauugggucaguugcgggaccggaaacauuguguccgcuguuaauaugacgagccguaugcuguuaaacagauucaccauggcacaccgcaagccuacauacgagagggauguggaccugggcgccgguacucggcaugucgcuguggaacccgagguagccaacuuggauaucauagggcagagaauugaaaauaucaaacacgagcauaagucaaccuggcacuaugacgaggauaacccuuacaaaacaugggcauaucauggauccuacgaagugaagccaucuggcagcgccaguuccaugguuaauggcgucgugaaacuccugacuaagcccugggacgugaucccuauggucacccaaauugcuaugacagauaccacuccauuugggcagcagcgcguuuucaaggagaaaguggacacgaggacacccaaggcgaaacgaggaaccgcccaaauaauggaaguaacugcaaaguggcuaugggguuuucuuagccggaacaaaaagccgagaaucuguaccagggaggaguucacacgcaaggugcguucuaaugcugccauuggcgcagucuuuguggacgagaaccaguggaacucagccaaagaggcuguugaagaugagcgguucugggaccuggugcacagagaaagggagcuccacaagcaggggaaaugcgccacgugcgucuauaacaugaugggaaagcgcgagaagaagcugggcgaguuugguaaggcgaaagggagucgagcaaucugguacaugugguugggagcccgguuccuggaguucgaagcucucggcuuuaugaaugaggaucauugguucuccagagaaaacagccuuucuggcguggagggggagggacugcacaaguuagguuacauucugagggacaucucgaaaauaccuggcgggaauauguaugccgaugacaccgcaggaugggauacucgcaucacagaagacgauuugcagaacgaggcuagaauuaccgacaucauggaaccagagcaugcccuccuggcuaagucaauuuuuaaacuaacuuaccaaaauaagguaguucgggugcagaggcccgccaaaaacggcacagucauggaugugaucagccgucgagaccagcgcgguuccggacaggugggaaccuauggccuuaauacauucacuaacauggaagcacaacugauaagacagauggagagugagggcauauuuucuccuagcgaacucgagaccccaaaccuggcggaacgggucuuggauugguuagagaaguacgggguugaaaggcugaagcgcauggccaucuccggagacgacugugugguaaaacccaucgaugacagauucgcuacggcccucaccgcacuuaaugauauggguaaggugcggaaagacauuccgcagugggagccuucaaagggcuggaacgauuggcagcaaguccccuuuugcagucaccacuuccaucagcugauaaugaaagacgggagggagaucgugguuccaugucgaaaucaggaugagcuagugggacgugcuagagucucucagggcgccgguuggagccugcgcgagacagcaugccucgggaaguccuaugcccaaauguggcaguugauguacuuucaccggagggaccugagacuugcggcuaacgccauuuguucagcagugccuguagauuggauccccacuagccgcaccacauggucuauucaugcccaccaucaguggaugacuaccgaagacaugcuguccguuuggaaucggguguggaucgaggaaaacccauggauggaggauaagacgcacauaaguagcuggggagacguccccuaucucggcaaaagggaggaccaauggugcggcucguuaaucgggcugacagcucgagccaccugggcaacuaauauucagguggcuaucaaccagguuagacgguugauuggaaaugaaaacuaccuggauuacaugacauccaugaagagguucaaaaaugagucugacccugaaggugcccucugguga

SEQ ID NO: 13600 - RNA, 9879 nt, Artificial Sequence
  derived and/or modified CDS sequence (opt3) from DENV-1__FJ024447__SS-prME
agcgugaccaugcugcucaugcuuaugcccacagcccuggcuuuccacuugacuacgagaggaggggagccucauaugaucgucuccaagcaggaaagaggaaaaucuuuacuguuuaagaccucagccgguguuaauaugugcacacuuauugccauggaccucggcgagcugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacugcucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggaucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaagucgugcaucagauuuucggaaccgcauacggcguacuauuuucuggugugagcuggacuaugaagauagggaucggcguucuguugacauggcucggacuaaauucacgaaguaccuccuuaagcaugacauguauugcggucggccuggugacucuauaccucggggugaugguccaggcugauucuggaugcguuaucaacuggaaaggccgcgaacugaagugugguucagggaucuucgugaccaaugaggugcacacguggacagaacaauauaaguuucaggccgacaguccgaaaagacuuagcgcagccauuggaaaggcuugggaggagggcguaugcgguauaagguccgccacccgguuggaaaacaucauguggaaacagauuucuaacgagcugaaucauauccuccuggaaaacgacaugaaguucacugucgugguuggcgauguggcagggauuuuagcucagggcaagaagaugauccgcccucaacccauggaguacaaauauucguggaaaagcuggggcaaggccaagauaaucggggcggacguccagaauaccacauuuauuaucgauggaccaaacacuccugaaugucccgacgaucagagagccuggaauauuugggagguggaggacuacggcuucgguaucuuuaccacaaacauauggcugaaacuuagggauuccuauacgcagguuugcgaccaccguuugaugucagcugcaauuaaagauaguaaggccgugcacgcugacaugggguacuggaucgaaucugagaaaaaugaaaccuggaagcucgcccgggcauccuucauugagguaaagacuuguaucuggccaaaaucccauacacuguggucaaacggaguccuagaaagcgagaugauaauccccaagauuuauggcgguccuaucucucaacacaauuaccgaccaggcuacuucacccagacugcggggccguggcaucugggaaaacucgagcuggauuuugaccuuugcgaaggcacaaccgugguggucgaugagcacugcgggaacagaggacccuccuugaggacgacuaccguuacaggcaagauuauccacgaaugguguugccgcaguuguacccugccuccauuacgguucagaggugaggacgggugcugguauggaauggagauaaggcccgugaaagaaaaggaggaaaaucucguaaagagcauggugucugccggcuccggugaggucgacucauuuagucugggccuucuguguauuagcaucaugaucgaagaggugaugcgcucgcgauggucccggaaaauguugaugacugggacacucgcuguuuucuuucugcuaauuaugggacagcugaccuggaacgaucucauccgucugugcauuauggugggcgccaaugcaucugacagaauggggaugggaacaacuuaccuugcuuugauggccaccuucaagaugaggccuauguuugcagucggccuguuauuccgccggcucacgagcagagaggugcugcuucugacaauaggucuaucacucguugccaguguggaacugccaaacuccuuggaggaacugggggauggauuagcuaugggcaucaugauucucaaacugcuuaccgacuuucaaucucaucagcugugggcgacuuugcucagccugaccuucaucaagacaacuuuuucccuacacuaugccuggaaaaccauggcaaugguccugucaauuguaagccuuuucccccucugucugaguacgacaucucagaagaccacuugguugccggugcuguuaggcucccucgggugcaagccucugacaauguuucuuaucgcugagaauaaaauauggggaaggcgaagcuggccacugaacgaagguaucauggccguuggcauugugucgaucuugcucucaucucugcuaaagaacgaugucccccuggccgggccucuuauugcuggaggcaugcucaucgcauguuacgugauaagugguuccagcgccgaccugucuuuggagaaagcggcugagguaagcugggaagaggaagccgagcauuccggggcaucacacaauauuuuaguggaaguccaggaugacggaaccaugaagaucaaagaugaggagcgcgacgauacucugacaauccuccugaaggccacccuucuggcuguuaguggcguguaucccuugagcauuccagcaacgcuauucgugugguacuucuggcagaagaagaagcagcggucuggcguccugugggacacuccuucacccccagaaguggggagagccguucucgaugacggaauauauaggaucaugcagcguggucugcuuggccgcagccagguaggggugggagucuuucaagagaacguguuccauaccauguggcacguuacacggggcgcgguguuaauguaccaggguaaaagacuggaaccgaguugggcuagcgucaagaaagaccucauuuccuacgggggaggcuggagguugcagggcucuuggaauaccggggaggaggugcagguaaucgccgucgaaccuggaaagaaccccaaaaaugugcaaacagcaccagguacuuuuaagacccccgagggcgaaguuggggccauugcucuggauuucaagccuggaacgucgggcagcccaaucgugaaccgagaggguaaaauagucgggcucuauggaaauggcgugguuacaacuucaggcaccuacguguccgccaucgcacaggcuaaggccagucaggaagggccccugccugagauugaggacgaagucuuucggaaacgcaaccuuacaaucauggaucugcacccgggaucugguaagaccagaagguauuugccagcgauugugcgggaggccaucaaacgaaagcuaagaacucugauacucgcacccacccgcguaguggcuagcgaaauggccgaggcuuuaaagggcaugccuauuagguaccaaacaacggcaguuaaauccgaacauacugggaaggagaucgucgaccugaugugccacgccaccuucacaaugcgucuucugucaccagugcgggugcccaauuauaacaugaucauuauggaugaggcccauuuuaccgacccuucuagcaucgcugcgagaggauacauaaguacuagggucggcaugggugaagcagccgcuauuuucaugacagccaccccgcccggguccguagaggcauuuccacagagcaaugccgugauccaggaugaggaacgcgacauuccugaacgaucuuggaacucaggauaugaguggaucacggauuuccccggcaaaacuguuugguuugugccauccauaaagaguggcaaugacauugcuaacugucucaggaaaaaugggaagcgggucauccaguugagcaggaagacauucgauaccgaguaccagaaaaccaagaacaacgacugggacuacgugguuacuacagauaucucggaaaugggagcgaauuuccgcgccgaccgugugauugauccuagacggugccugaaacccgucauccucaaggacgguccagagagggugauucuggcaggcccgaugccuguaaccguggcuucugccgcacagcgccgagggagaauaggacggaaccacaauaaagaaggcgaucaguauaucuacaugggucagccccuuaacaaugacgaggaucaugcccacuggacagaggcuaagaugcuacuggacaacauuaauacuccagaagggaucauccccgccuuguuugagccugaaagggagaaguccgcggcaauugauggcgaauaucgcuuaagaggagaggccaggaaaacguucguugagcugaugcggcguggcgaccucccagucuggcugagcuacaagguggcuucagaaggguuucaauauagugaucgccgauggugcuucgacggagagagaaacaaucaggugcuugaagagaacauggaugucgaaauauggaccaaagagggugagaggaagaaacugcggccccgcuggcucgacgccagaacauacucugacccuuuggcucugagggaauuuaaggaguucgcagccggccggcgauccguuagcggggaucuaauccuggaaauuggaaaacucccgcagcaccuuacucagagagcucaaaaugcccuggacaacuuagugauguugcauaauucagagcagggcggucgcgcauauaggcacgcgauggaggaacugccagauaccaucgagacacucaugcugcuugcccugauugcuguacucaccgggggcgugacuuuguuuuuccugaguggacggggcuuagggaagacgagcaucggacuacugugugucauggccuccucugugcuccuuuggauggcaagcguugaaccccauuggauagcugccuccaucauucuggaguuuuucuugauggugcugcucaucccugaacccgaccgucagagaaccccacaggauaaccaacuggcauacgucguaauuggucuucucuuuaugauccugacaguggccgcuaaugagaugggcuugcuggagacuaccaagaaagacuuagggauaggacacguugcgguggaaaaccaccaucacgccgcaaugcuagaugucgaccugcauccugcuucagccuggacacucuacgccguggcaaccacuauuaucacacccaugaugaggcacacgauugagaacaccacugcuaauaucucucuuacagccauagcgaaccaggcugccauccugaugggcuuggauaaggguuggccaauuaguaaaauggacaucggggucccucugcucgcacugggcugcuauagccaggugaauccgcuuaccuuaaccgccgcuguucugaugcucguggcacauuacgccauuaucggacccggcuugcaagcgaaggcuacacgcgaagcccagaaacggacugcagccgggauaaugaagaacccaacgguagauggaauuguggcuaucgaccuggauccugucguuuaugacgccaaguucgagaaacagcuaggccagaucaugcugcucauucuuuguaccagccaaauccuguugaugcgaacaacuugggcacugugcgaauccauaacccucgcuacagguccccugaccacuuuaugggaggggucuccaggaaaguuuuggaauacgacaauugccgugucaauggcgaacaucuucagaggcagcuaccuugccggugcaggccuggcuuucucccucaugaaaagucuagggggaggcaggcgcgggaccggagcccagggcgagacucugggugaaaaguggaaacggcaguugaaucagcugucuaagagcgaguuuaacaccuauaagagaucagggauuauggaagucgaccguuccgaggcaaaagaaggacucaagaggggcgagacaacuaaacacgcugugagucgggguaccgccaaacuucgcugguucguagagcgaaaucuggugaaaccugaaggcaagguuaucgauuugggguguggaagaggcggguggagcuacuauugcgccggacugaagaaagugacagaggucaagggcuacacgaaaggugggcccggacacgaggagccgauaccaauggcgaccuacggcuggaaccucgugaaguuacauucuggcaaagacgucuuuuucaucccucccgaaaagugugauacucugcuuugcgacauuggggaguccucaccaaaucccacaaucgaggaaggaaggacccugcgggugcuaaaaaugguugagccuuggcuccgcgguaaccaauuuuguauuaagauccugaauccguauaugcccagcguaguggaaacuuuggagcagaugcagagaaagcacggcgggaugcuggucaggaacccacucucgcgaaauucuacacaugagauguacugggugaguugcggaaccggcaacauuguuuccgcugugaauaugacgagccggaugcuucugaaccguuucaccauggcacacagaaaaccuacauaugaacgcgaugucgacuuaggugccgggacuaggcacguggcuguagagcccgaaguggccaaccuggauaucauaggacagcggauugagaauaucaagcaugaacacaaaucaaccuggcauuacgacgaggauaacccuuauaagacaugggcauaccacggcuccuaugagguuaaaccaucuggcagcgccaguuccauggucaaugggguggugaaguugcucacuaagcccugggacgucaucccuaugguuacccaaauugcuaugacagauaccacuccauuuggacagcagagaguguucaaagaaaagguagacacgcgcacacccaaagcgaagagggguaccgcccaaauaauggaggugacugcaaaauggcuguggggcuuucuaagccgaaacaagaagccgcggaucuguaccagagaagaguucacaaggaaaguccgcucuaaugcugccauuggggcaguguuuguugacgaaaaccaguggaacucagccaaggaggcuguggaggaugaacguuucugggaccuuguccaucgggagagagaacugcacaaacagggaaagugcgccacgugcguguacaacaugaugggcaaaagggagaagaagcucggugaauuugggaaagcgaagggaagucgcgcaaucugguacauguggcugggcgcccgauucuuggaguucgaggcucugggcuuuaugaaugaagaucacugguucucccgggagaacagccucucugggguagaaggagagggucuucauaaacugggcuauauuuuaagagacaucucgaauauaccugggggaaacauguacgccgaugacaccgcaggcugggauacuaggaucacagaggacgaucugcagaaugaagcucgcauuaccgacaucauggagccagaacacgccuugcucgcuaagucaauuuuuaaacugacuuaucaaaacaagguugugagaguccagcggcccgccaaaaaugguacagugauggaugugaucagcaggcgugaccagcgaggguccggacaggucggcaccuacggccuaaacacauucacuaacauggaggcacaacuuauacgccagauggaaagugaggggauauuuucuccuagcgagcuggaaaccccaaaucucgcggagagaguucuggauugguuggaaaaguauggaguggagcgguuaaagaggauggccaucuccggugacgacuguguagugaaacccaucgaugaccgcuucgcuacggcccugaccgcacucaacgauaugggcaaggucagaaaagacauuccgcagugggaaccuucaaagggguggaaugauuggcagcaagugcccuuuugcagucaucacuuccaccagcuuauaaugaaagacggacgggagaucguugugccauguaggaaccaggaugagcuggucggccgagcucgugugucucagggugccggguggagccuaagagaaacagcaugccugggaaaguccuacgcccaaauguggcagcucauguauuuucaucgccgggacuugaggcuggcggcuaaugccauuuguucagcaguaccuguugauuggauccccacuagcagaaccacauggucuauucacgcccaucaccaguggaugacuaccgaggacaugcuuuccguguggaaccgcgucuggaucgaagagaauccauggauggaagauaagacgcauauaaguagcuggggcgacgugcccuaccugggcaaacgggaggaccaauggugcgggucgcucaucggauuaacagcuagggccaccugggcaacuaacauucagguugcuaucaaucaggugcgaagacugauugguaacgagaauuacuuggauuauaugacauccaugaagcgguucaaaaacgaaucugacccugagggcgcccugugguga

SEQ ID NO: 13601 - RNA, 9879 nt, Artificial Sequence
  derived and/or modified CDS sequence (opt3) from DENV-1__FJ182025__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgggagagccgugcuggaugacggaauauauaggaucaugcagcguggucuuuuaggccgcagccagguugggguaggaguguuucaagagaacgucuuccauaccauguggcacgugacacggggcgcgguucugauguaccaggguaaaagacucgaaccgaguugggcuagcgugaagaaagacuugauuuccuacgggggaggcuggaggcugcagggcucuuggaauaccggggaggagguccaggugaucgccguagaaccuggaaagaaccccaaaaauguccaaacagcaccagguacuuuuaagacccccgagggcgaagugggggccauugcucucgauuucaagccuggaacgucgggcagcccaaucguuaaccgagaggguaaaauaguggggcuguauggaaauggcgucgugacaacuucaggcaccuacguuuccgccaucgcacaggcuaaggccagucaggaagggccccuuccugagauugaggacgaaguguuucggaaacgcaaccugacaaucauggauuugcacccgggaucugguaagaccagaagguaucuaccagcgauuguccgggaggccaucaaacgaaagcugagaacucucauauuagcacccacccgcgugguagcuagcgaaauggccgaggcucugaagggcaugccuauuagguaccaaacaacggcagugaaauccgaacauacugggaaggagaucguugaccuuaugugccacgccaccuucacaaugcgucugcucucaccaguccgggugcccaauuauaacaugaucauuauggaugaggcccauuuuaccgacccuucuagcaucgcugcgagaggauacauaaguacuagggugggcaugggugaagcagccgcuauuuucaugacagccaccccgcccggguccgucgaggcauuuccacagagcaaugccguaauccaggaugaggaacgcgacauuccugaacgaucuuggaacucaggauaugaguggaucacggauuuccccggcaaaacugugugguuuguuccauccauaaagaguggcaaugacauugcuaacuguuugaggaaaaaugggaagcgggugauccagcugagcaggaagacauucgauaccgaguaccagaaaaccaagaacaacgacugggacuacgucgugacuacagauaucucggaaaugggagcgaauuuccgcgccgaccguguuauugauccuagacggugccucaaacccgugauccugaaggacgguccagagagggucauucuugcaggcccgaugccugugaccguagcuucugccgcacagcgccgagggagaauaggacggaaccacaauaaagaaggcgaucaguauaucuacaugggucagccccuaaacaaugacgaggaucaugcccacuggacagaggcuaagaugcuguuggacaacauuaauacuccagaagggaucauccccgccuuauuugagccugaaagggagaaguccgcggcaauugauggcgaauaucgccugagaggagaggccaggaaaacguucguggagcucaugcggcguggcgaccugccaguuuggcuuagcuacaaggucgcuucagaaggguuucaauauagugaucgccgauggugcuucgacggagagagaaacaaucaggugcuggaagagaacauggauguggaaauauggaccaaagagggugagaggaagaaacuccggccccgcugguuggacgccagaacauacucugacccucuggcucuaagggaauuuaaggaguucgcagccggccggcgauccgucagcggggaucugauccucgaaauuggaaaacuuccgcagcaccugacucagagagcucaaaaugccuuagacaacuugguuaugcugcauaauucagagcagggcggucgcgcauauaggcacgcgauggaggaacucccagauaccaucgagacacugaugcuucuggcccucauugcuguguugaccgggggcguaacucuguuuuucuuaaguggacggggccuagggaagacgagcaucggacugcucugugugauagccuccucuguccuucuguggauggcaagcguggaaccccauuggaucgcugccuccauuaucuuggaguuuuuccugaugguucuccugauuccugaacccgaccgucagagaaccccacaggauaaccaacuugcauacguggucaucggucuccuguuuaugauauugacaguagccgcuaaugagaugggccuguuagagacuaccaagaaagaccuagggauuggacacguggcgguugaaaaccaccaucacgccgcaaugcuggauguggaccuccauccugcuucagccuggacacuuuacgccgucgcaaccacuaucauuacacccaugaugaggcacacgaucgagaacaccacugcuaauauaucucugacagccaucgcgaaccaggcugccauuuugaugggccuggauaaggguuggccaaucaguaaaauggacauuggggugccucuccuggcacuuggcugcuauucgcaggucaauccguuaacccugaccgccgcugugcucauguugguugcacauuacgccaucauaggacccggccugcaagcgaaggcuacacgcgaagcccagaaacggacugcagccgggauuaugaagaacccaacgguggauggaaucguagcuaucgaccuagauccuguggucuaugacgccaaguucgagaaacagcugggccagauuaugcuccuuauccuguguaccagccaaauauugcugaugcgaacaacuugggcacucugcgaauccauuacccuggcuacaggucccuuaaccacucuuugggaggggucuccaggaaaguuuuggaauacgacaaucgccguuucaauggcgaacauuuucagaggcagcuaccuggccggugcaggccucgcuuucucccuaaugaaaagucuagggggaggcaggcgcgggaccggagcccagggcgagacuuugggugaaaaguggaaacggcagcugaaucagcucucuaagagcgaguuuaacaccuauaagagaucagggaucauggaaguggaccguuccgaggcaaaagaaggacuuaagaggggcgagacaacuaaacacgcugucagucgggguaccgccaagcugcgcugguucguggagcgaaauuugguaaaaccugaaggcaaggugauagaucugggguguggaagaggcggguggagcuacuauugcgccggacucaagaaaguuacagaggugaagggcuacacgaaaggugggcccggacacgaggagccgaucccaauggcgaccuacggcuggaacuuagucaagcugcauucuggcaaagacguguuuuucauuccucccgaaaagugugauacucuucugugcgacaucggggaguccucaccaaaucccacaauugaggaaggaaggacccuacggguccucaaaaugguggagccuuggcugcgcgguaaccaauuuuguaucaagauuuugaauccguauaugcccagcguuguagaaacucuggagcagaugcagagaaagcacggcgggaugcucgugaggaacccacuuucgcgaaauucuacacaugagauguacugggucaguugcggaaccggcaacaucguguccgcuguuaauaugacgagccggaugcuguuaaaccguuucaccauggcacacagaaaaccuacauaugaacgcgauguggaccugggugccgggacuaggcacgucgcuguggagcccgaaguagccaacuuggauauaauuggacagcggaucgagaauaucaagcaugaacacaaaucaaccuggcauuacgacgaggauaacccuuauaagacaugggcauaccacggcuccuaugaggugaaaccaucuggcagcgccaguuccaugguuaauggggucgugaagcuccugacuaagcccugggacgugauuccuauggucacccaaauagcuaugacagauaccacuccauuuggacagcagagaguuuucaaagaaaagguggacacgcgcacacccaaagcgaagagggguaccgcccaaaucauggagguaacugcaaaauggcuauggggcuuucuuagccgaaacaagaagccgcggauuuguaccagagaagaguucacaaggaaagugcgcucuaaugcugccaucggggcagucuuuguggacgaaaaccaguggaacucagccaaggaggcuguugaggaugaacguuucugggaccuggugcaucgggagagagaacuccacaaacagggaaagugcgccacgugcgucuacaacaugaugggcaaaagggagaagaagcugggugaauuugggaaagcgaagggaagucgcgcaauuugguacaugugguugggcgcccgauuccuggaguucgaggcucucggcuuuaugaaugaagaucacugguucucccgggagaacagccuuucugggguggaaggagagggucugcauaaauuaggcuauauccugagagacauaucgaauaucccugggggaaacauguacgccgaugacaccgcaggcugggauacuaggauuacagaggacgauuugcagaaugaagcucgcaucaccgacauuauggagccagaacacgcccuccuggcuaagucaaucuuuaaacuaacuuaucaaaacaagguaguuagagugcagcggcccaccaaaaaugguaccgucauggaugugauaagcaggcgugaccagcgaggguccggacaggugggcacauacggccuuaacacuuucaccaacauggaggcccaacugauucgccagauggaaagugaggggaucuuuucuccuagcgagcucgaaacgccaaaucuggcagagagagucuuggauugguuagaaaaguauggaguugagcggcugaagaggauggcgaucuccggugacgacugugugguaaaacccguggaugaccgcuucgccaccgcucucacagcccuuaacgauaugggcaaggucagaaaagacauuccgcagugggaaccuucaaagggguggaaugauuggcagcaagugcccuuuugcagucaucacuuccaccagcugauaaugaaagacggacgggagaucguugugccauguaggaaccaggaugagcuagucggccgagcacgugugucucagggugcuggguggagccugagagaaacugccugccucggaaaguccuacgcacaaauguggcaguugauguauuuucaucgccgggaccugaggcuugccgcgaaugcuauuuguucagccguaccuguugauuggauccccaccagcagaacaacuuggucuauucacgcacaucaccaguggaugaccacggaggacaugcuguccguguggaaccgcgucuggaucgaagagaauccauggauggaagauaagacacauauaaguagcuggggcgacgugcccuaccucggcaaacgggaggaccaauggugcgggucguuaaucggacugaccgccagggcuacuugggccacaaacauucagguugcaaucaaucaggugcgaagauugauugguaacgagaauuaccuggauuauaugaccuccaugaagcgguucaaaaacgaaucugacccugagggcgcucucugguga

SEQ ID NO: 13602 - RNA, 9879 nt, Artificial Sequence
  derived and/or modified CDS sequence (opt3) from DENV-1__FJ373297__SS-prME
agcgugacaaugcugcucaugcuuaugcccacagcacuggcuuuccacuugacuacgagaggaggggaaccucauaugaucgucuccaagcaggaaaggggaaaaucuuuacuguuuaagacaucagccgguguuaacaugugcacacugauugccauggaccucggcgaacugugugaagauacuaugaccuacaaaugcccacggauaacagaaguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaaacuuugcauugaagccaaaaucucuaauacgaccacagauagcagauguccaacucaaggagaggcuacccugguugaagaacaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauccagacguccggaaccacaacuauuuuugcaggccauuuaaagugccggcugaaaauggauaagcuaacccucaaagggaugagcuaugucauguguacaggacuguucaaacuugagaaggaaguggccgagacucagcacgguaccguuuuggugcagauaaaauacgagggcacggacgcuccuugcaagaucccauucucgacacaagaugaaaaagggguaacccagaacggacgucugauuacugcgaaucccaucgucacagacaaggagaaaccugugaacauagaagcagagccacccuuuggcgagucuuauauuguuaucggugccggggaaaaggcucucaagcuguccugguucaaaaagggcucaaguaucggaaaaauguuugaggccaccgcacgcggcgccagaaggauggcuauucuuggggauacugccugggacuucggaagcaucgguggcguguuuaccuccgucgggaagcuggugcaucagauuuucggaacagcauacggcguauuguuuucuggugugagcuggacgaugaaaauagggaucggcguucuccugaccugguuaggacuaaauucacggaguacuucccuaagcaugacauguauugcggucggccucgugacccuguaccuuggggugaugguccaggcugauucuggaugcguuaucaacuggaagggccgagaauugaagugugguucagggaucuucgugacaaaugaggugcacacuuggaccgaacaauauaaauuucaggccgacaguccgaagcgccugagcgcagccauuggaaaggcuugggaggagggcguaugcgguauaagauccgccacgaggcucgaaaacaucauguggcggcagauuucuaacgagcugaaucauaucuuacuggaaaacgacaugaaguucacagucgugguuggcgauguggucgggauucuugcacagggcaagaagaugauccgcccucaacccauggagcacaaauacucguggaaaagcuggggcaaggcuaagauaaucggggccgacgugcagaauaccacuuuuauuaucgauggaccaaacaccccugaaugucccgacgaucagagagcguggaauauuugggagguugaggacuauggcuucgguaucuuuacaacuaacauaugguugaagcucagggauuccuacacccaggugugcgaccaccgucugaugucagccgcuauuaaagauaguaaggcaguacaugccgacaugggguauuggaucgaaucugagaaaaaugaaacauggaagcuagcucgggccagcuucauugaggucaagacguguaucuggccaaaaucccacacccuguggucaaacggagugcucgaaagcgagaugauaauccccaagauuuacggcgguccuaucucucaacauaauuaucgaccaggcuacuucacucagacagcagggccguggcaccugggaaaacuugaguuggauuuugaccugugcgaaggcaccacuguggucguugaugagcacugcgggaacagaggacccuccuuaaggacaaccacggugacuggcaagauuauccaugaaugguguugccgcaguuguacccucccuccacugcgguucaaaggugaggacgggugcugguacggaauggagauaagacccguaaaggaaaaggaggaaaaucuugugaaaagcauggucucugcgggcuccggugagguggacucauuuagucugggcuugcucuguauuagcaucaugaucgaagagguuaugaggucgcgcuggucccgaaagaugcugaugacagggacccuagccguguucuuucugcucauuaugggacagcugacuuggaacgaucuuauccggucuugcauuauggucggcgcuaaugccagcgaccguauggggaugggaacaaccuauuuggcacugauggcuacauucaaaaugagaccuauguuugccgugggcuuacucuucaggcgccugacuucacgggagguucuucugcuaaccauaggucucagucugguggcauccgucgaauugccaaacucucuggaggaauuaggggauggacucgccaugggcaucaugauucugaaacuucugacggacuuucaaagcuaccaguugugggcuacacuccugucccuaaccuucaucaaaacuaccuuuucacugcacuaugcguggaagacaauggccaugguacuuagcauugugagucuccugcccuugugucugucuacuaccucccagaagacgacaugguuaccgguucuccugggcagccuugggugcaaaccucugaccauguucuugaucgcagagaauaagauauggggaagaaaaucguggccacucaacgaagguaucauggcugugggcauugucucaauccugcuaucuagucugcuuaagaacgaugugccccucgccgggccucugauugccggaggcauguugaucgcuuguuacguaauauccgguagcucugcagacuuaagccuggagaaagccgcggagguguccugggaagaggaagcugagcauucaggggccagucacaauauucucgucgaaguucaggaugacggaacuaugaagaucaaagaugaggagagggacgauacacugaccauccuucugaaggcaacuuugcuagccgugagcggcguguauccccugucuauuccagcuacacucuuugucugguacuucuggcaaaagaaaaagcagcgauccggcgugcugugggacaccccuucacccccagaaguugagcgcgcaguacuugaugacgggauauaucggaucaugcagagaggauuacuggguaggagucaggugggcgucgggguguuccaagaaaacguuuuucauacgauguggcacgugacucguggagccguccucauguaccagggcaaacgcuuggagccgagcugggcguccgugaagaaagaccugauuucuuacggugggggauggcggcuccagggcucguggaauaccggcgaggaaguacaggucaucgcuguggagccugggaagaaccccaagaauguucaaacagccccaggaaccuucaaaacacccgaaggugaggugggcgcaauugcccuggauuuuaagccugggacuagcggaucaccaaucgucaacagagaaggcaaaauagugggucuuuaugggaauggaguugugaccacguccggcacauacgucagugcuaucgcccaggcaaaggcuucucaggagggcccccugccugagauugaagacgagguguucaggaaacgaaacuugacuaucauggaucuacacccggggagcggaaagacccggcgcuaucugccagccauuguaagagaagcgaucaagaggaaacuccggacauuaauacuggcccccacccgagugguugcauccgagauggcugaagcccuuaaggguaugccuauuagauaccaaacuaccgcugucaaaucagagcauacaggccgcgagaucguggaccugaugugccacgcaacguuuacuaugaggcucuugucuccagugcguguccccaauuauaacaugaucauuauggaugaagcccauuucaccgacccuagcaguaucgccgcucggggguacauauccacaagaguaggaaugggcgaggcggcagccauuuuuaugaccgcuacuccgcccgguagcguggaagccuucccacagucuaaugcaguuauccaggaugaggaaagggacauuccugagcgcucauggaacuccggguaugaguggaucacagauuuucccggaaagaccgugugguucgucccaaguauaaaaagcggcaaugacauugccaacugucugcgaaagaauggcaagagagugauccagcucucgcggaaaacguuugauacugaauaccaaaagaccaagaacaacgacugggacuacguugugaccaccgauaucucugagaugggggcuaauuucagggcggaccgcgucauugauccucguagaugccugaagcccgugauccuuaaagacggaccagaacggguaauucuagccgguccgaugccugugacuguugcauccgcugcccagaggcgcggccgaauagggagaaaccacaauaaggagggagaucaguauaucuacaugggccagccccugaacaaugacgaggaucaugcacacuggacagaagccaagauguuguuagacaacauuaauaccccagaggguaucauccccgcucuguucgaaccugagcgggaaaagagcgccgcgauugauggggaguauaggcuccgcggcgaggcaagaaagacauuugucgagcugaugaggcggggagaccuuccaguguggcugucauacaaaguggccagugagggcuuccaauauucugaucgucgcuggugcuuugacggggaacgaaacaaucagguccucgaggaaaacauggauguugagauauggacuaaggagggagaaaggaaaaaguugaggccccgguggcuggacgcucgcacguacuccgacccucuagcccugagagaguucaaagaauuugcugcagguaggcggagcgugucaggcgaucucauccuugagauugggaagcugccgcagcacuuaacccagcgagcccaaaaugcuuuggacaaccugguaaugcuccauaauagugaacagggaggcagagccuaucgccacgcaauggaggagcugccagauacaaucgaaacucuuaugcugcucgcguugauugccgugcugaccgguggggucacauuauucuuucuaagcggcaggggacugggcaagaccuccaucgggcuccuuugugugauggcuucuagcgcccuguuguggauggcauccguugagccccauuggauagcugccucaaucauucuggaguucuuucucauggugcugcuuaucccugagcccgaccggcagcguacuccacaggauaaccaacucgcauacgucguaauuggacuguuguucaugauccugacgguggccgcuaaugagauggguuuacuagaaaccaccaaaaaggaccugggcauagggcacguugcgguggagaaccaccaucacgccacuaugcucgaugucgaccuucauccugcaucugcuuggacccuguacgccguggccacaaccauuaucacucccaugaugagacacacaauugaaaacacgaccgcaaauaucaguuugacugcuauagccaaccaggcggcuauccugaugggacucgauaaaggcuggccaauuucgaagauggacaucggugucccucugcuugccuuagggugcuauagccaggugaauccgcugacacucaccgcagccguuuugaugcugguggcucauuacgcaauuaucggccccggacuacaagccaaagcgaccagggaggcucagaagcgcacagccgcaggcauaaugaagaacccaacuguagaugggauuguggccaucgaccuggauccugucguuuaugacgcuaaauuugaaaagcagcucggacagaucaugcuucugauuuuguguacgucccaaauccugcucaugcggaccacaugggcccugugcgagucuauaacuuuagcaaccggcccccuuacaacccugugggaggguucaccagggaaauucuggaauacuacgauugcugugagcauggccaacaucuuucgaggauccuaccucgcgggcgccggucuagcauucagucugaugaagucuuugggcgggggaagaaggggcacaggggcucagggagaaacccugggcgagaaauggaagcgccagcucaaucagcuuagcaagucagaguucaacacuuauaaacgguccgguauuauggaggucgacagaagugaagccaaggaggggcugcguaggggagagaccacaaaacacgcagugagccggggcacugcuaaguugcgcugguuuguagaacgaaaucuggugaaaccugaggguaagguuaucgaucucggcugugggagaggaggcuggucuuacuauugcgccggguuaaagaaagugaccgaagucaagggauacacaaaaggcggucccgggcacgaggaaccgauaccaauggccacguacggauggaaccuggugaaacuucauuccggcaaagacgucuucuuuaucccucccgagaagugugauacccugcuaugcgacauuggcgagucaagcccaaaucccacuaucgaagaggggaggacacuccgggugcugaaaaugguugaaccuugguugcgcggaaaccaauucuguauuaagauccugaauccguauaugcccucgguaguggagacccucgagcagaugcagagaaagcacgguggcaugcuugucaggaacccacugucucgaaauaguacucaugaaauguacuggguguccugcgggacaggaaacauuguuagcgcggugaauaugaccucacggauguuacugaaccguuuuacgauggcucacagaaaaccuaccuaugagcgcgaugucgacuugggcgcagguacaaggcacguggccguagaacccgagguggcuaaccucgauaucauagggcagcggauugaaaauaucaagcaugagcacaaauccacuuggcauuacgacgaggauaacccuuauaagaccugggccuaccacggaucuuaugaaguuaaaccaagcggcagugcauccagcauggucaauggcguggugaagcugcuaacaaagcccugggacgucaucccuaugguuacucaaauugccaugaccgauacaaccccauucgggcagcagagaguguuuaaagagaagguagacacucgcacgcccaaagcuaagaggggaacagcgcaaauaauggaagugaccgcccgauggcuuugggguuuccugucucggaacaaaaagccgagaaucuguacuagggaggaauuuacccgcaagguccguucaaaugcagcuauuggcgccguguucguugacgagaaccaguggaauagugcaaaagaggccguggaagaugagcgguuuugggaccucguccauagagaaagggagcugcacaagcaggggaaaugcgcuacaugcguguacaacaugaugggaaagcgcgagaaaaaguugggcgaguucgguaaggccaaagggucccgagcgaucugguacauguggcugggagcacgguuucucgaguucgaagcccuuggcuucaugaaugaggaucacugguuuagcagagaaaacucucugucgggcguagagggggagggauuacauaagcuggguuauauuuugagggacaucucaaaaauaccuggcgggaauauguacgcugaugacacggccggaugggauacccgcaucacugaagacgaucuccagaacgaggcaaagauuacagacaucauggaaccagagcacgcucugcuagccaccagcauuuucaaacuuacuuaucaaaauaagguugugagaguccagcggcccgcuaggaacggcacagugauggaugugaucucccgucgagaccagcgcgguagugggcaggucggaaccuacggccugaauacauuuacuaacauggaagcccaacucauaagacagauggagucugagggcauuuucagcccuuccgaacuggagaccccaaacuuggcagaacggguuuuagauuggcuggagaaacaugggguggaaaggcucaagcgcauggcgaucucaggagacgacuguguagugaagcccaucgaugacagauuugccacggcucuuagugcccugaaugauauggguaaaguccggaaggacauuccgcagugggagccuucuaaaggcuggaacgauuggcagcaagugcccuucugcagccaccacuuucaucagcuaauaaugaaggacgggagggagaucguugugccaugucgaaaucaggaugaacuggucggacgugcaagagugucccagggcgcugguuggucacuccgcgagaccgccugcuuggggaaaagcuaugcacaaauguggcagcugauguacuuccaccggagggaccuuagacuggccgcgaacgcuauuuguucugccguaccuguugauugggugcccacaaaucgcacuaccugguccauccaugcacaccaucaguggaugacaacugaagacaugcucagugucuggaaccggguguggauugaggaaaauccauggauggaggauaagacccacaucagcucguggggagacguucccuauuuaggcaagagggaggaccaauggugcggcucccugauaggguugacggcccgagcuacaugggccaccaacauccagguggcaauuaaucaggucagacggcugaucggaaacgaaaauuaccucgauuacaugacuucuaugaaaagguuuaagaacgacucagauccugagggugcucuuugguga

SEQ ID NO: 13603 - RNA, 9879 nt, Artificial Sequence
  derived and/or modified CDS sequence (opt3) from DENV-1__FJ024448__SS-prME
agcgugaccaugcugcucaugcuuaugcccaccgcacuggcuuuccacuugacuacgcggggcggggaaccucauaugaucgucuccaagcaggaaaggggaaaaucuuuacuguuuaagaccucagccgguguuaacaugugcacgcuaauugccauggaccucggcgaacugugugaagauacuauaaccuacaaaugcccacggaucacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauucagaggguggaaaccugggcccuccggcacccuggauucacaguuaucgcucuguuucuggcacaugccauuggcaccucgaucacgcagaagggcauaaucuucauucucuuaaugcuggugacuccaucaauggcuaugcgcugcgucgggaucggaagcagagauuuuguggagggucuuaguggcgccacauggguagacguuguguuggagcacggguccugugucaccacuauggcgaaggauaaacccacacuggacauugaacuacucaagaccgaggugacgaacccugcagugcugaggaaacuuugcaucgaagccaagauaucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauuaccugcgcaaaguuuaagugcguaacaaaacuggaggggaagaucgugcaguacgaaaacuuaaaauauucagucauugugaccguucacacuggagaccagcaucaaguggguaaugagaguacggaacacggcacaaccgcuacuaucacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauucagacaucuggaacuaccacaauauuugcaggccauuuaaaaugccgucugaagauggauaaacuaacucuccgcgggauguccuaugugauguguaccgggucguucaagcuggagaaagaagucgccgagacgcagcacgguacagugcuuguucagaucaaguacgagggcaccgacgcuccuugcaagauuccauucucgacucaagaugaaaaaggggugacacagaacggaagauugaucaccgcgaaucccauaguaacugacaaggagaaaccugucaacauugaagcagagccacccuuuggcgagucuuauaucgugaucggugccggggaaaaggcucugaaacucuccugguucaagaagggcucaaguauuggaaaaauguuugaggccaccgcaaggggcgcccggcgaauggcuauccugggggauacagccugggacuucggaagcauugguggcguuuuuacguccguggggaaacuuguccaucagauauucggaaccgcauacggcgugcuguuuucugguguaagcuggacuaugaaaaucgggauuggcguguugcucacauggcugggauuaaauucacgcaguaccucccugagcaugacauguaucgcgguuggccuagucacucucuaccugggggugauggugcaggcugauucuggaugcgucaucaacuggaagggcagagaacuuaaaugugguucagggauuuucguuaccaaugaggugcacacguggacagaacaauauaaguuucaggccgacaguccgaagagguugagcgcagccauaggaaaggcuugggaggagggcgugugcgguauccgguccgccacccgccuggaaaacauuauguggaagcagaucucuaacgagcucaaucauauucuguuagaaaacgacaugaaauucacuguagucgugggcgauguugcagggauccuggcucagggaaagaaaaugauaagaccucaacccauggagcacaaguacucguggaaaagcuggggcaaggccaagaucauuggggcggacgugcagaauaccacauuuaucauugauggaccaaacacuccugaaugucccgacgaucagagggccuggaauaucugggaggucgaggacuauggcuucgguauauuuaccacaaacauuuggcuuaaauugcgugauuccuacacacaggugugcgaccaccggcucaugucagcugcaaucaaggauaguaaagccguucaugcugacaugggguauuggauugaaucugagaagaaugaaaccuggaaacuggcccgagcauccuucaucgaggugaagacuuguauauggccaaagucccacacacuauggucaaacggaguacuggaaagcgagaugaucauucccaaaaucuacggcgguccuauuucucaacauaauuauagaccaggcuacuucacccagacugcggggccguggcaccucggaaagcuggagcuugauuuugacuugugcgaaggcacaaccgucgugguggaugagcacugcgggaacaggggacccucccugcgcacgacuaccgucacaggcaaaaucauacaugaaugguguugccggaguuguaccuuaccuccacucagauucaggggugaggacgggugcugguacggaauggagauucgccccguuaaggaaaaagaggaaaaucugguaaagagcaugguaucugccggcuccggugagguggacucauuuagucuuggccuguuguguaucagcaucaugauugaagaggucaugcgaucgcgguggucccguaagaugcucaugacugggacacuggcuguguucuuucuacugaucaugggacagcucaccuggaacgaucugauuagacuuugcauaaugguuggcgccaaugcaucugacaggauggggaugggaacaacuuauuuggcucugauggccaccuucaaaaugcgcccuauguuugcagugggcuuacucuuccggagacugacgagcagggagguccuucugcuaacaaucggucucucacugguggccaguguugaauugccaaacucccuggaggaauuaggggauggacucgcuaugggcauuaugauccugaaacuucugaccgacuuucaaucucaccaguugugggcgacucuccugagccuaaccuucauuaaaacaacuuuuucccugcauuacgccuggaagaccauggcaauggugcuuucaaucgucagccucuucccccuguguuugaguacgacaucucagaaaaccacuuggcugccgguauuacucggcucccuggggugcaagccucuuacaauguuucugauagcugagaauaagaucuggggacgacgcagcuggccauugaacgaagguauuauggccgugggcaucguuucgauucuccugucaucucuacugaaaaacgaugugccccuugccgggccucucaucgcuggaggcaugcugauagcauguuaugucauuagugguuccagcgccgacuugucuuuagagaaggcggcugaggugagcugggaagaggaagccgagcacuccggggcaucacauaauauccugguagaagugcaggaugacggaaccaugaaaaucaaggaugaggagcgggacgauacucucacaauucugcuuaaagccacccuguuggcugcaaguggcgucuacccccuaagcauaccagccacgcuguucguuugguauuucuggcaaaagaaaaagcagagaucuggcgugcucugggacacuccuucacccccagaaguggagagggcgguccuggaugacgggaucuaccguauuaugcagcgcggacuuuuaggucggagccaggugggcguugggguauuucaagaaaacguguuccacaccauguggcacgucacaagaggagcugugcugauguaucagggcaagaggcucgagccgaguugggccagcguuaaaaaggacuugaucuccuacggugggggauggcgacugcagggcucuuggaauaccggcgaggaagugcaggucauugcaguggagccugggaaaaaccccaagaauguacaaacagccccaggaacuuuuaaaacccccgaaggugaggucggcgcuaucgcccucgauuucaagccugggacgucgggaagcccaauagugaaccgggaaggcaagaucguuggucuguacgggaauggaguggucacaacuucaggcaccuauguguccgcaauugcucaggccaaagcgagucaggagggcccccuuccugagaucgaagacgagguuuuucgcaagagaaaccugacaauuauggauuugcauccggggucuggaaaaaccaggcgguaccuaccagccaucgugcgagaagcaauaaagagaaaacugcgcacucucauuuuagcucccaccagggucguggccagcgagauggcugaagcacugaaggguaugccuauccguuaucaaacaacggccguaaaguccgagcacacuggcaaagagaucguggaccuuaugugccaugccaccuucacaaugcggcugcucucaccaguuagaguccccaauuacaacaugauuaucauggaugaagcucacuuuaccgacccuucuagcauagcggcaaggggguauauuaguacucgcgugggaaugggcgaggccgcugccaucuucaugacagcaaccccgcccgguuccguggaagccuuuccacagagcaaugcugucauucaggaugaggaacgagacaucccugagagaucuuggaacucaggguacgaguggauaacggauuuccccggaaagacuguaugguuugugccauccauuaaaaguggcaaugacaucgcgaacuguuugcggaagaauggcaaaaggguuauccagcugagccgcaagacauucgauaccgaauaucaaaagaccaaaaacaacgacugggacuacguggucacuacagauauuucggagaugggggccaauuuccgugcagacagagugaucgauccucggaggugccucaagcccguuauucugaaagacggaccagaacgcgugauacuugcugguccgaugccugucaccguggccucugcagcccagcgaagaggccggaucgggaggaaccauaauaaggagggagaucaguacauuuauaugggccagccccuaaacaaugacgaggaucacgcucacuggacagaagccaaaaugcuguuggacaacaucaauacuccagaggguaucauucccgcguuauuugaaccugagcgcgaaaaguccgcagccauagauggggaguacagacugaggggcgaggcucggaagacguucguagaacucaugcgucgcggagaccugccaguguggcuuagcuauaaaguugccucagagggcuuucaauacagugaucgaagauggugcuucgacggggaaaggaacaaucagguccuggaggaaaacauggauguggagaucuggaccaaggagggagaacggaaaaagcuccgccccagaugguuggacgcuaggacauauucugacccucuggcacuacgggaguuuaaagaguucgccgcuggucgaagauccgugagcggcgaucugauucucgagaucgggaaacuuccgcagcaucugacucagcgcgcccaaaaugcauuagacaacuuggucaugcugcacaauucagaacagggaggcagggcguaccggcaugccauggaggagcucccagauaccauugaaacacugaugcuucuggcucucaucgccguuuugaccgguggggugacucuguuuuucuuaaguggccguggacuaggcaaaacgagcauagggcugcucuguguaauggcauccucugugcuucuguggauggcuagcgucgagccccacuggaucgccgcauccauuaucuuggaauuuuuccugauggugcuccugauuccugagcccgacagacagaggaccccacaggauaaccaacuugccuauguugugaucggacuccuguuuaugauauugacagucgcugcgaaugagaugggucuguuagaaacuaccaagaaggaccuaggcauugggcacguagccguggagaaccaucaccaugcagcuaugcuggauguugaccuccacccugccucagccuggacacuuuacgcaguggcuaccacuaucauuacacccaugaugcgccauacgaucgaaaacaccacugccaauauaucucugacagcgaucgcuaaccaggccgcaauuuugaugggacuggauaaaggcuggccaaucaguaagauggacauuggugucccucuccuggcccuugggugcuacagccaggugaauccguuaacccugaccgcugcaguccucauguugguggcccacuaugcgaucauaggccccggacugcaagcuaaagccacacgggaggcacagaagcgaacugccgcuggcauuaugaaaaacccaacgguugaugggaucguggccaucgaccuagauccuguaguguacgacgcaaaguucgaaaagcagcugggacagauuaugcuccuuauccuguguaccagccaaauauugcugaugagaacaacuugggcucucugcgaguccauuacccuggccacaggccccuuaaccacucuuugggaggguucuccagggaaauuuuggaauacgacaaucgcggucucaauggccaacauuuucaggggaagcuaucuggcaggcgcuggucucgccuucucccuaaugaagagucugggcgggggacgccggggcaccggggcacagggagaaacuuugggcgagaaauggaagagacagcugaaucagcucucuaaaagcgaauuuaacaccuacaagcguucagguaucauggagguugacagguccgaagcuaaggaggggcuuaaacggggagagacaacuaagcacgccgugagucgcggcaccgccaaacugcgaugguucgucgaaagaaauuuggugaagccugaggguaaaguaauagaucugggcugugggaggggaggcuggagcuauuacugcgcggggcucaagaaggugacagaaguuaaaggauauacgaagggcggucccgggcaugaggaaccgaucccaauggcuaccuacggauggaacuuagugaaacugcacucuggcaaggacgucuuuuucauuccucccgagaaaugugauacucuucugugcgacaucggcgaguccucaccaaaucccacaauugaagaggggcggacccuacgcgugcucaagauggucgaaccuuggcugagaggaaaccaauuuuguaucaaaauuuugaauccguacaugcccagcgugguugagacucuggagcagaugcagaggaagcaugguggcaugcucguacgaaacccacuuucgagaaauucuacacacgaaauguauugggugaguugcgggaccggaaacaucgucuccgcagugaauaugacgagccguaugcuguuaaacagauucaccauggcccaccgcaagccuacauacgagagggauguugaccugggcgcugguacucggcauguggccgucgaacccgagguggcaaacuuggauauaauugggcagagaaucgaaaauaucaaacacgagcauaagucaaccuggcacuaugacgaggauaacccuuacaaaacaugggccuaucauggauccuacgaaguaaagccaucuggcagcgcuaguuccauggugaauggcguugucaaacuccugacuaagcccugggacgugauuccuauggugacccaaauagcgaugacagauaccacuccauuugggcagcagcgcgucuucaaggagaaaguugacacgaggacacccaaggccaaacgaggaaccgcacaaaucauggaagugacugcuaaguggcuaugggguuuucuuagccggaacaaaaagccgagaauuuguaccagggaggaguucacacgcaagguacguucuaaugccgcaaucggcgccguguuugucgacgagaaccaguggaacucagcuaaagaggccguggaagaugagcgguucugggaccugguucacagagaaagggagcuccacaagcaggggaaaugcgcgacgugcguguauaacaugaugggaaagcgcgagaagaagcugggcgaguuugguaaggcaaaagggagucgagccauuugguacaugugguugggagcucgguuccuggaguucgaagcccucggcuuuaugaaugaggaucauugguucuccagagaaaacagccuuucuggcgucgagggggagggacugcacaaguuagguuacauccugagggacauaucgaaaaucccuggcgggaauauguaugcagaugacaccgcuggaugggauacucgcauuacagaagacgauuugcagaacgaggccagaaucaccgacauuauggaaccagagcaugcucuccuggccaagucaaucuuuaaacuaacuuaccaaaauaaggugguacggguucagaggcccgccaagaauggcacagugauggaugucauaagccgucgagaccagcgcgguuccggacaggugggaaccuauggccuuaauacauucacuaacauggaagcgcaacugauuagacagauggagagugagggcaucuuuucuccuagcgaacucgagaccccaaaccuggccgaacggguguuggauugguuagagaaguacggggucgaaaggcugaagcgcauggcuaucuccggagacgacuguguugugaaacccauugaugacagauucgccacggcacucaccgcucuuaaugauauggguaagguacggaaagacauaccgcagugggagccuucaaagggcuggaacgauuggcagcaagugcccuuuugcagucaccacuuccaucagcugaucaugaaagacgggagggagauugucgugccaugucgaaaucaggaugagcuaguuggacgugccagagugucucagggcgcagguuggagccugcgcgagacagccugccucgggaaguccuaugcgcaaauguggcaguugauguacuuucaccggagggaccugagacuugcugccaacgcaaucuguucagccgucccuguggauuggauucccacuagccgcaccacauggucuauccaugcucaccaucaguggaugacuaccgaagacaugcuguccguauggaaucggguuuggauagaggaaaacccauggauggaggauaagacgcacaucaguagcuggggagacgugcccuaucucggcaaaagggaggaccaauggugcggcucguuaauugggcugacagcccgagcaaccugggcuacuaauauccaggucgccauuaaccaggugagacgguugaucggaaaugaaaacuaccuggauuacaugacauccaugaagagguucaaaaaugagucugacccugaaggugcgcucugguga

SEQ ID NO: 13604 - RNA, 9879 nt, Artificial Sequence
  derived and/or modified CDS sequence (opt3) from DENV-1__FJ182026__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaacaugugcacacuaauugccauggaccucggcgagcugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaacuugccgagacgcagcacgguacagucuuggugcagauaaaguacgagggcaccgacgcuccuugcaaaaucccauucucgacucaaaacgaaaaggggguuacacagaauggacgccugauuaccgcgaaccccaucgugacugauaaagagaagccuguaaauauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggacacagccugggauuucggaagcaucgguggcguguuuacguccguugggaaacuggugcaucagauuuucggaaccgcauacggcgucuuguuuucuggugugagcuggacuaugaagauagggaucggcguacuccugacaugguuaggacugaacucacgaaguaccucccuaagcaugacauguauugcggugggccucguuacucuguaccuuggggucauggugcaggcugacucuggaugcgugaucaauuggaaaggccgcgaauugaagugugguucagggaucuucgucaccaacgagguucacacguggacagaacaauauaaguuucaggccgauaguccgaaaagacugagcgcagccauuggaaaggcuugggaggagggcgugugcgguauaagguccgccacccggcucgaaaacaucauguggaaacagauuucuaaugagcugaaccauaucuuacuggaaaaugacaugaaguucacugugguagucggcgacguggcagggauucuugcucagggcaagaagaugauccgcccucaacccauggaguacaaauauucguggaaaagcuggggcaaggccaagauaaucggggcggauguucagaacaccacauuuauuaucgacggaccaaauacuccugaaugucccgaugaccagagagccuggaacauuugggagguggaggauuacggcuucgguaucuuuaccacaaauauaugguugaagcucagggacuccuauacgcaggucugcgaucaccgucugaugucagcugcaauuaaagacaguaaggccgugcacgcugauaugggguacuggaucgaaucugagaaaaacgaaaccuggaagcuagcccgggcauccuucauugagguuaagacuuguaucuggccaaaaucccauacacuguggucaaauggagugcucgaaagcgagaugauaauccccaagauuuauggcgguccuaucucucaacacaacuaccgaccaggcuacuucacccagacugcggggccguggcaucugggaaaacuugaguuggacuuugaucugugcgaaggcacaaccguagucguggacgagcacugcgggaauagaggacccuccuuaaggacgacuaccgugacaggcaagauuauccacgaaugguguugccgcaguuguacccucccuccacugcgguucagaggugaggaugggugcugguauggaauggagauaaggcccgucaaagaaaaggaggaaaaccuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauuaugggacagcugaccuggaaugaccuuauccguuugugcauuauggugggcgccaacgcaucugauagaauggggaugggaacaacuuaccuggcuuuaauggccaccuucaagaugaggccuauguuugcaguuggccuccuguuccgccggcuuacgagcagagaggugcugcuacucacaauaggucugucauuggucgccaguguggaacugccaaauuccuuagaggaacucggggacggacuggcuaugggcaucaugauucuuaaacuguugaccgauuuucaaucucaucagcucugggcgacucugcuaagccugaccuucaucaagacaacuuuuucccuucacuaugccuggaaaaccauggcaaugguucucucaauugugagccuguuccccuugugucugaguacgacaucucagaagaccacuugguuaccgguccuccugggcucccuugggugcaagccucugacaauguuuuugaucgcugagaacaaaauauggggaaggcgaagcuggccacucaacgaagguaucauggccguaggcauugugucgauccugcuaucaucucugcuuaagaaugacguuccccucgccgggccucugauugcuggaggcauguugaucgcauguuacgugauaagugguuccagcgccgauuuaucucuggagaaagcggcugaggucagcugggaagaggaagccgagcauuccggggcaucacacaacauucucguggaaguacaggacgauggaaccaugaagaucaaagacgaggagcgcgaugacacucugacaauccuucugaaggccaccuugcuagcugugaguggcgucuauccccugagcauuccagcaacacucuucguuugguacuucuggcagaagaagaagcagcggucuggcgugcugugggauacuccuucacccccagaaguggagagagccguccuugacgaugggauauauaggaucaugcagcguggauuacugggucgcagccaggugggcguugggguauuucaagaaaauguguuccauaccauguggcacgucacacggggagcggugcucauguaccagggcaaaagauuggagccgaguugggcuagcguuaagaaagaccugauuuccuacggugggggauggaggcuccagggcucuuggaacgccggcgaggaagugcaggucaucgcaguggagccugggaagaaucccaaaaacguacaaaccgccccaggaacauuuaagacucccgaaggugaggucggcgcuauugcccuggacuucaagccugggaccucgggaagcccaaucgugaaucgagaaggcaaaauaguuggucuuuaugggaacggaguggucacgacaucaggcacuuacguguccgcaaucgcucaggccaaggcgagucaggagggcccccugccugagauugaagaugagguuuuucggaaacgcaauuugaccaucauggaccuacacccggggucuggaaagacaagaagguaucugccagccauugugcgggaagcaaucaaacgaaagcucagaaccuuaauacuggcucccacucgcgucguggccagcgagauggcugaagcacuuaaggguaugccuauuagguaccaaaccacagccguaaaauccgagcauacgggcaaggagaucguggaucugaugugccacgccacuuucaccaugcgucucuugucaccaguucggguccccaacuauaauaugaucauuauggacgaagcucauuuuacagauccuucuagcaucgcggcaagaggguacauaaguaccagggugggaaugggcgaggccgcugccauuuucaugacugcaacaccgcccgguuccguggaagccuuuccacagagcaacgcugucauccaggacgaggaacgcgauauuccugagcgaucuuggaacucaggguaugaguggaucaccgacuuccccggaaaaacgguaugguuugugccauccauaaagaguggcaacgauauugcgaauugucugaggaaaaauggcaagcggguuauccagcucagcaggaagacuuucgacacagaauaccagaaaaccaagaacaaugauugggacuacguggucaccacugacaucucggagaugggggccaacuuccgcgcagaucgugugauugacccuagacggugccugaaacccguuauccuuaaggauggaccagaaagggugauucuagcugguccgaugccugucacaguggccucugcagcccagcgccgaggcagaauagggcggaaucacaacaaagagggagaccaguauaucuacaugggccagccccugaauaacgaugaggaccaugcucacuggaccgaagccaagauguuguuagauaauauuaacacaccagaggguaucauccccgcgcuguuugaaccugagagggaaaaguccgcagccauugacggggaguaucgccucagaggcgaggcuaggaaaacuuucguagaacugaugcggcguggagaucuuccaguguggcugagcuacaagguugccucagagggcuuucaauauagugaccgccgauggugcuucgauggggaaagaaauaaccagguccucgaggaaaauauggacguggagauauggacgaaagagggagaaaggaagaaauugcggccccgcuggcuggaugcuagaaccuacucugacccucuagcacugagggaguuuaaggaguucgccgcuggucggcgauccgugagcggcgaccucauccuugagauugggaaacugccgcagcacuuaacacagagagcccaaaacgcauuggauaaucuggucaugcuccauaacucagaacagggaggccgcgcguauaggcacgccauggaggagcugccagacacuaucgaaacccuuaugcugcucgcuuugauugccguucugacagguggggugaccuuauuuuuccuaaguggccggggacugggcaagacuagcaucgggcuccuuuguguaauggcauccucugugcuguuguggauggcuagcgucgagccccauuggauagccgcauccaucauucuggaauuuuuccucauggugcugcuuaucccugagcccgaucgucagagaacgccacaggacaaucaacucgccuacguugugauuggacuguuguuuaugauccugaccgucgcugcgaacgagauggguuuacuagaaacaacuaagaaagaucugggcauagggcacguagccguggagaaccaccaucacgcagcuaugcucgacguugaucuucauccugccucagccuggacccuguacgcaguggcuacaaccauuaucacucccaugaugaggcacacaauugaaaauacgaccgccaacaucucuuugacugcgauagcuaaucaggccgcaauccugaugggacucgacaagggcuggccaauuaguaaaauggauaucggugucccucugcuugccuuagggugcuauagccaggugaacccgcugacacucaccgcugcagucuugaugcugguggcccauuacgcgauuaucggccccggacuacaagcuaaggccacccgcgaggcacagaaacggacagccgcuggcauaaugaagaauccaacuguugacgggauuguggccaucgaucuggacccuguaguguaugaugcaaaguucgaaaaacagcucggacagaucaugcuucugauuuuguguacgagccaaauccugcucaugcgaaccacaugggcucugugcgaguccauaacuuuagccaccggcccccuuacaacccugugggaggguucuccagggaaguuuuggaacacuacgauugcggucucaauggccaauaucuucagaggaagcuaccucgcaggcgcuggucuagccuucucccugaugaaaaguuugggcgggggaaggcgcggcacaggggcacagggagaaacccugggcgagaaguggaaacggcagcucaaccagcuuucuaagagcgaauuuaauacuuauaagagaucagguauuauggagguugaccguuccgaagcuaaagaggggcugaagaggggagagaccacaaaacacgccgugagucggggcacugccaaguugcgcugguucgucgaacgaaaccuggugaaaccugaggguaagguaaucgaccucggcugugggagaggaggcuggagcuacuauugcgcgggguuaaagaaagugaccgaaguuaagggauacacaaaaggcggucccgggcacgaggaaccgauaccaauggcuacguacggauggaaucuggugaaacuucauucuggcaaagaugucuuuuucaucccucccgagaagugugacacccugcuaugcgauauuggcgaguccucaccaaaccccacuaucgaagaggggaggacacuccgggugcugaaaauggucgaaccuugguugcgcggaaaucaauuuuguauuaagauccugaacccguauaugcccagcgugguugagacccucgagcagaugcagagaaagcacgguggcaugcuuguaaggaauccacugucgcgaaacucuacucaugaaauguacugggugaguugcgggacaggaaauauugucuccgcagugaacaugaccagccggauguuacugaaccguuucacgauggcccacagaaaaccuaccuaugagcgcgacguugauuugggcgcugguacaaggcacguggccgucgaacccgagguggcaaaucucgacaucauagggcagcggauugaaaacaucaagcaugagcacaaaucaacuuggcauuacgaugaggacaauccuuauaagaccugggccuaccacggauccuaugaaguaaaaccaucuggcagcgcuaguuccauggugaacggcguugucaagcugcuaacaaagcccugggaugugaucccuauggugacucaaauugcgaugaccgacacaaccccauuugggcagcagagagucuucaaagagaagguugauacucgcacgcccaaagccaagaggggaacagcacaaauaauggaagugaccgcuaaauggcuuugggguuuucugagccgaaauaagaagccgcggaucuguacuagagaggaguucaccaggaaaguacgcucuaacgccgcaauuggcgccguguuugucgacgagaaucaguggaacucagcuaaggaggccguggaagacgagcguuucugggaucucguucaucgggaaagagagcugcacaaacaggggaagugcgcgacaugcguguacaauaugaugggaaaaagggaaaagaaguugggcgaguuugguaaagcaaaggggagucgcgccaucugguacauguggcugggagcucgauuccucgaguucgaagcccuuggcuuuaugaacgaggaccacugguucucccgggaaaauagccugucuggcgucgagggggagggauuacauaaacuggguuauauuuugagagauaucucgaagauaccuggcgggaacauguacgcagacgauacggcuggaugggacaccaggaucacugaagaugaccuccagaaugaggcccgcauuacagauaucauggaaccagagcacgcucugcuagccaaaucaauuuuuaaacuuaccuaucaaaacaaagugguaagaguucagcggcccgcaaagaauggcacugugauggacgucaucagcaggcgugaucagcgagguuccggacaggugggaacauacggccugaacaccuucacaaacauggaagcgcaacucauacgccagauggagagugagggcauauuuucuccuagcgaacuggagacuccaaauuuggccgaaagaguguuagacuggcuggagaaguauggggucgaacggcucaaaaggauggcuaucuccggagaugacuguguugugaagcccaucgacgaucgcuucgccaccgcacuuacggcucugaacgacauggguaaaguaagaaaggauauuccgcagugggagccuucaaaaggcuggaaugacuggcagcaagugcccuuuugcagucaucacuuccaccagcuaauaaugaaggaugggcgggagaucgucgugccauguaggaaccaggacgaacugguuggacgagcccgugugucucagggcgcagguuggagccucagagagaccgccugcuuggggaaguccuacgcgcaaauguggcagcugauguauuuucaucgccgggaucuuaggcuggcugccaaugcaauuuguucagccgucccuguggacuggauccccacaagcagaacuaccuggucuauucacgcucaucaccaguggaugacaacugaagauaugcucuccguauggaaccgcguuuggaucgaggaaaauccauggauggaggacaaaacccauauaaguagcuggggagaugugcccuacuuaggcaagcgggaggaccaauggugcggcucgcugaucggguugacggccagggcaacaugggcuaccaacauucaggucgccaucaaucaggugcgaagacugauuggaaacgaaaauuaccucgacuauaugacuuccaugaaacgguucaagaacgagucugauccugaaggugcgcuuugguga

SEQ ID NO: 13605 - RNA, 9879 nt, Artificial Sequence
  derived and/or modified CDS sequence (opt3) from DENV-1__FJ182027__SS-prME
agcgugaccaugcugcucaugcuuaugcccaccgcccuggcuuuccacuugacuacgcggggcggggaaccucauaugaucgucuccaagcaggaaaggggaaagucuuuacuguuuaagaccucagccgguguuaauaugugcacgcuaauugccauggaccucggcgaacugugugaagauacuauaaccuacaaaugcccacggaucacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauucagaggguggaaaccugggcccuccggcacccuggauucacaguuaucgcucuguuucuggcacaugccauuggcaccucgaucacgcagaagggcauaaucuucauucucuuaaugcuggugacuccaucaauggcuaugcgcugcgucgggaucggaagcagagauuuuguggagggucuuaguggcgccacauggguagacguuguguuggagcacggguccugugucaccacuauggcgaaggauaaacccacacuggacauugaacuacucaagaccgaggugacgaacccugcagugcugaggaaacuuugcaucgaagccaagauaucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauuaccugcgcaaaguuuaagugcguaacaaaacuggaggggaagaucgugcaguacgaaaacuuaaaauauucagucauugugaccguucacacuggagaccagcaucaaguggguaaugagaguacggaacacggcacaaccgcuacuaucacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauucagacaucuggaacuaccacaauauuugcaggccauuuaaaaugccgucugaagauggauaaacuaacucuccgcgggauguccuaugugauguguaccgggagcuucaagcuggagaaagaagucgccgagacgcagcacgguacagugcuuguucagaucaaguacgagggcaccgacgcuccuugcaagauuccauucucgacucaagaugaaaaaggggugacacagaacggaagauugaucaccgcgaaucccauaguaacugacaaggagaaaccugucaacauugaagcagagccacccuuuggcgagucuuauaucgugaucggugccggggaaaaggcucugaaacucuccugguucaagaagggcucaaguauuggaaaaauguuugaggccaccgcaaggggcgcccggcgaauggcuauccugggggauacagccugggacuucggaagcauugguggcguuuuuacguccguggggaaacuuguccaucagauauucggaaccgcauacggcgugcuguuuucugguguaagcuggacuaugaaaaucgggauuggcguguugcucacauggcugggauuaaauucacgcaguaccucccugagcaugacauguaucgcgguuggccuagucacucucuaccugggggugauggugcaggcugauucuggaugcgucaucaacuggaagggcagagaacuuaaaugugguucagggauuuucguuaccaaugaggugcacacguggacagaacaauauaaguuucaggccgacaguccgaagagguugagcgcagccauaggaaaggcuugggaggagggcgugugcgguauccgguccgccacccgccuggaaaacauuauguggaagcagaucucuaacgagcucaaucauauucuguuagaaaacgacaugaaauucacuguagucgugggcgauguugcagggauccuggcucagggaaagaaaaugauaagaccucaacccauggagcacaaguacucguggaaaagcuggggcaaggccaagaucauuggggcggacgugcagaauaccacauuuaucauugauggaccaaacacuccugaaugucccgacgaucagagggccuggaauaucugggaggucgaggacuauggcuucgguauauuuaccacaaacauuuggcuuaaauugcgugauuccuacacacaggugugcgaccaccggcucaugucagcugcaaucaaggauaguaaagccguucaugcugacaugggguauuggauugaaucugagaagaaugaaaccuggaaacuggcccgagcauccuucaucgaggugaagacuuguauauggccaaagucccacacacuauggucaaacggaguacuggaaagcgagaugaucauucccaaaaucuacggcgguccuauuucucaacauaauuauagaccaggcuacuucacccagacugcggggccguggcaccucggaaagcuggagcuugauuuugacuugugcgaaggcacaaccgucgugguggaugagcacugcgggaacaggggacccucccugcgcacgacuaccgucacaggcaaaaucauacaugaaugguguugccggaguuguaccuuaccuccacucagauucaggggugaggacgggugcugguacggaauggagauucgccccguuaaggaaaaagaggaaaaucugguaaagagcaugguaucugccggcuccggugagguggacucauuuagucuuggccuguuguguaucagcaucaugauugaagaggucaugcgaucgcgguggucccguaagaugcucaugacugggacacuggcuguguucuuucuacugaucaugggacagcucaccuggaacgaucugauuagacuuugcauaaugguuggcgccaaugcaucugacaggauggggaugggaacaacuuauuuggcucugauggccaccuucaaaaugcgcccuauguuugcagugggcuuacucuuccggagacugacgagcagggagguccuucugcuaacaaucggucucucacugguggccaguguugaauugccaaacucccuggaggaauuaggggauggacucgcuaugggcauuaugauccugaaacuucugaccgacuuucaaucucaccaguugugggcgacucuccugagccuaaccuucauuaaaacaacuuuuucccugcauuacgccuggaagaccauggcaauggugcuuucaaucgucagccucuucccccuguguuugaguacgacaucucagaaaaccacuuggcugccgguauuacucggcucccuggggugcaagccucuuacaauguuucugauagcugagaauaagaucuggggacgacgcagcuggccauugaacgaagguauuauggccgugggcaucguuucgauucuccugucaucucuacugaaaaacgaugugccccuugccgggccucucaucgcuggaggcaugcugauagcauguuaugucauuagugguuccagcgccgacuugucuuuagagaaggcggcugaggugagcugggaagaggaagccgagcacuccggggcaucacauaauauccugguagaagugcaggaugacggaaccaugaaaaucaaggaugaggagcgggacgauacucucacaauucugcuuaaagccacccuguuggcugucaguggcguuuacccccuaagcauaccagcaacgcuguucgugugguauuucuggcaaaagaaaaagcagagaucuggcgugcucugggacacuccuucacccccagaagucgagagggccgugcuggaugacgggaucuaccguauuaugcagcgcggacuuuuaggucggagccagguuggcguagggguguuucaagaaaacgucuuccacaccauguggcacgugacaagaggagcgguucugauguaucagggcaagaggcucgagccgaguugggcuagcgugaaaaaggacuugaucuccuacggugggggauggcgacugcagggcucuuggaauaccggcgaggaaguccaggugauugccguagagccugggaaaaaccccaagaauguccaaacagcaccaggaacuuuuaaaacccccgaaggugaggugggcgccaucgcucucgauuucaagccugggacgucgggaagcccaauaguuaaccgggaaggcaagaucgugggucuguacgggaauggagucgugacaacuucaggcaccuauguuuccgccauugcacaggcuaaagccagucaggagggcccccuuccugagaucgaagacgagguguuucgcaagagaaaccugacaauuauggauuugcauccggggucuggaaaaaccaggcgguaccuaccagcgaucguccgagaagccauaaagagaaaacugcgcacucucauuuuagcacccaccagggugguagcuagcgagauggccgaagcucugaaggguaugccuauccguuaucaaacaacggcagugaaguccgagcacacuggcaaagagaucguugaccuuaugugccaugccaccuucacaaugcggcugcucucaccagucagagugcccaauuacaacaugauuaucauggaugaagcccacuuuaccgacccuucuagcauagcugcgaggggguauauuaguacucgcgugggaaugggcgaggcagccgcuaucuucaugacagccaccccgcccgguuccgucgaagcauuuccacagagcaaugccguaauucaggaugaggaacgagacaucccugagagaucuuggaacucaggguacgaguggauaacggauuuccccggaaagacugugugguuuguuccauccauuaaaaguggcaaugacaucgcuaacuguuugcggaagaauggcaaaagggugauccagcugagccgcaagacauucgauaccgaauaucaaaagaccaaaaacaacgacugggacuacgucgugacuacagauauuucggagaugggggcgaauuuccgugccgacagaguuaucgauccucggaggugccucaagcccgugauucugaaagacggaccagaacgcgucauacuugcagguccgaugccugugaccguagcuucugccgcacagcgaagaggccggaucgggaggaaccauaauaaggagggagaucaguacauuuauaugggccagccccuaaacaaugacgaggaucacgcccacuggacagaagcuaaaaugcuguuggacaacaucaauacuccagaggguaucauucccgccuuauuugaaccugagcgcgaaaaguccgcggcaauagauggggaguacagacugaggggcgaggcccggaagacguucguggaacucaugcgucgcggagaccugccaguuuggcuuagcuauaaagucgcuucagagggcuuucaauacagugaucgaagauggugcuucgacggggaaaggaacaaucaggugcuggaggaaaacauggauguggagaucuggaccaaggagggagaacggaaaaagcuccgccccagaugguuggacgccaggacauauucugacccucuggcucuacgggaguuuaaagaguucgcagccggucgaagauccgucagcggcgaucugauucucgagaucgggaaacuuccgcagcaucugacucagcgcgcucaaaaugccuuagacaacuugguuaugcugcacaauucagaacagggaggcagggcauaccggcaugcgauggaggagcucccagauaccauugaaacacugaugcuucuggcccucaucgcuguguugaccggugggguaacucuguuuuucuuaaguggccguggacuaggcaaaacgagcauagggcugcucugugugauggccuccucuguccuucuguggauggcaagcguggagccccacuggaucgcugccuccauuaucuuggaauuuuuccugaugguucuccugauuccugagcccgacagacagaggaccccacaggauaaccaacuugcauauguggucaucggacuccuguuuaugauauugacaguagccgcuaaugagaugggucuguuagaaacuaccaagaaggaccuaggcauugggcacguggcgguugagaaccaucaccaugccgcaaugcuggauguggaccuccacccugcuucagccuggacacuuuacgccgucgcaaccacuaucauuacacccaugaugcgccauacgaucgaaaacaccacugcuaauauaucucugacagccaucgcgaaccaggcugccauuuugaugggacuggauaaaggcuggccaaucaguaagauggacauuggugugccucuccuggcacuugggugcuacucgcaggucaauccguuaacccugaccgccgcugugcucauguugguugcacacuaugccaucauaggccccggacugcaagcgaaagcuacacgggaggcccagaagcgaacugcagccggcauuaugaaaaacccaacgguggaugggaucguagcuaucgaccuagauccuguggucuacgacgccaaguucgaaaagcagcugggacagauuaugcuccuuauccuguguaccagccaaauauugcugaugagaacaacuugggcacucugcgaguccauuacccuggcuacaggccccuuaaccacucuuugggaggguucuccagggaaauuuuggaauacgacaaucgccguuucaauggcgaacauuuucaggggaagcuaucuggccggcgcaggucucgcuuucucccuaaugaagagucugggcgggggacgccggggcaccggggcccagggagaaacuuugggcgagaaauggaagagacagcugaaucagcucucuaaaagcgaauuuaacaccuacaagcguucagguaucauggagguggacagguccgaagcaaaggaggggcuuaaacggggagagacaacuaagcacgcugucagucgcggcaccgccaaacugcgaugguucguggaaagaaauuugguaaagccugaggguaaagugauagaucugggcugugggaggggaggcuggagcuauuacugcgccgggcucaagaagguuacagaagugaaaggauauacgaagggcggucccgggcaugaggaaccgaucccaauggcgaccuacggauggaacuuagucaaacugcacucuggcaaggacguguuuuucauuccucccgagaaaugugauacucuucugugcgacaucggcgaguccucaccaaaucccacaauugaagaggggcggacccuacgcguccucaagaugguggaaccuuggcugagaggaaaccaauuuuguaucaaaauuuugaauccguacaugcccagcguuguagagacucuggagcagaugcagaggaagcaugguggcaugcucgugcgaaacccacuuucgagaaauucuacacacgaaauguauugggucaguugcgggaccggaaacaucguguccgcuguuaauaugacgagccguaugcuguuaaacagauucaccauggcacaccgcaagccuacauacgagagggauguggaccugggcgccgguacucggcaugucgcuguggaacccgagguagccaacuuggauauaauugggcagagaaucgaaaauaucaaacacgagcauaagucaaccuggcacuaugacgaggauaacccuuacaaaacaugggcauaucauggauccuacgaagugaagccaucuggcagcgccaguuccaugguuaauggcgucgugaaacuccugacuaagcccugggacgugauuccuauggucacccaaauagcuaugacagauaccacuccauuugggcagcagcgcguuuucaaggagaaaguggacacgaggacacccaaggcgaaacgaggaaccgcccaaaucauggaaguaacugcaaaguggcuaugggguuuucuuagccggaacaaaaagccgagaauuuguaccagggaggaguucacacgcaaggugcguucuaaugcugccaucggcgcagucuuuguggacgagaaccaguggaacucagccaaagaggcuguugaagaugagcgguucugggaccuggugcacagagaaagggagcuccacaagcaggggaaaugcgccacgugcgucuauaacaugaugggaaagcgcgagaagaagcugggcgaguuugguaaggcgaaagggagucgagcaauuugguacaugugguugggagcccgguuccuggaguucgaagcucucggcuuuaugaaugaggaucauugguucuccagagaaaacagccuuucuggcguggagggggagggacugcacaaguuagguuacauccugagggacauaucgaaaaucccuggcgggaauauguaugccgaugacaccgcaggaugggauacucgcauuacagaagacgauuugcagaacgaggcuagaaucaccgacauuauggaaccagagcaugcccuccuggcuaagucaaucuuuaaacuaacuuaccaaaauaagguaguucgggugcagaggcccgccaaaaacggcacagucauggaugugauaagccgucgagaccagcgcgguuccggacaggugggaaccuauggccuuaauacauucacuaacauggaagcacaacugauuagacagauggagagugagggcaucuuuucuccuagcgaacucgagaccccaaaccuggcggaacgggucuuggauugguuagagaaguacgggguugaaaggcugaagcgcauggccaucuccggagacgacugugugguaaaacccauugaugacagauucgcuacggcccucaccgcacuuaaugauauggguaaggugcggaaagacauaccgcagugggagccuucaaagggcuggaacgauuggcagcaaguccccuuuugcagucaccacuuccaucagcugaucaugaaagacgggagggagauugugguuccaugucgaaaucaggaugagcuagugggacgugcuagagucucucagggcgccgguuggagccugcgcgagacagcaugccucgggaaguccuaugcccaaauguggcaguugauguacuuucaccggagggaccugagacuugcggcuaacgccaucuguucagcagugccuguagauuggauucccacuagccgcaccacauggucuauccaugcccaccaucaguggaugacuaccgaagacaugcuguccguuuggaaucggguguggauagaggaaaacccauggauggaggauaagacgcacaucaguagcuggggagacguccccuaucucggcaaaagggaggaccaauggugcggcucguuaauugggcugacagcucgagccaccugggcaacuaauauccagguggcuauuaaccagguuagacgguugaucggaaaugaaaacuaccuggauuacaugacauccaugaagagguucaaaaaugagucugacccugaaggugcccucugguga

SEQ ID NO: 13606 - RNA, 9879 nt, Artificial Sequence
  derived and/or modified CDS sequence (opt3) from DENV-1__FJ024449__SS-prME
agcgugaccaugcugcucaugcuuaugcccacagcccuggcuuuccacuugacuacgagaggaggggagccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauuaucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaaaaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauucccacacgcaggucugcgaccaccgucucaugucagcugcaaucaaagauaguaaggccgugcaugcugacaugggguauuggauugaaucugagaaaaaugaaaccuggaagcuggcccgggcauccuucaucgagguuaagacuuguauauggccaaaaucccacacacuauggucaaacggagugcuggaaagcgagaugaucauucccaagaucuacggcgguccuauuucucaacauaauuaucgaccaggcuacuucacccagacugcggggccguggcaccucggaaaacuggagcuugauuuugacuugugcgaaggcacaaccguagucguggaugagcacugcgggaacagaggacccucccugaggacgacuaccgugacaggcaagaucauacaugaaugguguugccgcaguuguaccuuaccuccacuccgguucagaggugaggacgggugcugguacggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuucuuucuacugaucaugggacagcucaccuggaacgaucugauucgucuuugcauaauggugggcgccaaugcaucugacagaauggggaugggaacaacuuauuuggcucugauggccaccuucaagaugaggccuauguuugcaguuggcuuacucuuccgccggcugacgagcagagaggugcuucugcuaacaaucggucucucacuggucgccaguguggaauugccaaacucccuggaggaauuaggggauggacucgcuaugggcauuaugauccugaaacuucugaccgacuuucaaucucaccaguugugggcgacucuccugagccuaaccuucauuaagacaacuuuuucccugcauuacgccuggaaaaccauggcaaugguucuuucaaucgugagccucuucccccuguguuugaguacgacaucucagaagaccacuuggcugccggucuuacucggcucccuggggugcaagccucuuacaauguuucugauagcugagaauaaaaucuggggaaggcgaagcuggccauugaacgaagguauuauggccguaggcaucgugucgauucuccugucaucucuacugaagaacgauguuccccuugccgggccucucaucgcuggaggcaugcugauagcauguuaugugauuagugguuccagcgccgacuugucuuuagagaaagcggcugaggucagcugggaagaggaagccgagcacuccggggcaucacauaauauccugguggaaguacaggaugacggaaccaugaagaucaaagaugaggagcgcgacgauacucucacaauucugcuuaaggccacccuguuggcugugaguggcgucuacccccuaagcauaccagcaacgcuguucguuugguauuucuggcagaaaaagaagcagcggucuggcgugcucugggacacuccuucacccccagaaguggagagagccguccuggaugacgggaucuacaggauuaugcagcguggacuuuuaggucgcagccaggugggcguugggguauuucaagaaaacguguuccacaccauguggcacgucacacggggagcggugcugauguaucagggcaaaagacucgagccgaguugggcuagcguuaagaaagacuugaucuccuacggugggggauggaggcugcagggcucuuggaauaccggcgaggaagugcaggucauugccguggagccugggaagaaccccaaaaauguacaaacagcaccaggaacuuuuaagacccccgaaggugaggucggcgccaucgcucucgauuucaagccugggacgucgggaagcccaauagugaaccgagaaggcaaaaucguuggucuguacgggaauggaguggucacaacuucaggcaccuauguguccgccauugcacaggcuaaggccagucaggagggcccccuuccugagaucgaagacgagguuuuucggaaacgcaaccugacaauuauggauuugcauccggggucuggaaagaccagaagguaccuaccagcgaucgugcgggaagccauaaaacgaaagcugagaacucucauuuuagcacccacccgcgucguggcuagcgagauggccgaagcucugaaggguaugccuaucagguaucaaacaacggcaguaaaauccgagcacacuggcaaggagaucguggaccuuaugugccaugccaccuucacaaugcgucugcucucaccaguucggguccccaauuacaacaugauuaucauggaugaagcccacuuuaccgacccuucuagcauagcugcgagaggguauauuaguacuagggugggaaugggcgaggcagccgcuaucuucaugacagccaccccgcccgguuccguggaagcauuuccacagagcaaugccgucauucaggaugaggaacgcgacaucccugagcgaucuuggaacucaggguacgaguggauaacggauuuccccggaaaaacuguaugguuugugccauccauuaagaguggcaaugacaucgcuaacuguuugaggaaaaauggcaagcggguuauccagcugagcaggaagacauucgauaccgaauaucagaaaaccaagaacaacgacugggacuacguggucacuacagauauuucggagaugggggcgaauuuccgcgccgaccgugugaucgauccuagacggugccucaaacccguuauucugaaggacggaccagaaagggugauacuugcagguccgaugccugucaccguggcuucugccgcacagcgccgaggcagaaucgggcggaaccauaauaaagagggagaucaguacauuuauaugggccagccccuaaacaaugacgaggaucacgcccacuggacagaagcuaagaugcuguuggacaacaucaauacuccagaggguaucauucccgccuuauuugaaccugagagggaaaaguccgcggcaauagauggggaguaccgccugagaggcgaggccaggaaaacguucguagaacucaugcggcguggagaccugccaguguggcuuagcuauaagguugcuucagagggcuuucaauacagugaucgccgauggugcuucgacggggaaagaaacaaucagguccuggaggaaaacauggauguggagaucuggaccaaagagggagaaaggaagaaacuccggccccgcugguuggacgccagaacauauucugacccucuggcucuaagggaguuuaaggaguucgcagccggucggcgauccgugagcggcgaucugauucucgagaucgggaaacuuccgcagcaucugacucagagagcucaaaaugccuuagacaacuuggucaugcugcacaauucagaacagggaggccgcgcauacaggcaugcgauggaggagcucccagauaccauugaaacacugaugcuucuggcccucaucgcuguuuugaccgguggggugacucuguuuuucuuaaguggccggggacuaggcaagacgagcauagggcugcucuguguaauggccuccucugugcuucuguggauggcaagcgucgagccccacuggaucgcugccuccauuaucuuggaauuuuuccugauggugcuccugauuccugagcccgaccgucagagaaccccacaggauaaccaacuugcauauguugugaucggacuccuguuuaugauauugacagucgccgcuaaugagaugggucuguuagaaacuaccaagaaagaccuaggcauugggcacguagcgguggagaaccaucaccaugccgcaaugcuggauguugaccuccacccugcuucagccuggacacuuuacgccguggcaaccacuaucauuacacccaugaugaggcauacgaucgaaaacaccacugcuaauauaucucugacagccaucgcgaaccaggcugccauuuugaugggacuggauaagggcuggccaaucaguaaaauggacauuggugucccucuccuggcacuugggugcuacagccaggugaauccguuaacccugaccgccgcuguccucauguugguggcacacuaugccaucauaggccccggacugcaagcgaaggcuacacgcgaggcccagaaacggacugcagccggcauuaugaagaacccaacgguugaugggaucguggcuaucgaccuagauccuguaguguacgacgccaaguucgaaaaacagcugggacagauuaugcuccuuauccuguguaccagccaaauauugcugaugcgaacaacuugggcacucugcgaguccauuacccuggcuacaggccccuuaaccacucuuugggaggguucuccagggaaguuuuggaauacgacaaucgccgucucaauggcgaacauuuucagaggaagcuaucuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuacaagagaucagguaucauggagguugaccguuccgaagcaaaagaggggcuuaagaggggagagacaacuaaacacgcugugagucggggcaccgccaagcugcgcugguucgucgaacgaaauuuggugaaaccugaggguaagguaauagaucugggcugugggagaggaggcuggagcuauuacugcgccgggcucaagaaagugacagaaguuaagggauauacgaaaggcggucccgggcaugaggaaccgaucccaauggcgaccuacggauggaacuuagugaagcugcacucuggcaaagacgucuuuuucauuccucccgagaagugugauacucuucugugcgacaucggcgaguccucaccaaaucccacaauugaagaggggaggacccuacgggugcucaaaauggucgaaccuuggcugcgcggaaaccaauuuuguaucaagauuuugaauccguacaugcccagcgugguugagacucuggagcagaugcagagaaagcaugguggcaugcucguaaggaacccacuuucgcgaaauucuacacacgaaauguauugggugaguugcgggaccggaaacaucgucuccgcugugaauaugacgagccggaugcuguuaaaccguuucaccauggcacacagaaaaccuacauacgagcgcgauguugaccugggcgccgguacuaggcauguggcugucgaacccgagguggccaacuuggauauaauugggcagcggaucgaaaauaucaagcacgagcauaaaucaaccuggcacuaugacgaggauaacccuuacaagacaugggcauaucauggauccuacgacguaaaaccaucuggcagcgccaguuccauggugaauggcguugucaagcuccugacuaagcccugggaugugauuccuauggugacccaaauagcuaugacagacaccacuccauuugggcagcagagagucuucaaagaaaagguugacacgcgcacacccaaagcgaagaggggaaccgcccaaaucauggaggugacugcaaaauggcuaugggguuuucuuagccgaaacaagaagccgcggauuuguaccagagaagaguucacaaggaaaguacgcucuaaugcugccaucggcgcaguguuugucgaugaaaaccaguggaacucagccaaggaggcuguggaggacgaacguuucugggaucugguucaccgggagagagaacuccacaaacaggggaagugcgccacgugcguguauaacaugaugggaaaaagggagaagaagcugggcgaauuugguaaagcgaaggggagucgcgcaauuugguacaugugguugggagcccgauuccuggaguucgaggcucucggcuuuaugaaugaagaccauugguucucccgggagaacagccuuucuggcgucgaaggggagggacugcacaaauuagguuacauccugagagauauaucgaagaucccuggcgggaauauguaugccgacgauaccgcaggaugggacacuaggauuacagaggaugacuugcagaacgaagcucgcaucaccgauauuauggagccagaacaugcccuccuggcuaaaucaaucuuuaagcuaacuuaccaaaauaaagugguaagaguucagcggcccgccaagaacggcacagugauggacgucauaagcaggcgugaucagcgagguuccggacaggugggaaccuauggccuuaauacauucacuaacauggaggcacaacugauucgccagauggaaagugagggcaucuuuucuccuagcgagcucgaaaccccaaaccuggcggagagaguguuggacugguuaaagaaauacggggucgaacggcugaagaggauggccaucuccggagacgauuguguugugaaacccauugacgaucgcuucgcuacggcccucaccgcacuuaaugacauggguaagguaagaaaagauauaccgcagugggagccuucaaagggcuggaacgacuggcagcaagugcccuuuugcagucaccacuuccaucagcugaucaugaaggaugggcgggaaauugucgugccauguaggaaucaggacgagcuaguuggacgagcucgugugucucagggcgccgguuggagccugagagagacagcaugccucgggaaauccuaugcccaaauguggcaguugauguacuuucaccgccgggaucugaggcuugcggcuaacgccaucuguucagcagucccuguggacuggauucccacuagcagaaccacauggucuauccaugcccaccaucaguggaugacuaccgaagauaugcuguccguauggaaucgcguuuggauagaggaaaacccauggauggaggacaagacgcacaucaguagcuggggagacgugcccuaucucggcaaacgggaagaucaauggugcggcucguuaauugggcugacagcuagggccaccugggcaacuaauauccaggucgcuauuaaccaggugcgaagauugaucggaaaugagaacuaccuggacuacaugacauccaugaagcgguucaaaaaugagggugauccugaaggcgcccucugguga

SEQ ID NO: 13607 - RNA, 9879 nt, Artificial Sequence
  derived and/or modified CDS sequence (opt3) from DENV-1__FJ390383__SS-prME
agcgugaccaugcugcucaugcuuaugcccacggcccuggcuuuccacuugacuacgagaggaggggagccucauaugaucgucuccaagcaggaaagagggaaaucuuuacuguuuaagaccucagccgguguuaauaugugcacacuaauugccauggaccucggagagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcguugggaaacuggugcaucagauauucggaaccgcauacggcgucuuguuuuccggugugucuuggacuaugaagaucgggauuggcguacuccugacaugguuaggacugaauagccgaucaaccagucuauccaugacauguaucgcggugggccucguuacucuguaccuuggggucauggugcaggcugauagcggaugcgugaucaacuggaaaggccgcgaauugaagugugguucugggauuuucgucaccaaugagguucacacguggacagaacaauauaaguuucaggccgacucaccgaaaagacugagugcagccauaggaaaggcuugggaggagggcgugugcgguaucaggagcgccacccggcucgaaaacauuauguggaaacagaucuccaacgagcugaaucauauuuuacuggaaaacgacaugaaguucacugugguagucggcgauguggcagggauccuugcucagggcaagaagaugauacgcccucaacccauggaguacaaauauucuuggaagucguggggcaaggccaaaaucauuggggcggacguucagaauaccacauuuaucauugauggaccaaacacuccugaaugucccgacgaucagagagccuggaauaucugggagguggaggacuacggcuucgguauauuuaccacaaacauuugguugaagcucagggauagcuauacgcaggucugcgaccaccgucugauguccgcugcaaucaaagauucaaaggccgugcacgcugacaugggguacuggauugaaagugagaaaaaugaaaccuggaagcuagcccgggcaucuuucaucgagguuaagacuuguauauggccaaaaagccauacacugugguccaacggagugcucgaaucagagaugaucauucccaagaucuauggcgguccuauuagccaacacaauuaccgaccaggcuacuucacccagacugcggggccguggcaucugggaaaacuugaguuggauuuugaccugugcgaaggcacaaccguagucguggaugagcacugcgggaacagaggacccucuuuaaggacgacuaccgugacaggcaagaucauacacgaaugguguugccgcuccuguacccucccuccacugcgguucagaggugaggacgggugcugguauggaauggagauuaggcccgucaaagaaaaggaggaaaaucuuguuaagaguauggugagcgccggcucuggugagguagacuccuuuucacugggcuugcucuguaucaguaucauuaucgaagaggugaugcgcagccgauggucgcggaaaaugcugaugacugggacacuagcugucuucuuucugcucauuaugggacagcugaccuggaacgaucuuauacguuugugcaucauggugggcgccaaugcauccgacagaauggggaugggaacaacuuaccuggcuuuaauggccaccuucaagaugaggccuauguuugcaguuggccuccuguuccgccggcuuacgucuagagaggugcugcuacucacaauuggucugagcuuggucgccucaguggaacugccaaacaguuuagaggaacucggggauggacuggcuaugggcaucaugauucuuaaacuguugaccgacuuucaaucccaucagcucugggcgacucugcuaucucugaccuucaucaagacaacuuuuagccuucacuaugccuggaaaaccauggcaaugguucucuccauagugucacuguuccccuugugucugagcacgacaagucagaagaccacuugguuaccgguccuccugggcucucuugggugcaagccucugacaauguuuuugaucgcugagaauaaaauuuggggaaggcgauccuggccacucaacgaagguaucauggccguaggcauugugagcauccugcuaucgucacugcuuaagaacgaugagccccucgccgggccucugauagcuggaggcauguugauugcauguuacguuaucucugguaguuccgccgacuuaagccuggagaaagcggcugaagugucuugggaggaagaggccgaacauagcggggcaucccacaauauccucgucgaggugcaggaugacggaaccaugaagauuaaagaugaggaacgcgacgauacucugacaauacuucugaaggccaccuugcuagcuguaucaggcguguauccccugaguaucccagcaacacucuucgucugguacuucuggcagaagaagaagcagcggagcggcguucugugggacacuccuucucccccagagguggaaagagccgugcuugaugacgggauuuauaggaucaugcagcguggauuacugggucgcucccaggucggcguggggguuuuucaagagaacguauuccauaccauguggcacgugacacggggagcgguccucauguaccagggcaaaagauuggagccgucaugggcuagugugaagaaagaccugauuagcuacggugggggauggaggcuccagggcuccuggaauaccggcgaagagguucaggugaucgccgucgaaccugggaagaaccccaaaaaugugcaaacagcaccaggaacuuuuaagacccccgagggugaaguaggcgccauagcucuggauuucaagccugggacgucuggaucgccaaucgucaaccgagagggcaaaauugugggucuuuaugggaauggaguugugacaacuagcggcaccuacgucucagccaucgcacaggcuaaggccucccaggagggcccccugccugaaauugaggacgaaguguuucggaaacgcaacuugacaaucauggaucuacacccggggaguggaaagaccagaagguaucugccagcgauaguucgggaggccauuaaacgaaagcucagaacuuuaauccuggcacccacccgcguggucgcuucugaaauggccgaggcucuuaaggguaugccuaucagguaccaaacaacggcagugaaaagcgagcauacuggcaaggaaauuguagaccugaugugccacgccaccuucacaaugcgucucuuguccccagugcggguucccaauuauaacaugaucauaauggaugaggcccauuuuaccgacccuucaucuauugcugcgagaggguacaucagcacuagggucggaaugggcgaagcagccgcuauuuucaugacagccaccccgcccgguaguguggaggcauuuccacaguccaaugccgugauccaggaugaggaacgcgacauaccugagcgaagcuggaacucuggguaugaauggauuacggauuuccccggaaaaacugucugguuuguaccaucaaucaaguccggcaaugacaucgcuaacugucugaggaaaaauggcaagcgggugauucagcucaguaggaagacauucgauaccgaguaccagaaaaccaagaacaacgacugggacuacguugugacuacagauaucagcgaaaugggggcgaauuuccgcgccgaccgugucauugauccuagacggugccugaaacccgugauacuuaaggacggaccagagaggguuauccuagcagguccgaugccugugaccgucgcuucggccgcacagcgccgaggcagaauugggcggaaccacaauaaagagggagaucaguauaucuacaugggccagccccugaacaaugacgaagaucaugcccacuggacagaggcuaagauguuguuagacaacaucaauacuccagaagguauuauacccgcccuguuugagccugaaagggagaagucugcggcaaucgauggggaguaucgccucagaggcgaagccaggaaaacguucguggagcugaugcggcguggagaccuuccaguauggcuguccuacaagguggcuagcgaaggcuuucaauauucagaucgccgauggugcuucgacggggagagaaacaaucagguucucgaagagaacauggaugucgagauuuggaccaaagaaggagagaggaagaaauugcggccccgcuggcuggacgccagaacauacagugacccucuagcucugagggaauuuaaggaguucgcagccggucggcgaucuguguccggcgaucucauccuugaaauugggaaacugccgcagcacuuaacucagagagcucaaaaugccuuggacaaccuggugaugcuccauaauagcgagcagggaggccgcgcauauaggcacgcgauggaggaacugccagauaccaucgagacacuuaugcugcucgccuugauagcuguccugaccggugggguuacuuuauuuuuccuaucaggccggggacugggcaagacgaguaucgggcuccuuugugugauggccagcuccguacuguuguggauggcaucuguggaaccccauuggauugcugccagcaucauucuggaguuuuuccucaugguccugcuuaucccugagcccgaccgucagagaaccccacaggauaaccaacucgcauacgugguuauaggacuguuguuuaugauucugacaguggccgcuaaugaaauggguuuacuagagacuaccaagaaagaccugggcaucgggcacgucgcgguagaaaaccaccaucacgccgcaaugcucgauguggaccuucauccugcuuccgccuggacacuguacgccguugcaaccacuauuaucacacccaugaugaggcacacgauagagaacaccacugcuaauaucucauugacagccauugcgaaccaggcugccauccugaugggacucgauaagggcuggccaauuucuaaaauggacaucggugugccucugcuugcauuagggugcuauagucaggucaauccgcugacccucaccgccgcuguguugaugcuggucgcacauuacgccauaauuggccccggacuacaagcgaaggcuacacgcgaagcccagaaacggacugcagccggcaucaugaagaacccaacgguggaugggaucguugcuauugaccuggauccugugguauaugacgccaaguucgagaaacagcucggacagaucaugcuucugauauuguguaccucgcaaauucugcucaugcgaacaacuugggcacugugcgagagcaucaccuuagcuacaggcccccuuaccacucugugggaagguuccccagggaaguuuuggaauacgacaauugccgugucuauggcgaacaucuucagaggaucauaccucgccggcgcaggucuagcuuucagccugaugaaauccuugggcgggggaaggcgcggcaccggggcccagggagagacucugggcgaaaaguggaaacggcagcucaaucagcuuaguaagucugaguuuaacaccuauaagagaagcgguauaauggaagucgaccguucagaggcaaaagaggggcugaagaggggagaaacaacuaaacacgcuguuucccggggcaccgccaaguugcgcugguucguggagcgaaaucuggucaaaccugaagguaaggugaucgaucucggcugugggagaggaggcuggaguuacuauugcgccggguuaaagaaaguaacagaggugaagggauacacgaaaggcggucccgggcacgaggaaccgauuccaauggcgaccuacggauggaaccugguuaaacuucauagcggcaaagacguguuuuucaucccucccgagaagugugauacucugcuaugcgacauuggcgaaucuuccccaaaucccacaaucgaggaagggaggacccuccggguccugaaaaugguggagccuugguugcgcggaaaccaauuuuguauuaagauccugaauccguauaugcccucagucguggagacucucgaacagaugcagagaaagcacgguggcaugcuuguuaggaacccacugagccgaaauucgacacaugagauguacuggguaucuugcgggaccggaaacauagugagugcugucaauaugacgucccggauguuacugaaccguuucaccauggcacacagaaaaccuacauaugaacgcgauguggacuugggcgccgguacuaggcacguugcuguggagcccgaagucgccaaccucgauauuaucgggcagcggaucgagaauauuaagcaugagcacaaaagcaccuggcauuacgacgaagauaacccuuauaagacaugggcauaccacggaucauaugaggugaaaccauccggcucugccagcaguaugguaaauggcgugguuaagcugcuaacuaagcccugggacgucauaccuauggugacccaaaucgcuaugacagauaccacuccauuugggcagcagagaguguucaaagaaaaggucgacacgcgcacacccaaagcgaagaggggaaccgcccaaauuauggagguuacugcaaaauggcuuugggguuuucugucccgaaacaagaagccgcggaucuguaccagagaagaguucacaaggaaagugcgcagcaaugcugccauuggcgcaguauuuguggacgagaaccaguggaacucugccaaggaagcugucgaggaugaacguuucugggaccucgugcaucgggagagagaacugcacaaacaggggaagugcgccacgugcguuuacaacaugaugggaaaaagggagaagaaguugggcgaguuugguaaagcgaaggggucacgcgcaaucugguacauguggcugggagcccgauuccucgaguucgaggcucuuggcuuuaugaaugaagaucacugguucagucgggagaacucccugagcggcguggagggggaaggauuacauaaacuggguuauauauugagagacaucucuaagauuccuggcgggaauauguacgccgaugacaccgcaggaugggauacuaggaucacagaggacgaucuccagaacgaagcucgcauuaccgacaucauggagccagaacacgcccugcuagcuaaaucgauauuuaaacuuacuuaucaaaauaaagucgugagaguacagcggcccgccaagaacggcacaguuauggaugugauuucaaggcgugaccagcgagguagcgggcaggucggaaccuacggccugaauacauucacuaacauggaggcacaacucauccgccagauggaguccgaaggcaucuuuaguccuucugagcuggaaauuccaaacuuggcggagagaguguuagauuggcuggaaaaguaugggguggagcggcucaaaaggauggccauaagcggagacgacugugucguuaagcccaucgaugaccgcuucgcuaccgcccuuacggcacugaaugauauggguaaagugagaaaggacauuccgcagugggagccuuccaaaggcuggaacgauuggcagcaaguacccuuuugcucacaucacuuccaccagcuaaucaugaaggacgggcgggaaauuguggucccauguaggaaucaggaugagcuggugggacgagcucguguuagucagggcgccgguuggucucucagagaaaccgcaugcuugggaaagagcuacgcccaaauguggcagcugauguauuuucaucgccgggaccuuaggcuggcggcuaacgccaucuguuccgcagugccugucgauuggauacccacaucaagaacuaccuggagcauccacgcccaucaccaguggaugacaacugaggacaugcucucuguguggaaucgcguauggauugaagagaacccauggauggaggauaaaacccauaucuccaguuggggagacguucccuacuuaggcaagcgggaagaccaauggugcggcagccugauuggguugacggcuagggccacaugggcaaccaauauccagguggcuauuaaccagguccgaagacugauaggaaaugagaacuaccucgauuauaugacuucgaugaaacgguucaagaaugaaggugacccugagggcgcccuuugguga

SEQ ID NO: 13608 - RNA, 9879 nt, Artificial Sequence
  derived and/or modified CDS sequence (opt3) from DENV-1__FJ182033__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaagcuuugcauugaagccaaaaucucuaauacgaccacagauagcagguguccaacucaaggagaggcuacccugguugaagagcaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauccagacguccggaaccacaacuauuuuugcaggccauuuaaagugccggcugaaaauggauaagcuaacccucaaagggaugagcuaugucauguguacaggaucguucaagcuggagaaggaaguggccgagacucagcacgguaccguucuugugcagauaaaauacgagggcacggacgcuccuugcaagaucccauucucuacacaagaugaaaaagggguaacccagaacggacguuugauuacugcgaaucccaucgucacagacaaggagaaaccugugaacauagaagcagagccacccuuuggcgaguccuauauuguuaucggugccggggaaaaggcucugaagcucucaugguucaaaaagggcaguagcaucggaaaaauguuugaggccaccgcacgcggcgccagaaggauggcuauucugggggauacugccugggacuucggauccaucgguggcguguuuaccucuauugggaagcuuguccaucagauauucggaacagcauacggcgugcuguuuagcgguguaucauggacgaugaaaaucgggauuggcguguugcucaccuggcugggauuaaauagucgguccacuagccugucuaugacauguaucgcgguuggccuagucacccucuaccugggggugauggugcaggcugauucaggaugcgucaucaacuggaagggccgagaacuuaagugugguagugggauuuucguuacaaaugaggugcacacuuggaccgaacaauauaaauuucaggccgacagcccgaagcgcuuguccgcagccauaggaaaagcuugggaggagggcgugugcgguaucagaucugccacgaggcuggaaaacauuauguggcggcagaucucgaacgagcucaaucauauucuguuagaaaacgacaugaaguucacaguagucgugggcgauguuguggggauccuggcacagggaaaaaagaugauacgcccucaacccauggagcacaaauacagcuggaaguccuggggcaaggcuaaaaucauuggggccgacguccagaauaccacuuuuaucauugauggaccaaacaccccugaaugucccgacgaucagagagcguggaauaucugggagguggaggacuauggcuucgguauauuuacaacuaacauuuggcuuaaguugagggauucauacacccagguuugcgaccaccgucucaugagugccgcuaucaaagauucuaaggcagugcaugccgacaugggguauuggauugaaagcgagaaaaaugaaacauggaagcuggcucgggccuccuucaucgagguaaagacguguauauggccaaaaucacacacccuauggagcaacggaguccuggaaucugagaugaucauucccaagaucuacggcgguccuauuucccaacauaauuaucgaccaggcuacuucacucagacagcagggccguggcaccucggaaaacuggagcuugauuuugacuugugcgaaggcaccacugugguggucgaugagcacugcgggaacagaggacccagucugaggacaaccacgguuacuggcaagaucauacaugaaugguguugccgcagcuguaccuuaccuccacuccgguucaaaggugaggacgggugcugguacggaauggagauuagacccgugaaggaaaaggaggaaaaucugguaaaaucuaugguguccgcgggcucaggugaggucgacaguuuuagccuuggccuguuguguaucucgaucaugauugaagaggugaugaggucccgcuggucucgaaagaugcucaugacagggacccuggccguuuucuuucuacugaucaugggacagcucacuuggaacgaucugauucggagcugcauaauggugggcgcuaaugccucagaccguauggggaugggaacaaccuaucuugcauugauggcuacauucaaaaugagaccuauguuugccgucggccuguuauucaggcgccucacuagucgggaggugcugcuucugaccaucggucuaucccucguugcaucuguggaacugccaaacagcuuggaggaacugggggauggauuagccaugggcauuaugauccucaagcugcuuacggacuuucaauccuaccagcugugggcuacauugcucucacugaccuucauuaaaacuaccuuuagccuacacuaugcguggaagacaauggccaugguccugaguaucguaucucuucucccccuguguuuguccacuaccagccagaagacgacauggcugccgguguuacucggcucgcuggggugcaaaccucuuaccauguuccugauagcagagaauaagaucuggggaagaaaaucauggccauugaacgaagguauuauggcuguuggcaucgugucuauucuccugaguucccuacugaagaacgaugucccccuugccgggccucucaucgccggaggcaugcugauagcuuguuacgugauuagcgguucuagcgcagacuuguccuuagagaaagccgcggagguaucaugggaagaggaagcugagcauaguggggccagccacaauauccugguggaaguccaggaugacggaacuaugaagaucaaagaugaggagagggacgauacacucaccauucugcuuaaggcaacucuguuggccguuucuggcguguauccccuauccauaccagcuacacuguuugugugguacuucuggcaaaagaaaaagcagcgaucaggcguccucugggacaccccuagucccccagaaguggagcgcgcaguucuggaugacgggaucuaucggauuaugcagagaggacuuuuagguaggagccagguaggcgugggggucuuccaagaaaacguguuucauacgauguggcacguuacucguggagccgugcugauguaccagggcaaacgccucgagccguccugggcgucugucaagaaagacuugaucucguacggugggggauggcggcugcagggcagcuggaauaccggcgaggaagugcagguaauugcugucgagccugggaagaaccccaagaaugugcaaacagccccaggaaccuucaaaacacccgaaggugagguuggcgcaaucgcccucgauuuuaagccugggacuucaggauccccaauagugaacagagaaggcaaaaucgucggucuguaugggaauggagugguuaccacgaguggcacauacgugucugcuauugcccaggcaaaggcuagccaggagggcccccuuccugagaucgaagacgaggucuucaggaaacgaaaccugacuauuauggauuugcacccgggguccggaaagacccggcgcuaucuaccagccaucgugagagaagcgauaaagaggaaacugcggacacucauuuuagcccccacccgaguaguggcaucagagauggcugaagcccugaaggguaugccuaucagauaccaaacuaccgcuguuaaaucugagcauacaggccgcgagaucgucgaccuuaugugccacgcaacguuuacuaugaggcugcucagcccagugcgugugcccaauuauaacaugauuaucauggaugaagcccauuucaccgacccuaguuccauagccgcucggggguacauuagcacaagagucggaaugggcgaggcggcagccaucuuuaugaccgcuacuccgcccgguucuguagaagccuucccacagucaaaugcagugauucaggaugaggaaagggacaucccugagcgcuccuggaacaguggguaugaguggauaacagauuuucccggaaagaccguuugguucgugccaagcauuaaaucgggcaaugacaucgccaacuguuugcgaaagaauggcaagagagucauccagcugucucggaaaacguuugauacugaauaccaaaagacaaaaaacaacgacugggacuacgugguuaccaccgauauuuccgagaugggggcuaauuucagggcggaccgcgugaucgauccucguagaugccucaagcccgucauucugaaagacggaccagaacgggugauacuugccgguccgaugccuguaacuguggcaagcgcugcccagaggcgcggccgaaucgggagaaaccacaauaaggagggagaucaguauauuuacaugggccagccccuaaacaaugacgaggaucaugcacacuggacagaagccaagaugcuguuggacaacaucaauaccccagaggguaucauucccgcuuuauucgaaccugagcgggaaaaaucagccgcgauagauggggaguauaggcugcgcggcgaggcaagaaagacauuuguugaacucaugaggcggggagaccugccagucuggcuuaguuacaaaguggccucugagggcuuccaauauuccgaucgucgcuggugcuuugacggggaacgaaacaaucaggugcuggaggaaaacauggaugucgagaucuggacuaaggagggagaaagaaaaaagcucaggccccggugguuggacgcucgcacguacagcgacccucuggcccuaagagaguucaaagaauuugcugcagguaggcggucaguuaguggcgaucugauucucgagaucgggaagcuuccgcagcaccugacccagcgagcccaaaaugcuuuagacaacuuggugaugcugcauaauagcgaacagggaggcagagccuaucgccacgcaauggaggagcucccagauacaauugaaacucugaugcuucuggcgcucaucgccguauugaccgguggggugacacuguucuuuuuauccggcaggggacuaggcaagaccucuauagggcugcucugugucauggcuagcuccgcccuucuguggauggcaucaguggagccccauuggaucgcugccucuauuaucuuggaauucuuucugaugguucuccugauuccugagcccgaccggcagcguacuccacaggauaaccaacuugcauacguggucaucggacuccuguucaugauauugacgguagccgcuaaugagaugggucuguuagaaaccacaaaaaaggaccuaggcauugggcacguggcgguugagaaccaccaucacgccacuaugcuggauguggaccuccauccugcaagugcuuggacccuuuacgccgucgccacaaccaucauuacucccaugaugagacacacaaucgaaaacacgaccgcaaauauaucgcugacugcuaucgccaaccaggcggcuauuuugaugggacuggauaaaggcuggccaaucagcaagauggacauuggugugccucuccuggcccuugggugcuauucccaggucaauccguuaacacugaccgcagccgugcucauguugguugcucauuacgcaaucauaggccccggacugcaagccaaagcgaccagggaggcucagaagcgcacagccgcaggcauuaugaagaacccaacuguggaugggaucguagccaucgaccuagauccuguggucuaugacgcuaaauuugaaaagcagcugggacagauuaugcuccuuauccuguguacgucucaaauauugcugaugcggaccacaugggcccucugcgagucaauuacucuggcaaccggccccuuaacaacccuuugggaggguagcccagggaaauucuggaauacuacgaucgcuguuuccauggccaacauuuuucgaggaaguuaccuggcgggcgccggucucgcauucucucuaaugaagagccugggcgggggaagaaggggcacaggggcucagggagaaaccuugggcgagaaauggaagcgccagcugaaucagcucucaaaguccgaauucaacacuuauaaacggagugguaucauggagguggacagaagcgaagccaaggaggggcuucguaggggagagaccacaaaacacgcagucucucggggcacugcuaagcugcgcugguuuguggaacgaaauuugguaaaaccugaggguaaggugauagaucugggcugugggagaggaggcugguccuacuauugcgccgggcucaagaaaguuaccgaagugaagggauacacaaaaggcgguuuagggcacgaggaacccaucccgauggccacguacggauggaaccuggucaagcuucauucaggcaaagacguguucuuuauuccaccugagaagugugauacccugcuaugcgacaucggcgagagcucgcccaauccaacuauugaagaggggaggacacuccggguccugaaaaugguggaacccugguugcgcggaaaccaauucuguaucaagauucugaauccuuauaugccgucuguuguagagacccucgagcagaugcagagaaagcacgguggcaugcuugugaggaacccccugagucgaaauuccacucaugaaauguacugggucagcugcgggacaggaaacaucgugucagcgguuaauaugaccucccggauguuacugaaccguuuuacgauggcucacagaaaaccaaccuaugagcgcgauguggacuugggcgcagguacaaggcacgucgccguggaaccugagguagcuaaccucgauauaauugggcagcggaucgaaaauaucaagcaugagcacaaaucuacuuggcauuacgacgaggauaaccccuauaagaccugggccuaccacggaagcuaugaagugaaaccuaguggcuccgcaagcucuaugguuaauggcgucgugaagcugcuaacaaagccaugggacgugauucccauggucacucaaauagccaugaccgauacaaccccuuucgggcagcagagaguuuuuaaagagaagguggacacucgcacgccaaaagcuaagaggggaacagcgcaaaucauggaaguaaccgcccgauggcuuugggguuuccugucacggaacaaaaagcccagaauuuguacuagggaggaauuuacccgcaaggugcguaguaaugcagcuaucggcgccgucuucguggacgagaaccaguggaauuccgcaaaagaggccguugaagaugagcgguuuugggaccucgugcauagagaaagggagcugcacaagcaggggaaaugcgcuacaugcgucuacaacaugaugggaaagcgcgaaaaaaaguugggcgaguucgguaaggccaaagggagccgagcgauuugguacauguggcugggagcacgguuucucgaguucgaagcccuuggcuucaugaaugaggaucacugguuuucuagagaaaacucgcugucaggcguggagggggagggauuacauaagcuggguuauaucuugagggacauaagcaaaaucccgggcgggaauauguacgcugaugacacggccggaugggauacccgcauuacugaagacgaucuccagaacgaggcaaagaucacagacauuauggaaccugagcacgcucugcuagccaccuccaucuucaaacuuacuuaucaaaauaagguaguuagagugcagcggccagcuaggaacggcacagucauggaugugauaagucgucgagaccagcgcgguucugggcaggugggaaccuacggccugaauacauuuacuaacauggaagcccaacucauuagacagauggagagcgagggcaucuuccugcccuccgaauuggagaccccuaacuuagcagaacggguccuggauuggcucgagaaacaugggguugaaaggcuuaagcgcauggcgaucucaggagacgacugugugguaaagccaauugaugacagauuugccacggcucugaccgcccuaaaugauauggguaaagugcggaaggacauaccccagugggagccgaguaaaggcuggaacgauuggcagcaagucccuuucugcucucaccacuuucaucagcugaucaugaaggacgggagggagauugugguucccugucgaaaucaggaugaacucgugggacgugcaagagucagccagggcgcugguugguccuugcgcgagacagccugccuggggaaaucauaugcacaaauguggcagcuuauguacuuccaccggagggaccugagacucgccgcgaacgcuaucuguagcgccgugccaguagauuggguuccuacuucucgcaccacaugguccauucaugcacaccaucaguggaugacuaccgaagacauguuaaguguguggaaucgggucuggaucgaggaaaaccccuggauggaggauaagacgcacauaagcucguggggagacgugccauaucugggcaagagggaggaccaauggugcggcuccuugaucgggcugacagcccgagcuaccugggccacuaauauucagguugcaaucaaccaggugagacggcucauuggaaaugaaaacuaccuugauuacaugacaucuaugaaaagguuuaagaaugagucagaccccgaaggugcucugugguga

SEQ ID NO: 13609 - RNA, 9879 nt, Artificial Sequence
  derived and/or modified CDS sequence (opt3) from DENV-1__FJ182034__SS-prME
agcgugaccaugcugcucaugcuuaugcccaccgcacuggcuuuccacuugacuacgagaggaggggaaccucauaugaucgucuccaagcaggaaagggggaaaucuuuacuguuuaagaccucagccgguguuaauaugugcacacuaauugccauggaccucggcgaacugugugaagauacuaugaccuacaaaugcccacggauuacagaagcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuagcaccgagauccagcugacagacuacggggcccucacccuugauuguucuccaaggacuggacuggacuucaacgaaauggucuugcuaacaaugaaggagaaauccuggcuggugcauaagcagugguuucucgaucugccgcuucccuggacgucaggcgcaagcaccagucaagagacuuggaaucggcaggaccuguugguaacauucaaaaccgcucacgccaagaagcaggaaguugugguccucgguucucaagagggggcuaugcacacagcccugacuggcgcaaccgaaauccagacguccggaaccacaacuauuuuugccggccauuuaaaaugccgucugaagauggauaaacuaacccucaaggggaugagcuaugugauguguacaggaucguucaaacuggagaaggaagucgcugagacucagcacgguaccgugcuuguucagauaaaguacgagggcacggacgcgccuugcaaaaucccauucucuacacaagaugaaaagggggugacccagaacggacgcuugauuacugcaaaucccaucguaacagacaaagagaagccugucaacauagaagccgagccacccuuuggcgaguccuauauugugaucggugcuggggaaaaagcccugaagcucucaugguucaagaaaggcaguagcaucggaaagauguuugaggcaaccgccagaggcgcuaggcggauggccauucugggggauacugcaugggacuucggauccaucgguggcguuuuuaccucuguggggaaacuuguccaucagauuuucggaacagcguacggcgugcuguuuagcgguguaucauggacgaugaagauagggaucggcguguugcucaccuggcugggauuaaauagucgauccacuagccugucuaugacauguauugcuguuggccuagucacccucuaccugggggugauggugcaggccgauucaggaugcgucaucaacuggaaaggccgcgaacuuaagugugguagugggaucuucguuacaaaugaggugcacacuuggaccgaacaauauaaguuucaggcagacagcccgaaaagauuguccgccgcuauuggaaaggccugggaggagggcgugugcgguauaaggucugcaacgcggcuggaaaacaucauguggaaacagauuucgaacgagcucaaucauauccuguuagaaaacgacaugaaguucacaguagucgugggcgauguugcugggauucuggcccagggcaagaaaaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccaggugugcgaccaccgucucaugagugcagccauuaaagauucuaaggcuguucacgccgacaugggguacuggaucgaaagcgagaaaaaugaaacauggaagcuggcacgggcguccuucauugaggugaagacguguaucuggccaaaaucacauacccuauggagcaacggaguacuggaaucugagaugauaauccccaagauuuauggcgguccuaucucccaacacaauuaccgaccaggcuacuucacucagacagccgggccguggcaucucggaaaacuggagcuugauuuuaacuugugcgaaggcaccacugucgugguggacgagcacugcgggaauagaggacccagucugaggacaaccacggucacuggcaagauuauccacgaaugguguugccgcagcuguaccuuaccuccacuccgguucaaaggugaggaugggugcugguauggaauggagauaagacccguuaaggaaaaggaggaaaaccuggugaaaucuaugguauccgcuggcucaggugagguggacaguuuuagccuuggccuguuguguauuucgaucaugaucgaagaggucaugaggucccgcuggucucgaaagaugcucaugacagggacccuggccguguucuuucuacugauuaugggacagcucacuuggaaugaccugauccggcuuugcauuaugguuggcgcaaacgcuagcgaucguauggggaugggaaugacauacuuggcccugauggcaaccuucaaaaugagaccuauguuagccgugggccuccuguuuaggcgccuuacaucacgggagguccugcuacucacuauaggucugaguuugguggcuuccguugaacugccaaauucuuuagaggaacucggggacggacuggcgaugggcaucaugauucuuaagcuguugaccgauuuccaaagccaucagcucugggccacgcugcuaucccugacauuuaucaaaaccacuuauucacuucacuacgcauggaagaccauggcuauggugcucagcauugucagucuguuccccuugugucugucuacaacuucccagaagaccacgugguuaccgguacuccugggcagccuugggugcaaaccucugacaauguuuuugaucgccgagaacaagauauggggaagaaaaucguggccacucaacgaagguaucauggccgugggcauuguuucaauccugcuaucuagucugcuuaagaaugacgugccccucgcugggccucugauugcaggaggcauguugaucgccuguuaugucauauccgguagcucugcggauuuaagccuggagaaagcugccgagguguccugggaagaggaagcagagcauucaggggccagucacaacauucucguagaagugcaggacgauggaaccaugaagaucaaagacgaggagagggaugacacucugacaauccuucugaaggcuaccuugcuagcagucagcggcguuuacccccugucuauuccagccacucucuucgugugguauuuuuggcaaaagaaaaagcagcgauccggcgugcugugggauacaccuucacccccagaagucgagcgcgcggugcuugacgaugggauauaccggaucaugcagagaggauuacuggguaggagucagguuggcguagggguguuccaagaaaaugucuuccauaccauguggcacgugacgcguggagcuguucucauguaccagggcaaacgcuuggagccgagcugggccuccgugaagaaagaccugauuucuuauggugggggauggcggcuccagggcucguggaacacuggcgaggaaguccaggugaucgcaguagagccugggaagaaucccaagaacguccaaaccgccccaggaacauuuaaaaccagcgaaggugaggugggcgcuauugcccuggacuucaagcccgggacaucaggauccccuaucguuaauagagaaggcaaaauagugggucuuuacgggaacggagucgugacuaccaguggcacguauguuucugcaaucgcucaggccaaggcgagccaggagggcccacugcccgagauugaaaaugagguguuuaggaaacgaaacuugacaaucauggaucuacacccuggguccggaaagacucggcgcuaccugccggccauugucagagaagcaaucaagaggaaacuccggaccuuaauacuggcuccaacacgagugguagccucagagauggcugaagcacuuaaggguaugcccauuagauaucaaaccacugccgugaaaucugagcauaccggcaaggagaucguugaccugaugugccacgccacauucacgaugcgccucuugagcccugucagggugccaaauuacaacaugaucauuauggaugaagcucauuuuacugaccccaguuccaucgcggcacguggguauauaagcacccgggugggaaugggcgaggccgcugccauuuucaugacagcaaccccuccggguucugucgaagccuuuccccagucaaaugcuguaauccaggaugaggaaagagacauuccagagagguccuggaacaguggguacgaguggaucacugauuucccuggaaaaacagugugguuuguucccagcauaaagucgggcaaugacauugcgaacugucugcgcaagaacggcaaacgagugauccagcucucuagaaagaccuucgauacggaauaccagaagacuaagaauaacgacugggauuaugucgugacaaccgacaucuccgagaugggggccaauuuucgggcagacaggguuauugauccacgccguugccugaaaccugugauccuuaaggacggacccgaaagagucauucuagcugguccaaugccggugaccguagccagcgcagcccagcggaggggccgcauagggcgaaaccacaauaaggagggagaucaguacaucuauaugggccagccucugaacaaugacgaggaucaugcucacuggacugaagccaaaauguuguuagacaacauuaauacacccgaggguaucaucccagcgcuguucgaacccgagagagaaaagucagcagccauugauggggaguaccggcucaggggcgaggcucgcaaaaccuucguggaacugaugagaaggggagaccuuccuguuuggcugaguuauaaggucgccucugagggcuuucaauacuccgaucggcguuggugcuucgacggggaacgcaacaaucaggugcucgaggaaaacauggauguggagauauggacaaaagagggagaacgaaagaaauugagaccaagguggcuggacgcucggacuuauagcgauccccuagcacugcgcgaguuuaaggaguucgccgcugguagaaggucagucaguggcgaccucauccuugagauugggaagcugccucagcacuuaacgcagcgggcccaaaaugcauuggacaaccugguuaugcuccauaauagcgaacagggaggccgagcguacagacacgccauggaggagcugccggauaccaucgaaacacuuaugcugcucgcuuugauugccgugcugacuggugggguaaccuuauuuuuccuauccggccgcggacugggcaaaacaucuaucgggcuccuuugugugauggcaagcuccguccuguuguggauggcuucaguggagccacauuggauagccgcaucuaucauucuggaauuuuuccucaugguucugcuuauccccgagccugacaggcagcggacaccccaggauaaccaacucgccuacguggucauuggacuguuguuuaugauccugacuguagcugcgaacgagauggguuuacuagaaacgaccaagaaagaccugggcauagggcacguggccguugagaaucaccaucacgcagcuaugcucgauguggaccuucauccagccagugccuggacacuguaugcagucgcuacuaccauuaucacaccuaugaugcgucacaccauugaaaacacuacagccaauaucucguugacggcgauagcuaaccaggccgcaauccugaugggacucgauaagggcuggcccauuagcaaaauggacaucggugugccacugcuugccuuagggugcuacucccaggucaauccucugacccucacugcugcaguguugaugcugguugcccauuaugcgauuaucggcccgggacuacaagcuaaggccacaagagaggcacagaagaggaccgccgcuggcauaaugaaaaaccccaccguggaugggauuguagccaucgaccuggauccaguggucuacgacgcaaaguucgaaaaacagcucggacagaucaugcuucugauuuuguguacaucucaaauccugcucaugcgcacuacgugggcucugugcgagucaauaaccuuagccacaggcccucuuacuacccugugggaggguagccccgggaaguuuuggaauacaaccauugcgguuuccauggccaacaucuuccggggaaguuaucucgcaggcgcuggucuagccuuuucucugaugaagucauugggcgggggacgaagaggcacuggggcacagggagaaacgcugggcgagaaguggaagaggcagcucaaucagcuuagcaaauccgaguucaacacauacaagcgcagugguauuauggagguggaucggagcgaagcuaaagaggggcugaagagaggagagaccacuaaacacgccgucucucguggcaccgccaaguugaggugguucguggaacggaaucugguaaagccagaggguaaagugaucgaccucggcugugggcgcggaggcugguccuauuacugcgcgggguuaaagaaaguuacagaagugaagggauacacuaaaggcgguccugggcacgaggaacccauaccgauggcuaccuauggauggaaccuggucaaacuucauucaggcaaagacguguuuuucaucccaccugagaagugugauacacugcuaugcgacauuggcgagagcucgcccaauccaacgaucgaagaggggcgaacccucagaguccugaagaugguggaacccugguugaggggaaaccaauuuuguauuaaaauccugaauccuuacaugccgucuguuguagagacucucgagcagaugcagcggaagcacgguggcaugcuugugcgcaacccccugaguagaaauuccacacaugaaauguauugggucagcugcgggaccggaaacauugugucagcaguuaacaugacuuccaggauguuacugaaucgauucacaauggcccaccggaaaccaaccuacgagcgugauguggacuugggcgcugguacgagacacgucgccguggaaccugagguagcaaaccucgauaucauagggcagcgcauugaaaauaucaagcaugagcacaaaucuaccuggcauuaugacgaggauaaccccuacaagacaugggccuaucacggaagcuacgaagugaagccuaguggcuccgcuagcucuaugguuaauggcgucgugaaacugcuaacuaagccaugggacgugauccccauggucacccaaauugcgaugacagauacuaccccuuuugggcagcagaggguuuucaaagagaagguggacacacggaccccaaaagccaagagaggaacugcacaaauaauggaaguaacggcuaaguggcuuugggguuuucugucacgcaacaaaaagcccaggaucuguacacgagaggaguucacccggaaagugagaaguaaugccgcaauuggcgccgucuuuguggaugagaaccaguggaacuccgcuaaggaggccguugaagacgagagguucugggaccucgugcaucgcgaacgugagcugcacaaacaggggaagugcgcgacuugcgucuacaacaugaugggaaagcgggagaaaaaguugggcgaguuugguaaagcaaaggggagcagagccaucugguauauguggcugggagcuagguuccucgaguuugaagcccuuggcuucaugaaugaggaucacugguucucucgcgaaaacucgcugucaggcguggagggggagggauuacauaaacuggguuacauuuugcgagacaucagcaagauaccgggcgggaauauguaugcagaugacaccgcuggaugggauacacggaucacggaagacgaucuccagaacgaggccaaaauuaccgacaucauggaaccugagcacgcucugcuagccaaguccauuuuuaaacuuacuuaccaaaauaaaguaguuagagugcagaggccagcaaagaacggcacagucauggaugugaucagucgcagagaccagcgggguucuggacaggugggaaccuauggccugaacacuuucacaaauauggaagcgcaacucauaaggcagauggagagcgagggcauauuuucccccucagaacuggagaccccuaacuuggccgggcgugucuuagauuggcuggaaaaacauggaguugagcgacucaagcgcauggcuaucaguggugacgauugugugguaaaaccaaucgacgacagauucgccacagcacuuacugcucugaaugauaugggcaaggugcggaaggacauuccccagugggaaccgucuaaaggguggaacgauuggcagcaagucccuuuuugcagccaccacuuccaucagcuaauaaugaaggacggaagggagaucgugguucccugucgcaaucaggaugagcuggugggcagagcccgggucucccagggugcaggguggucacucagggaaaccgccugcuugggaaaaagcuacgcgcaaauguggcagcugauguauuuucaccgacgugaccuuagacuggcugccaacgcaauuuguucugccgugccaguagauuggguuccuacgucccgcaccacauggaguauccaugcucaccaucaguggaugacuaccgaggacaugcucagcguguggaaucgggucuggauugaagagaaccccuggauggaagauaagacacacaucucguccuggggcgacgugccauacuuaggcaaaagggaggaucaauggugcgggucucugauaggauugacugccagagcaaccugggcuacgaauauccagguugccauuaaccaggugcgccggcugaucgguaaugagaacuaccucgacuauaugacaucaaugaagagguucaagaaugaaagcgaccccgagggcgcgcuuugguga

SEQ ID NO: 13610 - RNA, 9879 nt, Artificial Sequence
  derived and/or modified CDS sequence (opt3) from DENV-1__FJ182036__SS-prME
uccgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacgcugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggcuacuccaucaauggccaugcgcugcguggggauuggaagcagagauuuugucgagggucuuaguggcgcgacauggguggacguaguuuuggagcacggguccugugugaccacuauggcaaaggauaaacccacacuggacaucgaacuacucaagaccgaggucacgaacccugccgugcugaggaaacuuugcauugaagcuaagaucucuaauaccacaacugauagccgguguccaacccaaggagaggccacacugguggaagaacaagacgcaaacuucgucugccgccgaacuuuuguugauagaggcugggguaauggguguggauuguucggcaaaggcucccucauaaccugcgcuaaguuuaagugcgugacaaaacuggaggggaagauuguacaguacgaaaacuuaaaauauucagugaucgucaccgugcacacuggagaccagcaucaaguugguaaugagaguacggaacacggcacaaccgccacuauuacaccccaagcgccuaccaccgagauccagcugacugacuacggggcccucacacuugauuguagcccaaggacgggacuggacuucaacgaaaugguguugcuaaccaugaaggagaaaucuuggcugguccauaagcagugguuucucgaucugccgcuucccuggacuuccggcgcaucaacaagccaagagaccuggaaucggcaggaccuguuggugacauucaaaacugcucacgccaagaagcaggaaguaguugugcucgguagucaagagggggcuaugcacaccgcccugacgggcgcaaccgaaauccagacaucuggaacuaccacaauuuuugccggccauuuaaaaugccgucugaagauggauaaacuaacucucaaggggauguccuaugucauguguaccgguagcuucaaacuggagaaggaacuugcugagacgcagcacggaacaguguugguccagauaaaguacgagggcaccgacgcgccuugcaaaaucccauucucgacucaagaugaaaagggggugacacagaacggacgccugauuaccgcaaaucccaucguuacugacaaagagaagccugugaacauagaagccgagccacccuuuggcgagucuuauauuguaaucggugcuggggaaaaagcccucaagcuguccugguucaagaaaggcucaaguaucggaaagauguuugaggcaaccgccagaggcgcuaggcggauggccauucuuggggauacagcaugggacuucggaagcaucgguggcgucuuuacguccguggggaaacugguucaucagauuuucggaaccgcguacggcguguuguuuucuggugucagcuggacuaugaagauagggaucggcgugcuccugacaugguuaggacuaaauucacgaaguaccucccuaagcaugacauguauugcuguaggccucgugacucuguaccuugggguuaugguccaggccgauucuggaugcgugaucaacuggaaaggccgcgaauugaagugugguucagggaucuucgugaccaaugagguccacacguggacagaacaauauaaguuucaggcagacaguccgaaaagacugagcgccgcuauuggaaaggccugggaggagggcguuugcgguauaagguccgcaacccggcucgaaaacaucauguggaaacagauuucuaacgagcugaaucauaucuuacuggaaaacgacaugaaguucacuguggugguaggcgaugucgcugggauucuugcccagggcaagaagaugauccgcccucaacccauggaguacaaauauucguggaaaagcuggggcaaggcgaagauaaucggggccgacgugcagaauaccacauuuauuaucgauggaccaaacacuccugaaugucccgacgaucagagagcuuggaauauuugggagguugaggacuacggcuucgguaucuuuaccacaaacauaugguugaagcucagggauuccuauacacaggugugcgaccaccgucugaugucagcagccauuaaagauaguaaggcuguccacgccgacaugggguacuggaucgaaucugagaaaaaugaaaccuggaagcuagcacgggcgagcuucauugaggugaagacuuguaucuggccaaaaucccauacacuguggucaaacggaguucucgaaagcgagaugauaauccccaagauuuauggcgguccuaugucucaacacaauuaccgaccaggcuacuucacccagacugccgggccguggcaucugggaaaacuugaguuggauuuugaccugugcgaaggcacaaccgugguagucgaugagcacugcgggaacagaggacccuccuuaaggacgacuaccgugacaggcaagaucauucacgaaugguguugccgcaguuguacccucccuccacugcgguucagaggugaggacgggugcugguauggaauggagaucaggcccgugaaagaaaaggaggaaaaucuugucaagagcaugguuucugcuggcuccggugagguggacucauuuagucugggcuugcucuguauaagcauuaugaucgaagagguaaugcgcucgcgauggucccggaaaaugcugaugacugggacacuagccguguucuuucugcucaucaugggacagcugaccuggaacgaucuuauucguuugugcaucauggucggcgcaaaugcuucugacagaauggggaugggaacaacuuaccuggccuuaauggcaaccuucaagaugaggccuauguuugccgugggccuccuguuccgccggcuuacgagcagagagguucugcuacucacaauuggucugucauugguggcuagugucgaacugccaaacuccuuagaggaacucggggauggacuggcgaugggcauaaugauccuuaaacuguugaccgacuuucaaucucaucagcucugggccacucugcuaagccugaccuucauuaagacaacuuuuucccuucacuaugcauggaaaaccauggcuauggugcucucaaucguuagccuguuccccuugugucugaguacgacaucucagaagaccacuugguuaccggugcuccugggcucccuugggugcaagccucugacaauguuuuugauugccgagaauaaaaucuggggaaggcgaagcuggccacucaacgaagguauaauggccgucggcaucguaucgauucugcuaucaucucugcuuaagaacgaugugccccucgcugggccucugaucgcaggaggcauguugauugccuguuacguuaucagugguuccagcgcggacuuaucucuggagaaagcugccgaggugagcugggaagaggaagcagagcauuccggggccucacacaauauacucgucgaagugcaggaugacggaaccaugaagauuaaagaugaggagcgcgacgauacucugacaauccuucugaaggcuaccuugcuagcaguaaguggcguguauccccugagcaucccagccacacucuucgucugguacuucuggcagaagaagaagcagcggucuggcguucugugggacacuccuucacccccagaaguggagagagcggugcuugaugacgggauuuauaggauaaugcagcguggauuacugggucgcagccaggucggcguggggguuuuucaagaaaacguauuccauaccauguggcacgugacacggggagcuguccucauguaccagggcaaaagauuggagccgaguugggccagcgugaagaaagaccugaucuccuacggugggggauggaggcuccagggcucuuggaauaccggcgaggaaguucaggugauugcagucgagccugggaagaaccccaaaaaugugcaaacagccccaggaacuuuuaagacccccgaaggugagguaggcgcuaucgcccuggauuucaagccugggacgucgggaagcccaauugucaaccgagaaggcaaaaucgugggucuuuaugggaauggaguugugacaacuucaggcaccuacgucuccgcaauagcucaggccaaggcgagucaggagggcccccugccugagaucgaagacgagguguuucggaaacgcaacuugacaauuauggaucuacacccggggucuggaaagaccagaagguaucugccagccaucguucgggaagcaauuaaacgaaagcucagaacuuuaauccuggcucccacccgcguggucgccagcgagauggcugaagcacuuaaggguaugccuauaagguaccaaacaacggccgugaaauccgagcauacuggcaaggagauuguagaccugaugugccacgccaccuucacaaugcgucucuugucaccagugcggguucccaauuauaacaugaucaucauggaugaagcucauuuuaccgacccuucuagcauugcggcaagaggguacaucaguacuagggucggaaugggcgaggccgcugccauauucaugacagcaaccccgcccgguuccguggaagccuuuccacagagcaaugcugugauucaggaugaggaacgcgacaucccugagcgaucuuggaacucaggguaugaguggauuacggauuuccccggaaaaacugucugguuuguaccauccaucaagaguggcaaugacauagcgaacugucugaggaaaaauggcaagcgggugauucagcucagcaggaagacauucgauaccgaauaccagaaaaccaagaacaacgacugggacuacguugugacuacagauaucucggagaugggggccaauuuccgcgcagaccgugucaucgauccuagacggugccugaaacccgugauucuuaaggacggaccagaaaggguuauccuagcugguccgaugccugugaccgucgccucugcagcccagcgccgaggcagaauugggcggaaccacaauaaagagggagaucaguauauauacaugggccagccccugaacaaugacgaggaucaugcucacuggacagaagccaagauguuguuagacaacaucaauacuccagaggguauuauccccgcgcuguuugaaccugagagggaaaaguccgcagccaucgauggggaguaucgccucagaggcgaggcuaggaaaacguucguggaacugaugcggcguggagaccuuccaguauggcugagcuacaagguggccucagagggcuuucaauauagugaucgccgauggugcuucgacggggaaagaaacaaucagguucucgaggaaaacauggaugucgagauuuggaccaaagagggagaaaggaagaaauugcggccccgcuggcuggacgcuagaacauacucugacccucuagcacugagggaguuuaaggaguucgccgcuggucggcgauccgugagcggcgaucucauacuugagaucgggaaacugccgcagcacuuaacucagagagcccaaaaugcauuggacaaccuggugaugcuccauaauucagaacagggaggccgcgcguauaggcacgccauggaggagcugccagauaccauugaaacacuuaugcugcucgcuuugaucgccguccugaccggugggguuacuuuauuuuuccuaaguggccggggacugggcaagacgagcauugggcuccuuugugugauggcauccucuguacuguuguggauggcuagcguggagccccauuggaucgccgcauccauaauccuggaauuuuuccucaugguccugcuuauuccugagcccgaccgucagagaaccccacaggauaaccaacucgccuacgugguuaucggacuguuguuuaugauucugacaguggcugcgaaugagauggguuuacuagaaacuaccaagaaagaccugggcaucgggcacgucgccguagagaaccaccaucacgcagcuaugcucgauguggaccuucauccugccucagccuggacacuguacgcaguugcuaccacuauaauuacacccaugaugaggcacacgaucgaaaacaccacugccaauauuucuuugacagcgaucgcuaaccaggccgcaauacugaugggacucgauaagggcuggccaaucaguaaaauggacauuggugugccucugcuugccuuagggugcuauucgcaggucaauccgcugacccucaccgcugcaguguugaugcuggucgcccauuacgcgaucauuggccccggacuacaagcuaaggccacacgcgaggcacagaaacggacugccgcuggcaucaugaagaacccaacgguggaugggauaguugccauugaccuggauccugugguauaugacgcaaaguucgaaaaacagcucggacagaucaugcuucugaucuuguguaccagccaaauucugcucaugcgaacaacuugggcucugugcgaguccaucaccuuagccacaggcccccuuaccacucugugggaggguucuccagggaaguuuuggaauacgacaauagcggugucaauggccaacauuuucagaggaagcuaccucgcaggcgcuggucuagccuucucccugaugaaaaguuugggcgggggaaggcgcggcaccggggcacagggagaaacucugggcgagaaguggaaacggcagcucaaucagcuuucuaagagcgaauuuaacaccuauaagagaucagguaucauggaggucgaccguuccgaagcuaaagaggggcugaagaggggagagacaacuaaacacgccguuagucggggcaccgccaaguugcgcugguucguggaacgaaaucuggucaaaccugaggguaaggugauugaucucggcugugggagaggaggcuggagcuacuauugcgcgggguuaaagaaaguaacagaagugaagggauacacgaaaggcggucccgggcacgaggaaccgaucccaauggcuaccuacggauggaaccugguuaaacuucauucuggcaaagacguguuuuucauaccucccgagaagugugauacucugcuaugcgacaucggcgaguccucaccaaaucccacaauugaagaggggaggacccuccggguccugaaaaugguggaaccuugguugcgcggaaaccaauuuuguaucaagauucugaauccguauaugcccagcgucguggagacucucgagcagaugcagagaaagcacgguggcaugcuuguuaggaacccacugucgcgaaauucuacacaugaaauguacuggguaaguugcgggaccggaaacaucguguccgcagucaauaugacgagccggauguuacugaaccguuucaccauggcccacagaaaaccuacauaugagcgcgauguggacuugggcgcugguacuaggcacguugccguggaacccgaggucgcaaaccucgauauuaucgggcagcggauagaaaauauuaagcaugagcacaaaucaaccuggcauuacgacgaggauaacccuuauaagacaugggccuaccacggauccuaugaagugaaaccaucuggcagcgcuaguuccaugguaaauggcgugguuaagcugcuaacuaagcccugggacgucaucccuauggugacccaaaucgcgaugacagauaccacuccauuugggcagcagagaguguucaaagagaaggucgacacgcgcacacccaaagccaagaggggaaccgcacaaauuauggaaguuacugcuaaauggcuuugggguuuucugagccgaaacaagaagccgcggauauguaccagagaggaguucacaaggaaagugcgcucuaaugccgcaaucggcgccguauuuguggacgagaaccaguggaacucagcuaaggaggccgucgaagaugagcguuucugggaccucgugcaucgggaaagagagcugcacaaacaggggaagugcgcgacgugcguuuacaacaugaugggaaaaagggaaaagaaguugggcgaguuugguaaagcaaaggggagucgcgccauuugguacauguggcugggagcucgauuccucgaguucgaagcccuuggcuuuaugaaugaggaucacugguucucccgggaaaacagccugucuggcguggagggggagggauuacauaaacuggguuauaucuugagagacauuucgaagaucccuggcgggaauauguacgcagaugacaccgcuggaugggauacuaggauaacagaagacgaucuccagaacgaggcccgcaucaccgacauuauggaaccagagcacgcucugcuagccaaaucaaucuuuaaacuuacuuaucaaaauaaagucgugagaguacagcggcccgcaaagaacggcacaguuauggaugugauuagcaggcgugaccagcgagguuccgggcaggucggaaccuacggccugaauacauucacuaacauggaagcgcaacucauccgccagauggagagugagggcauauuuucuccuagcgaacuggagaccccaaacuuggccaagagaguguuagauuggcuggaaaaauaugggguggagcggcucaagaggauggcuauuuccggagacgacugugucguuaaacccaucgaugaccgcuucgccacggcacuuaccgcucugaaugauauggguaaggugagaaaagacaucccgcagugggaaccuucaaagggcuggaacgauuggcagcaaguacccuuuugcagucaucacuuccaccagcuaauuaugaaggacgggcgggagauaguggucccauguaggaaucaggaugagcuggugggacgagcccguguuucucagggcgcagguuggagccucagagaaacagccugcuuggggaaauccuacgcgcaaauguggcagcugauguauuuucaucgccgggaccuuaggcuggcugccaacgcaaucuguucagccgugccugucgauuggauucccacuagcagaaccacauggucuauccacgcucaucaccaguggaugacuaccgaggacaugcucuccguguggaaucgcguauggauugaagagaacccauggauggaagauaagacgcauaucaguagcuggggagacguucccuacuuaggcaaacgggaggaccaauggugcggcucgcugauaggguugacagccagggcaaccugggcuacuaauauccagguggccauuaaccagguccgaagacugaucggaaaugagaacuaccucgauuauaugacauccaugaagcgguucaaaaaugaaucugacccugagggugcgcuuugguga

SEQ ID NO: 13611 - RNA, 9879 nt, Artificial Sequence
  derived and/or modified CDS sequence (opt3) from DENV-1__FJ205876__SS-prME
agcgugaccaugcugcucaugcuuaugcccacggcccuggcuuuccacuugacuacgagaggaggggaaccucauaugaucgucuccaagcaggaaagagggaaaucuuuacuguuuaagaccucagccgguguuaauaugugcacacuaauugccauggaccucggcgaacugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgagagagccgugcuggaugacgggauauauaggaucaugcagcguggacuuuuaggucgcagccagguuggcguagggguguuucaagaaaacgucuuccauaccauguggcacgugacacggggagcgguucugauguaccagggcaaaagacucgagccgaguugggcuagcgugaagaaagacuugauuuccuacggugggggauggaggcugcagggcucuuggaauaccggcgaggaaguccaggugaucgccguagagccugggaagaaccccaaaaauguccaaacagcaccaggaacuuuuaagacccccgaaggugaggugggcgccauugcucucgauuucaagccugggacgucgggaagcccaaucguuaaccgagaaggcaaaauagugggucuguaugggaauggagucgugacaacuucaggcaccuacguuuccgccaucgcacaggcuaaggccagucaggagggcccccuuccugagauugaagacgagguguuucggaaacgcaaccugacaaucauggauuugcacccggggucuggaaagaccagaagguaucuaccagcgauuguccgggaagccaucaaacgaaagcugagaacucucauauuagcacccacccgcgugguagcuagcgagauggccgaagcucugaaggguaugccuauuagguaccaaacaacggcagugaaauccgagcauacuggcaaggagaucguugaccuuaugugccacgccaccuucacaaugcgucugcucucaccaguccgggugcccaauuauaacaugaucauuauggaugaagcccauuuuaccgacccuucuagcaucgcugcgagaggguacauaaguacuagggugggaaugggcgaggcagccgcuauuuucaugacagccaccccgcccgguuccgucgaagcauuuccacagagcaaugccguaauccaggaugaggaacgcgacauuccugagcgaucuuggaacucaggguaugaguggaucacggauuuccccggaaaaacugugugguuuguuccauccauaaagaguggcaaugacauugcuaacuguuugaggaaaaauggcaagcgggugauccagcugagcaggaagacauucgauaccgaauaccagaaaaccaagaacaacgacugggacuacgucgugacuacagauaucucggagaugggggcgaauuuccgcgccgaccguguuauugauccuagacggugccucaaacccgugauccugaaggacggaccagaaagggucauucuugcagguccgaugccugugaccguagcuucugccgcacagcgccgaggcagaauagggcggaaccacaauaaagagggagaucaguauaucuacaugggccagccccuaaacaaugacgaggaucaugcccacuggacagaagcuaagaugcuguuggacaacauuaauacuccagaggguaucauccccgccuuauuugaaccugagagggaaaaguccgcggcaauugauggggaguaucgccugagaggcgaggccaggaaaacguucguggaacucaugcggcguggagaccugccaguuuggcuuagcuacaaggucgcuucagagggcuuucaauauagugaucgccgauggugcuucgacggggaaagaaacaaucaggugcuggaggaaaacauggauguggagauauggaccaaagagggagaaaggaagaaacuccggccccgcugguuggacgccagaacauacucugacccucuggcucuaagggaguuuaaggaguucgcagccggucggcgauccgucagcggcgaucugauccucgagauugggaaacuuccgcagcaccugacucagagagcucaaaaugccuuagacaacuugguuaugcugcauaauucagaacagggaggccgcgcauauaggcacgcgauggaggagcucccagauaccaucgaaacacugaugcuucuggcccucauugcuguguugaccggugggguaacucuguuuuucuuaaguggccggggacuaggcaagacgagcaucgggcugcucugugugauggccuccucuguccuucuguggauggcaagcguggagccccauuggauagcugccuccaucauuuuggaauuuuuccugaugguucuccugaucccugagcccgaccgucagagaaccccacaggauaaccaacuugcauacguggucauuggacuccuguuuaugaucuugacaguagccgcuaaugagaugggucuguuagaaacuaccaagaaagaccuaggcauagggcacguggcgguugagaaccaccaucacgccgcaaugcuggauguggaccuccauccugcuucagccuggacacuuuacgccgucgcaaccacuauuaucacacccaugaugaggcacacgauugaaaacaccacugcuaauaucucucugacagccauagcgaaccaggcugccaucuugaugggacuggauaagggcuggccaauuaguaaaauggacaucggugugccucuccuggcacuugggugcuauucgcaggucaauccguuaacccugaccgccgcugugcucauguugguugcacauuacgccauuaucggccccggacugcaagcgaaggcuacacgcgaggcccagaaacggacugcagccggcauaaugaagaacccaacgguggaugggauuguagcuaucgaccuagauccuguggucuaugacgccaaguucgaaaaacagcugggacagaucaugcuccuuauucuguguaccagccaaaucuugcugaugcgaacaacuugggcacucugcgaguccauaacccuggcuacaggccccuuaaccacucuuugggaggguucuccagggaaguuuuggaauacgacaauugccguuucaauggcgaacaucuucagaggaagcuaccuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuauaagagaucagguauuauggagguggaccguuccgaagcaaaagaggggcuuaagaggggagagacaacuaaacacgcugucagucggggcaccgccaagcugcgcugguucguggaacgaaauuugguaaaaccugaggguaaggugaucgaucugggcugugggagaggaggcuggagcuacuauugcgccgggcucaagaaaguuacagaagugaagggauacacgaaaggcggucccgggcacgaggaaccgauaccaauggcgaccuacggauggaacuuagucaagcugcauucuggcaaagacguguuuuucaucccucccgagaagugugauacucuucugugcgacauuggcgaguccucaccaaaucccacaaucgaagaggggaggacccuacggguccucaaaaugguggaaccuuggcugcgcggaaaccaauuuuguauuaagaucuugaauccguauaugcccagcguuguagagacucuggagcagaugcagagaaagcacgguggcaugcucgugaggaacccacuuucgcgaaauucuacacaugaaauguacugggucaguugcgggaccggaaacauuguguccgcuguuaauaugacgagccggaugcuguuaaaccguuucaccauggcacacagaaaaccuacauaugagcgcgauguggaccugggcgccgguacuaggcacgucgcuguggaacccgagguagccaacuuggauaucauagggcagcggauugaaaauaucaagcaugagcacaaaucaaccuggcauuacgacgaggauaacccuuauaagacaugggcauaccacggauccuaugaagugaaaccaucuggcagcgccaguuccaugguuaauggcgucgugaagcuccugacuaagcccugggacgugaucccuauggucacccaaauugcuaugacagauaccacuccauuugggcagcagagaguuuucaaagagaagguggacacgcgcacacccaaagcgaagaggggaaccgcccaaauaauggaaguaacugcaaaauggcuaugggguuuucuuagccgaaacaagaagccgcggaucuguaccagagaggaguucacaaggaaagugcgcucuaaugcugccauuggcgcagucuuuguggacgagaaccaguggaacucagccaaggaggcuguugaagaugagcguuucugggaccuggugcaucgggaaagagagcuccacaaacaggggaagugcgccacgugcgucuacaacaugaugggaaaaagggaaaagaagcugggcgaguuugguaaagcgaaggggagucgcgcaaucugguacaugugguugggagcccgauuccuggaguucgaagcucucggcuuuaugaaugaggaucacugguucaaccgggaaaauucccuuagcggcguggagggggagggacugcauaaauuagguuauauucugagagacaucucuaagauaccuggcgggaacauguacgccgaugacaccgcaggaugggauacuaggaucacagaagacgauuugcagaaugaggcucgcauuaccgacaucauggaaccagagcacgcccuccuggcuagaucgauuuuuaaacuaacuuaucaaaacaagguaguucgggugcagaggcccgccaaaaauggcacagucauggaugugaucucacgucgagaccagcgcgguagcggacaggugggaaccuacggccuuaacacauucacuaacauggaagcacaacugauaagacagauggaguccgagggcauuuuuaguccuucugaacucgagaccccaaaucuggcggaacgggucuuggauugguuagagaaguaugggguugaaaggcugaagcgcauggccaucagcggagacgacugugugguaaaacccaucgaugacagauucgcuacggcccucaccgcacuuaacgauauggguaaggugcggaaagacauuccgcagugggagccuuccaagggcuggaaugauuggcagcaaguccccuuuugcucacaucacuuccaccagcugauaaugaaagacgggagggagaucgugguuccaugucgaaaccaggaugagcuagugggacgugcuagagucagucagggcgccgguuggucucugcgcgagacagcaugccucggaaagagcuacgcccaaauguggcaguugauguauuuucaucggagggaccugagacuugcggcuaaugccauuuguuccgcagugccuguagauuggauccccacuucacgcaccacauggagcauucacgcccaucaccaguggaugacuaccgaagacaugcugucuguuuggaaccggguguggaucgaggaaaauccauggauggaggauaagacgcauauauccaguuggggagacguccccuaccucggcaaaagggaggaccaauggugcggcagcuuaaucgggcugacagcucgagccaccugggcaacuaacauucagguggcuaucaaucagguuagacgguugauuggaaacgaaaauuaccuggauuauaugacaucgaugaagagguucaaaaacgaguccgacccugaaggugcccucugguga

SEQ ID NO: 13612 - RNA, 9879 nt, Artificial Sequence
  derived and/or modified CDS sequence (opt3) from DENV-1__FJ024455__SS-prME
agcgugaccaugcugcucaugcuuaugcccacggcccuggcuuuccacuugacuacgagaggcggggaaccucauaugaucgucuccaagcaggaaagaggaaaaucuuuacuguuuaagaccucaguuggugugaauaugugcacccuaauugcaauggaccucggcgaacugugugaagauacuaugaccuacaaaugcccacggaucacggagaccgaaccggacgauguagacuguuggugcaaugccacugauacaugggugaccuaugggacguguagucaaacuggagagcaccgccgagacaagcguagcgucgcgcuugcuccccaugugggccuggguuuggagaccagaacagaaacuuggauguccucugagggggccuggaaacagauccagaggguugaaaccugggcacuccggcacccuggauucacagugauugcccuguuucuggcucaugcaaucggcaccucgauuacgcagaagggcaucauuuucauccucuuaaugcuggucacuccaucaauggccaugcgcugcguggggauuggaagcagagauuuuguagagggucuuaguggcgcuacauggguugacguggucuuggagcacggguccugugugaccacuauggccaaggauaaacccacacuggacaucgaacuacucaagaccgaggugacgaacccugcgguccugaggaaacuuugcauugaagcaaagaucucuaauaccacaacugauagccgguguccaacccaaggagaggccacacugguugaagaacaagacgcuaacuucgugugccgccgaacuuuuguagauagaggcugggguaauggguguggauuguucggcaaaggcucccucauaaccugcgccaaguuuaagugcgugacaaaacuggaggggaagauuguccaguacgaaaacuuaaaauauucagugaucguuaccgugcacacuggagaccagcaucaagucgguaaugagaguacggaacacggcacaaccgcaacuauuacaccccaagcuccuaccaccgagauccagcugacugacuacggggcccucacacuugauuguagcccaaggacgggacuggacuucaacgaaaugguguugcuaaccaugaaggagaaaucuuggcugguacauaagcagugguuucucgaucugccgcuucccuggacuuccggcgcgucaacaagccaagagaccuggaaucggcaggaccuguugguuacauucaaaacugcccacgcaaagaagcaggaaguggucgugcucgguagucaagagggggcuaugcacaccgcccugacgggcgcuaccgaaauccagacaucuggaacuaccacaauuuuugccggccauuuaaaaugccgucugaagauggauaaacuaacucucaaggggauguccuaugucauguguaccgggagcuucaaacuggagaaggaacuugcagagacgcagcacgguacaguguugguucagauaaaguacgagggcaccgacgccccuugcaaaaucccauucucgacucaagaugaaaagggggugacacagaacggacgccugauuaccgcuaaucccaucguaacugacaaagagaagccugucaacauagaagcggagccacccuuuggcgagucuuauauugugaucggugcaggggaaaaagcccucaagcuguccugguucaagaaaggcucaaguaucggaaagauguuugaggcuaccgccagaggcgcaaggcggauggccauucuuggggauacagcuugggacuucggaagcaucgguggcguuuuuacguccguggggaaacugguccaucagauuuucggaaccgccuacggcguguuguuuucugguguaagcuggacuaugaagauagggaucggcgugcuccugacaugguuaggacuaaauucacgaaguaccucccuaagcaugacauguauugcaguuggccucgucacucuguaccuuggggugauggugcaggcggauucuggaugcgucaucaacuggaaaggccgcgaauugaagugugguucagggaucuucguuaccaaugaggugcacacguggacagaacaauauaaguuucaggcugacaguccgaaaagacugagcgccgcaauuggaaaggccugggaggagggcgugugcgguauaagguccgcuacccggcucgaaaacaucauguggaaacagauuucuaacgagcugaaucauaucuuacuggaaaacgacaugaaguucacuguagucgugggcgauguugccgggauucuugcacagggcaaaaagaugauccgcccucaacccauggaguacaaauauucguggaaaagcuggggcaaggcuaagauaaucggggccgacgugcagaauaccacauuuauuaucgauggaccaaacacuccugaaugucccgacgaucagagagcguggaauauuugggaggucgaggacuacggcuucgguaucuuuaccacaaacauaugguugaagcucagggauuccuauacacaggugugcgaccaccgucugaugucagccgcuauuaaagauaguaaggcaguucacgccgacaugggguacuggaucgaaucugagaaaaaugaaaccuggaagcuagcucgggccagcuucauugaggugaagacuuguaucuggccaaaaucccauacacuguggucaaacggaguacucgaaagcgagaugauaauccccaagauuuauggcgguccuaucucucaacacaauuaccgaccaggcuacuucacccagacugcagggccguggcaucugggaaaacuugaguuggauuuugaccugugcgaaggcacaaccgucgugguggaugagcacugcgggaacagaggacccuccuuaaggacgacuaccgucacaggcaagauuauccacgaaugguguugccgcaguuguacccucccuccacugcgguucagaggugaggacgggugcugguauggaauggagauaaggcccguuaaagaaaaggaggaaaaucuugugaaguccaugguaucugcgggcuccggugagguggacucauuuagucugggcuugcucuguauuagcaucaugaucgaagaggucaugcgcucgcgauggucccggaaaaugcugaugacugggacacuagccguguucuuucugcucauuaugggacagcugaccuggaacgaucuuauccguuugugcauuaugguuggcgcuaaugccucugacagaauggggaugggaacaacuuaccuggcauuaauggcuaccuucaagaugaggccuauguuugccgugggccuccuguuccgccggcuuacgagcagagagguccugcuacucacaauaggucugucauugguggcaaguguugaacugccaaacuccuuagaggaacucggggauggacuggccaugggcaucaugauucuuaaacuguugaccgacuuucaaucucaucagcucugggcuacucugcuaagccugaccuucaucaagacaacuuuuucccuucacuaugcguggaaaaccauggccauggugcucucaauugucagccuguuccccuugugucugaguacgacaucucagaagaccacuugguuaccgguacuccugggcucccuugggugcaagccucugacaauguuuuugaucgcagagaauaaaauauggggaaggcgaagcuggccacucaacgaagguaucauggcugugggcauuguuucgauccugcuaucaucucugcuuaagaacgaugugccccucgccgggccucugauugccggaggcauguugaucgcuuguuacgucauaagugguuccagcgcagacuuaucucuggagaaagccgcggaggugagcugggaagaggaagcugagcauuccggggccucacacaauauucucguagaagugcaggaugacggaaccaugaagaucaaagaugaggagcgcgacgauacucugacaauccuucugaaggcaaccuugcuagccgucaguggcguuuauccccugagcauuccagcuacacucuucgugugguacuucuggcagaaaaagaagcagcggucuggcgugcugugggacacuccuucacccccagaagucgagagagcagugcuugaugacgggauauauaggaucaugcagcguggauuacugggucgcagccagguuggcguagggguguuucaagaaaacgucuuccauaccauguggcacgugacacggggagccguucucauguaccagggcaaaagauuggagccgaguugggcgagcgugaagaaagaccugauuuccuacggugggggauggaggcuccagggcucuuggaauaccggcgaggaaguccaggugaucgcuguagagccugggaagaaccccaaaaauguccaaacagccccaggaacuuuuaagacccccgaaggugaggugggcgcaauugcccuggauuucaagccugggacgucgggaagcccaaucguuaaccgagaaggcaaaauagugggucuuuaugggaauggagucgugacaacuucaggcaccuacguuuccgcuaucgcccaggcaaaggcuagucaggagggacccccuccggagauugaagacgagguguuucggaaacgcaaccugacaaucauggauuugcacccagggucuggaaagaccagaagguaucuacccgccauuguccgggaagcgaucaaacgaaagcugagaacucucauauuagccccuacccgcgugguagcaagcgagauggcugaagcccugaaggguaugccaauuagguaccaaacaacggcugugaaauccgagcauacuggcaaggagaucguugaccuuaugugccacgcaaccuucacaaugcgucugcucucacccguccgggugccuaauuauaacaugaucauuauggaugaagcccauuuuaccgacccgucuagcaucgccgcuagaggguacauaaguacuagggugggaaugggcgaggcggcagccauuuucaugacagcuacacccccagguuccgucgaagccuuuccucagagcaaugcaguaauccaggaugaggaacgcgacauucccgagcgaucuuggaacucaggguaugaguggaucacggauuucccaggaaaaacugugugguuuguuccuuccauaaagaguggcaaugacauugccaacuguuugaggaaaaauggcaagcgggugauccagcugagcaggaagacauucgauaccgaauaccagaaaaccaagaacaacgacugggacuacgucgugacuacagauaucucggagaugggggcuaauuuccgcgcggaccguguuauugaucccagacggugccucaaaccagugauccugaaggacggaccggaaagggucauucuugccgguccuaugcccgugaccguagcaucugcugcccagcgccgaggcagaauagggcggaaccacaauaaagagggagaucaguauaucuacaugggccagccacuaaacaaugacgaggaucaugcacacuggacagaagccaagaugcuguuggacaacauuaauacucccgaggguaucaucccugcuuuauuugaaccagagagggaaaaguccgccgcgauugauggggaguaucgccugagaggcgaggcaaggaaaacguucguggaacucaugcggcguggagaccugcccguuuggcuuagcuacaaggucgccucagagggcuuucaauauagugaucgccgauggugcuucgacggggaaagaaacaaucaggugcuggaggaaaacauggauguggagauauggaccaaagagggagaaaggaagaaacuccggccucgcugguuggacgcuagaacauacucugacccgcuggcccuaagggaguuuaaggaguucgcugcaggucggcgauccgucagcggcgaucugauccucgagauugggaaacuuccacagcaccugacucagagagcccaaaaugcuuuagacaacuugguuaugcugcauaauucagaacagggaggccgcgccuauaggcacgcaauggaggagcuccccgauaccaucgaaacacugaugcuucuggcgcucauugccguguugaccggugggguaacucuguuuuucuuaaguggccggggacuaggcaagacgagcaucgggcugcucugugugauggcuuccucuguccuucuguggauggccagcguggagccucauuggauagcagcuuccaucauuuuggaauuuuuccugaugguucuccugauccccgagccagaccgucagagaaccccucaggauaaccaacuugccuacguggucauuggacuccuguuuaugaucuugacaguagcagccaaugagaugggucuguuagaaacuaccaagaaagaccuaggcauagggcacguggcuguugagaaccaccaucacgcggccaugcuggauguggaccuccaucccgcaucagcuuggacacuuuacgccgucgccaccacuauuaucacaccaaugaugaggcacacgauugaaaacaccacugcaaauaucucucugacagcuauagccaaccaggcggcuaucuugaugggacuggauaagggcuggccuauuaguaaaauggacaucggugugccgcuccuggcccuugggugcuauucgcaggucaaucccuuaacccugaccgcagccgugcucauguugguugcucauuacgcaauuaucggcccaggacugcaagccaaggcgacacgcgaggcucagaaacggacugccgcaggcauaaugaagaacccuacgguggaugggauuguagccaucgaccuagaucccguggucuaugacgcuaaguucgaaaaacagcugggacagaucaugcuccuuauucuguguaccagccaaaucuugcugaugcgaacaacuugggcccucugcgaguccauaacccuggcaacaggcccauuaaccacucuuugggaggguucuccugggaaguuuuggaauacgacaauugcuguuucaauggccaacaucuucagaggaagcuaccuggcgggcgccggucucgcauucucccuaaugaaaagucugggcgggggaaggcgcggcaccggggcucagggagaaacuuugggcgagaaguggaaacggcagcugaaucagcucucuaagagcgaauuuaacaccuauaagagaucagguauuauggagguggaccguuccgaagccaaagaggggcuuaagaggggagagacaacuaaacacgcagucagucggggcaccgcuaagcugcgcugguucguggaacgaaauuugguaaaacccgaggguaaggugaucgaucugggcugugggagaggaggcuggagcuacuauugcgccgggcucaagaaaguuacagaagugaagggauacacgaaaggcgguccggggcacgaggaaccaauaccuauggccaccuacggauggaacuuagucaagcugcauucuggcaaagacguguuuuucauacccccagagaagugugauacucuucugugcgacauuggcgaguccucacccaauccuacaaucgaagaggggaggacccuacggguccucaaaaugguggaaccguggcugcgcggaaaccaauuuuguauuaagaucuugaaucccuauaugccaagcguuguagagacucuggagcagaugcagagaaagcacgguggcaugcucgugaggaacccucuuucgcgaaauucuacacaugaaauguacugggucaguugcgggaccggaaacauuguguccgcgguuaauaugacgagccggaugcuguuaaaccguuucaccauggcucacagaaaacccacauaugagcgcgauguggaccugggcgcagguacuaggcacgucgccguggaaccugagguagcuaacuuggauaucauagggcagcggauugaaaauaucaagcaugagcacaaaucaaccuggcauuacgacgaggauaacccauauaagacaugggccuaccacggauccuaugaagugaaacccucuggcagcgcaaguuccaugguuaauggcgucgugaagcuccugacuaagccuugggacgugaucccaauggucacccaaauugccaugacagauaccacucccuuugggcagcagagaguuuucaaagagaagguggacacgcgcacaccgaaagcuaagaggggaaccgcgcaaauaauggaaguaacugccaaauggcuaugggguuuucuuagccgaaacaagaagccucggaucuguaccagagaggaguucacaaggaaagugcgcucuaaugcagcuauuggcgccgucuuuguggacgagaaccaguggaacucagcaaaggaggccguugaagaugagcguuucugggaccuggugcaucgggaaagagagcuccacaaacaggggaagugcgcuacgugcgucuacaacaugaugggaaaaagggaaaagaagcugggcgaguuugguaaagccaaggggagucgcgcgaucugguacaugugguugggagcacgauuccuggaguucgaagcccucggcuuuaugaaugaggaucacugguucucccgggaaaacagccuuucuggcguggagggggagggacugcauaaauuagguuauauucugagagacaucucgaagauaccaggcgggaauauguacgcugaugacaccgccggaugggauacuaggaucacagaagacgauuugcagaacgaggcacgcauuaccgacaucauggaacccgagcacgcucuccuggccaaaucaauuuuuaagcuaacuuaucaaaauaaaguaguuagagugcagcggccugcuaagaacggcacagucauggaugugaucagcaggcgugaccagcgagguuccggacaggugggaaccuacggccuuaauacauucacuaacauggaagcccaacugauacgccagauggagagugagggcauauuuucuccaagcgaacucgagacccccaaccuggcagaaagagucuuggauugguuagagaaguaugggguugaacggcugaaaaggauggcgaucuccggagacgacugugugguaaagccgaucgaugaccgcuucgccacggcucucaccgcccuuaaugauauggguaaagugagaaaggacauuccucagugggagcccucaaaaggcuggaacgauuggcagcaagucccauuuugcagucaucacuuccaccagcugauaaugaaggacgggcgggagaucgugguuccuuguaggaaucaggaugagcuggugggacgagcacgugucucucagggcgcugguuggagccugagagagacagccugccucgggaaguccuacgcacaaauguggcaguugauguauuuucaucgccgggaccugaggcuugccgcgaacgcuauuuguucagccgugcccguagauuggaucccaacuagcagaaccacauggucuauucacgcacaucaccaguggaugacuaccgaagacaugcuguccguuuggaaucgcguguggaucgaggaaaaccccuggauggaggauaaaacgcauauaaguagcuggggagacgucccuuaccucggcaagcgggaggaccaauggugcggcucguuaaucgggcugacagccagggcuaccugggccacuaauauucagguggcaaucaaccagguucgaagauugauuggaaaugaaaacuaccuggauuauaugacauccaugaaacgguucaagaaugagucugacccagaaggugcucucugguga

SEQ ID NO: 13613 - RNA, 9879 nt, Artificial Sequence
  derived and/or modified CDS sequence (opt3) from DENV-1__FJ024456__SS-prME
agcgugaccaugcugcucaugcuuaugcccacagcacuggcuuuccacuugacuacgagaggaggggaaccucauaugaucguaaccaagcaggaaaggggaaaauccuuacuguuuaagacaucugccgguguuaacaugugcauucuaauagccauggaccucggcgaacugugugaagauacuaugaccuacaaaugcccacggaucacagaggcggaaccggacgauguggacuguuggugcaaugcuaccgauacuuggguaacauaugggaccuguucacaaacgggagagcaccgccgagacaagcguaguguggcccuugcaccccaugucggccuggguuuggagacuagaaccgaaacauggaugagcuccgagggggccuggaaacagauucagaggguggaaacuugggcucuccggcacccuggauucaccguuaucgcacuguuucuggcccaugcuauuggcacaucuaucacccagaagggcauuaucuucauucucuuaaugcuggugacgccaucgauggccaugcgcugcgucgggaucggaucaagagauuuuguggagggucuuagcggcgcgacuuggguagacguuguguuggagcacgggaguugugucacaaccauggcaaaggauaaacccacucuggacauugaacuacucaagacagaggugaccaacccugccgugcugaggaaacuuugcaucgaagcuaagauauccaauacgaccacagauucucgguguccaacucaaggagaggccacccugauggaagaacaagacgcaaacuucgucugccgccgaacauuuguugauagaggcugggguaauggguguggauuguucggcaaaggcagccucauuacuugcgcuaaguuuaagugcgugaccaaacuggaggggaagaucguacaguacgaaaacuuaaaauauuccgugauugucacagugcacaccggagaccagcaucaaguugguaaugagucaacugaacacggcacgacagccaccaucacuccccaggcgccuaccagugagauccagcugacagacuacggggcccucacccuugauuguagcccaaggacuggacuggacuucaacgaaaugguguugcuaacaaugaaggagaaaucuuggcugguccauaagcagugguuucucgaucugccgcuucccuggacguccggcgcaucaaccagccaagagacuuggaaucggcaggaccuguuggugacauucaaaaccgcucacgccaagaagcaggaaguaguugugcucgguagucaagagggggcuaugcacacagcccugacuggcgcaaccgaaauucagacgucuggaaccacaacuauauuugccggccauuuaaaaugccgucugaagauggauaaacuaacccucaaggggauguccuaugucauguguacagguagcuucaaacuggagaaggaaguggcugagacucagcacggaaccguccuugugcagaucaaguacgagggcacggacgcgccuugcaaaauuccauucucgacacaagaugaaaaggggguuauccagaacggacgcuugauaaccgcaaaucccauugugacugacaaagagaagccuguaaacaucgaagccgagccacccuuuggcgagucuuauaucgucauuggugugggggaaaaagcucugaagcucuccugguucaagaaaggcucaaguaucggaaagauguuugaggccacagcaagaggcgccaggcggauggcuauucugggggauaccgccugggacuucggaagcauagguggcguuuuuacuuccguggggaaacuuguccaucagaucuucggaaccgcauacggcgugcuguuuucugguguaagcuggacaaugaagauugggaucggcguguugcucacguggcugggauuaaauucacgaaguaccucccugagcaugacuuguaucgcgguuggccuagucacacucuaccugggggugauggugcaggcugauucuggaugcgucauuaacuggaaaggccgcgaacuuaagugugguucagggauauucguuaccaaugaggugcacacauggacugaacaauauaaguuucaggccgacaguccgaaaagauugagcgcagccaucggaaaggcuugggaggagggcgugugcgguauuagguccgccacccggcuggaaaacaucauguggaaacagauuucuaacgagcucaaucauauccuguuagaaaacgacaugaaguucacgguagucgugggcgauguuguggggauacuggcacagggcaaaaagaugauccgcccucaacccauggagcacaaauacucguggaaaagcuggggcaaggcuaagauuaucggggccgacguccagaauacaaccuuuauuaucgauggaccaaacacuccugaaugucccgacgaucagagagcguggaauauaugggagguggaggacuauggcuucgguauuuuuaccacaaacaucuggcuuaaguugagggauuccuacacucaggccugcgaccaccgucucaugucagcugcaauuaaagauaguaaggccguucaugcugacaugggguauuggaucgaaucugagaaaaaugaaaccuggaagcuggcccgggcauccuucauagaggugaagacauguaucuggccaaaaucccacacgcuauggucaaacggaguacuggaaagcgagauggucauucccaagaucuacggcgguccuauuucucaacauaauuaucgaccaggcuacuucacccagacugcggggccguggcaccucggaaaacuggagcuugauuuugacuugugcgaaggcacaaccgugguggucgaugagcacugcgggaacagaggacccucccugaggacuacaaccguuacgggcaagaucauacaugaaugguguugccgcaguuguacuuuaccuccacuccgguucaaaggugaggacgggugcugguacggaauggagauuagacccgugaaggaaaaggaggaaaaucugguaaaaagcauggugucugccggcuccggugaggucgacucauuuagucuuggccuguuguguaucagcaucaugauugaagaggugaugaggucgcgcuggucccgaaagaugcucaugaccgggacacuggcuguuuuccuacugcucaucaugggacagcugaccuggaacgaucuuauucgguugugcauaauggugggcgccaaugcaucugaccguauggggaugggaacuacauaucuggcuuuaauggccaccuuuaaaaugagaccuauguucgcagucggccuccuguuuaggcgccuuacaagccgggaggugcugcuacucacuaucggucugucauugguugccaguguggaacugccaaacuccuuagaggaacucggggauggacuggcuaugggcauuaugauccuuaagcuguugaccgacuuccaaucucaccagcucugggcgacgcugcuaagccugacauuuauuaaaaccacucuuucccuccauuacgccuggaagaccauggcaaugguccugucaaucgucagcuuguucccccuguguuuaaguacaacuucucagaagaccacguggcucccggugcugcuuggcucccuggggugcaaaccuuugacaauguuucucauagcugagaauaagaucuggggaagaaaaagcuggccacugaacgaagguauuauggccguuggcguggucucgauccuacugucaucucuucucaagaacgaugugccccuggccgggccuuugauugcuggaggcauguuaaucgcauguuauguaauaagugguuccagcgccgaccugucucucgagaaagcggcugaggugagcugggaagaggaagccgagcacuccggggcaucacauaauauucuggucgaaguucaggaugacggaaccaugaagaucaaagaugaggagagggacgauacucuuacaauccuguugaaggccacccuacuggcugugaguggcguguacccccucagcauuccagcaacucuguucgucugguauuuuuggcaaaagaaaaagcagcgaucuggcgugcuuugggacacaccuucacccccagaaguugagcgcgccguauuagaugacgggauauaccggaucaugcagagaggacugcucgguaggagccaggugggcgucgggguguuccaagaaaacguuuuccacaccauguggcacgugacgcguggagcggucuugauguaucagggcaaacgccuggagccgaguugggcuagcgugaagaaagaccucauuuccuacggugggggauggcggcugcagggcucuuggaauacuggcgaggaaguacaggucaucgccguggagccugggaagaaccccaagaauguucaaaccgcaccaggaacauuuaaaacccccgaaggugaggugggcgccauugcucuugauuucaagccugggacaucgggaagcccaaucgucaacagagaaggcaaaauagugggucuguacgggaauggaguugugacuaccucaggcacguaugucuccgccaucgcacaggcuaaggccagucaggagggccccuugccugagauugaagacgagguguuuaggaaacgaaaccuaacaaucauggaucugcauccggggucuggaaagacucggcgcuaccucccagcgauuguaagagaagccaucaagaggaaauuacggacccugauacuugcacccacacgagugguugcuagcgagauggccgaagcucugaaggguaugccuauuagauaucaaaccacugcagucaaauccgagcacaccggcaaggagaucguggaccucaugugccaugccacauucacgaugcgcuugcugucaccagugaggguccccaauuacaacaugaucauuauggaugaagcccacuuuacugacccuucuagcaucgcugcgcguggguauauaaguacccggguaggaaugggcgaggcagccgcuauuuucaugacagccaccccgcccgguuccguggaagcauuuccacagagcaaugccguuauccaggaugaggaaagagacauuccugagaggucuuggaacucaggguacgaguggaucacugauuuccccggaaaaacagugugguuugucccauccauaaagaguggcaaugacauugcuaacugucuccgcaagaauggcaaacgagugauccagcugagcagaaagaccuucgauacggaauaucagaaaacuaagaacaacgacugggacuacguugugacaaccgauaucucggagaugggggcgaauuuucgggccgacagggucauugauccucgccguugccuuaaacccgugauccuaaaggacggaccagaaagaguaauucuggcagguccgaugccugugaccguugcuucugccgcacagcggaggggccgcauagggcgaaaccauaauaaggagggagaucaguacaucuauaugggccagcccuugaacaaugacgaggaucacgcccacuggacugaagcuaaaauguuacuggacaacauuaauacaccagaggguaucauccccgcccucuucgaaccugagagagaaaaguccgcggcaauugauggggaguaccggcugaggggcgaggcccgcaaaaccuucgucgaacuuaugagaaggggagaccugccaguguggcucagcuauaagguggcuucagagggcuuucaauacagugaucggcguuggugcuucgacggggaacgcaacaaucaggucuuggaggaaaacauggauguugagauauggacaaaagagggagaacgaaagaaacugagacccagguggcuagacgcccggacuuauucugacccucuggcucuccgcgaguuuaaggaguucgcagccgguagaagguccgugagcggcgaucuuauccuggagauugggaaguuaccgcagcauuugacgcagcgggcucaaaaugcccuggacaaccucguaaugcugcacaauucagaacagggaggccgagcauacagacaugcgauggaggagcuuccagauaccaucgaaacacugaugcucuuggcccugauugcuguguuaacugguggggucacccuauuuuuccugaguggccgcggacucggcaaaacaagcaucgggcuucugugugugauggccuccucuguuuugcuguggauggcaagcguggagccccacuggauagcugccuccaucauucucgaauuuuuccugaugguccuucucaucccugagcccgacaggcagcggaccccacaggauaaccaacuggcauauguagugauuggauugcuguuuaugaucuuaacuguugccgcuaaugagaugggucuacuggaaacgaccaagaaagaccucggcauagggcacguggcggucgagaaccaucaccaugccacaaugcuugauguggaccugcacccugcaucagcuuggacuuuguacgccgucgccaccacaauuaucacccccaugaugcgucauacuauugaaaacacaacggcaaauaucucucugaccgcuauagccaaccaggcggcuauccucaugggacuggauaagggcuggccaauuaguaaaauggacaucggugugccucuuuuagcccuggggugcuacucgcagguuaauccgcucacuuugacagcagccgugcugaugcuaguagcucacuaugcaauuaucggccccggacugcaagccaaggcgaccagagaggcucagaagaggaccgccgcaggcauaaugaaaaacccaacaguggaugggauugucgccaucgaccucgauccuguuguguacgacgcuaaguucgaaaaacagcuuggacagaucaugcuguugauucuguguacuagccaaauccuccugaugcgcacgaccugggccuuaugcgaguccauaacacuugcaacuggcccccugaccacacucugggaggguucuccagggaaguuuuggaauaccacuauugcugucucaauggccaacaucuuccggggaagcuaucuagcgggcgccggucuggcauuuuccuugaugaaaagucugggcgggggacgaagaggcacgggggcucagggagaaacacucggcgagaaguggaagaggcagcuuaaucagcugucuaaaagcgaguucaacauuuacaagcgcucagguaucauggagguggaccgguccgaagccaaagagggguugaagagaggagagaccacucgucacgcaguaaguaggggcaccgcuaaacugcggugguucguggaacgcaaucucguuaagccugaggguaaggugauagauuuaggcugugggcgaggaggcuggagcuauuacugcgccgggcugaaaaaggucacagaagugaaaggauauacuaagggcggucccgggauggaggaaccgaucccaauggccaccaacggauggaaucuugucaaacugcauucuggcaaggacguguuuuucacaccucccgagaaaugugauacgcuacucugcgacauuggcgaguccucaccaaaccccaccaucgaagaggggagaacucugaggguuuugaagaugguagaaccuuggcugcggggaaaucaauuuuguauuaagauccucaacccguacaugcccagcguggucgagacacuugagcagaugcagcgcaaacacgguggcaugcuggugagaaauccauuaucgaggaacucuacccaugaaauguacuggguuaguugcgggacuggaaauauuguguccgcggucaacaugacaagccgaaugcuguugaaccgguucaccauggcucaccguaagccuacguaugagagagauguggaccucggcgcagguacccgccacguagccguggaacccgagguugcuaaucuggauaucauagggcagaggauugaaaacaucaaacaugagcacaagucaacauggcauuacgacgaggauaauccuuauaaaacuugggccuaccacggauccuaugaagucaagccaucuggcagcgcaaguuccauggugaacggcguggucaagcuacuuaccaaacccugggacguuaucccuauggugacacaaauugccaugacugauaccacaccauuugggcagcagcggguauucaaggagaaaguggacaccagaacucccaaggcuaaacgcggaacggcgcaaauaauggaagucacagccagguggcugugggguuuucucagccgaaauaagaagccgcggaucuguaccagagaggaguucacuaggaaagugcgcucuaacgcagcuauuggcgccguuuuuguggacgagaaucaguggaacucagcaaaggaggccgucgaagaugagcguuucugggaccuggugcagaaagaacgggaguugcauaagcaggggaaaugcgcuaccugcguauacaauaugaugggaaagagagaaaagaaacugggcgaguuugguaaggccaaagggaguagggcgaucugguauauguggcucggagcacgcuuccuugaguuugaagcccugggcuucaugaacgaggaucacugguucucccgagaaaauagcuuaucuggcguugagggggagggacugcacaaguuggguuacauucuccgggacaucucgaaaauaccuggcgggaacauguacgcugaugacacagccggaugggauacgagaaucaccgaagacgaucugcaaaaugaggcaaagauuacugacaucauggaaccagagcaugcucuacuugccacaucaauuuuuaaacugaccuaucagaacaagguggucagggugcagcgccccgcuaagaauggcacugugauggaugucaucagcagacgggaccagagggguuccgggcaaguuggaacauacggccucaacaccuucacaaacauggaagcccagcugauacgucagauggagagugagggcauauuuuugccuucugaauuagagacuccaaaucuggcagaacgagugcucgauuggcuugagaaacacgggguagaacgccugaagagaauggcgaucagcggagacgacuguguggucaaacccaucgaugaccgguucgccaccgcucuaacggcccugaacgauauggguaaggugaggaaagacauuccgcagugggagccuuccaagggcuggaaugauuggcaacagguucccuuuugcucacaucacuuccaccagcucauaaugaaggacgggcgcgagaucguggucccauguagaaaccaggaugaauuggugggacgggcaaggguaagucaaggcgcugguuggucucugcgagagaccgccugccuugggaaaagcuaugcacagauguggcagcugauguacuuucaucguagagaccuccgcuuagccgcgaaugcuauuuguuccgccguuccuguggauuggguccccacaucacggacuaccuggagcauccacgcacaucaccaauggaugacaacugaagacaugcugucuguguggaacaggguuuggauugaggaaaauccauggauggaggauaagacccauguguccaguuggggagacguccccuauuugggcaaaagagaggaccaguggugcggcagccugaucgggcucacggcccgcgcuacaugggccucgaacauacagguggcaaucaaucagguacggaggcuuauuggaaacgaaaauuaccuggauuauaugaccuccaugaagcgauucaaaaacgagggugacccugaaggcgcucuaugguga

SEQ ID NO: 13614 - RNA, 9879 nt, Artificial Sequence
  derived and/or modified CDS sequence (opt3) from DENV-1__FJ024457__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgagagagccgugcuggaugacgggauauauaggaucaugcagcguggacuuuuaggucgcagccagguuggcguagggguguuucaagaaaacgucuuccauaccauguggcacgugacacggggagcgguucugauguaccagggcaaaagacucgagccgaguugggcuagcgugaagaaagacuugauuuccuacggugggggauggaggcugcagggcucuuggaauaccggcgaggaaguccaggugaucgccguagagccugggaagaaccccaaaaauguccaaacagcaccaggaacuuuuaagacccccgaaggugaggugggcgccauugcucucgauuucaagccugggacgucgggaagcccaaucguuaaccgagaaggcaaaauagugggucuguaugggaauggagucgugacaacuucaggcaccuacguuuccgccaucgcacaggcuaaggccagucaggagggcccccuuccugagauugaagacgagguguuucggaaacgcaaccugacaaucauggauuugcacccggggucuggaaagaccagaagguaucuaccagcgauuguccgggaagccaucaaacgaaagcugagaacucucauauuagcacccacccgcgugguagcuagcgagauggccgaagcucugaaggguaugccuauuagguaccaaacaacggcagugaaauccgagcauacuggcaaggagaucguugaccuuaugugccacgccaccuucacaaugcgucugcucucaccaguccgggugcccaauuauaacaugaucauuauggaugaagcccauuuuaccgacccuucuagcaucgcugcgagaggguacauaaguacuagggugggaaugggcgaggcagccgcuauuuucaugacagccaccccgcccgguuccgucgaagcauuuccacagagcaaugccguaauccaggaugaggaacgcgacauuccugagcgaucuuggaacucaggguaugaguggaucacggauuuccccggaaaaacugugugguuuguuccauccauaaagaguggcaaugacauugcuaacuguuugaggaaaaauggcaagcgggugauccagcugagcaggaagacauucgauaccgaauaccagaaaaccaagaacaacgacugggacuacgucgugacuacagauaucucggagaugggggcgaauuuccgcgccgaccguguuauugauccuagacggugccucaaacccgugauccugaaggacggaccagaaagggucauucuugcagguccgaugccugugaccguagcuucugccgcacagcgccgaggcagaauagggcggaaccacaauaaagagggagaucaguauaucuacaugggccagccccuaaacaaugacgaggaucaugcccacuggacagaagcuaagaugcuguuggacaacauuaauacuccagaggguaucauccccgccuuauuugaaccugagagggaaaaguccgcggcaauugauggggaguaucgccugagaggcgaggccaggaaaacguucguggaacucaugcggcguggagaccugccaguuuggcuuagcuacaaggucgcuucagagggcuuucaauauagugaucgccgauggugcuucgacggggaaagaaacaaucaggugcuggaggaaaacauggauguggagauauggaccaaagagggagaaaggaagaaacuccggccccgcugguuggacgccagaacauacucugacccucuggcucuaagggaguuuaaggaguucgcagccggucggcgauccgucagcggcgaucugauccucgagauugggaaacuuccgcagcaccugacucagagagcucaaaaugccuuagacaacuugguuaugcugcauaauucagaacagggaggccgcgcauauaggcacgcgauggaggagcucccagauaccaucgaaacacugaugcuucuggcccucauugcuguguugaccggugggguaacucuguuuuucuuaaguggccggggacuaggcaagacgagcaucgggcugcucugugugauggccuccucuguccuucuguggauggcaagcguggagccccauuggauagcugccuccaucauuuuggaauuuuuccugaugguucuccugaucccugagcccgaccgucagagaaccccacaggauaaccaacuugcauacguggucauuggacuccuguuuaugaucuugacaguagccgcuaaugagaugggucuguuagaaacuaccaagaaagaccuaggcauagggcacguggcgguugagaaccaccaucacgccgcaaugcuggauguggaccuccauccugcuucagccuggacacuuuacgccgucgcaaccacuauuaucacacccaugaugaggcacacgauugaaaacaccacugcuaauaucucucugacagccauagcgaaccaggcugccaucuugaugggacuggauaagggcuggccaauuaguaaaauggacaucggugugccucuccuggcacuugggugcuauucgcaggucaauccguuaacccugaccgccgcugugcucauguugguugcacauuacgccauuaucggccccggacugcaagcgaaggcuacacgcgaggcccagaaacggacugcagccggcauaaugaagaacccaacgguggaugggauuguagcuaucgaccuagauccuguggucuaugacgccaaguucgaaaaacagcugggacagaucaugcuccuuauucuguguaccagccaaaucuugcugaugcgaacaacuugggcacucugcgaguccauaacccuggcuacaggccccuuaaccacucuuugggaggguucuccagggaaguuuuggaauacgacaauugccguuucaauggcgaacaucuucagaggaagcuaccuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuauaagagaucagguauuauggagguggaccguuccgaagcaaaagaggggcuuaagaggggagagacaacuaaacacgcugucagucggggcaccgccaagcugcgcugguucguggaacgaaauuugguaaaaccugaggguaaggugaucgaucugggcugugggagaggaggcuggagcuacuauugcgccgggcucaagaaaguuacagaagugaagggauacacgaaaggcggucccgggcacgaggaaccgauaccaauggcgaccuacggauggaacuuagucaagcugcauucuggcaaagacguguuuuucaucccucccgagaagugugauacucuucugugcgacauuggcgaguccucaccaaaucccacaaucgaagaggggaggacccuacggguccucaaaaugguggaaccuuggcugcgcggaaaccaauuuuguauuaagaucuugaauccguauaugcccagcguuguagagacucuggagcagaugcagagaaagcacgguggcaugcucgugaggaacccacuuucgcgaaauucuacacaugaaauguacugggucaguugcgggaccggaaacauuguguccgcuguuaauaugacgagccggaugcuguuaaaccguuucaccauggcacacagaaaaccuacauaugagcgcgauguggaccugggcgccgguacuaggcacgucgcuguggaacccgagguagccaacuuggauaucauagggcagcggauugaaaauaucaagcaugagcacaaaucaaccuggcauuacgacgaggauaacccuuauaagacaugggcauaccacggauccuaugaagugaaaccaucuggcagcgccaguuccaugguuaauggcgucgugaagcuccugacuaagcccugggacgugaucccuauggucacccaaauugcuaugacagauaccacuccauuugggcagcagagaguuuucaaagagaagguggacacgcgcacacccaaagcgaagaggggaaccgcccaaauaauggaaguaacugcaaaauggcuaugggguuuucuuagccgaaacaagaagccgcggaucuguaccagagaggaguucacaaggaaagugcgcucuaaugcugccauuggcgcagucuuuguggacgagaaccaguggaacucagccaaggaggcuguugaagaugagcguuucugggaccuggugcaucgggaaagagagcuccacaaacaggggaagugcgccacgugcgucuacaacaugaugggaaaaagggaaaagaagcugggcgaguuugguaaagcgaaggggagucgcgcaaucugguacaugugguugggagcccgauuccuggaguucgaagcucucggcuuuaugaaugaggaucacugguucucccgggaaaacagccuuucuggcguggagggggagggacugcauaaauuagguuauauucugagagacaucucgaagauaccuggcgggaauauguacgccgaugacaccgcaggaugggauacuaggaucacagaagacgauuugcagaacgaggcucgcauuaccgacaucauggaaccagagcacgcccuccuggcuagaucaauuuuuaaacuaacuuaucaaaauaagguaguucgggugcagaggcccgccaaaaacggcacagucauggaugugaucagccgucgagaccagcgcgguuccggacaggugggaaccuacggccuuaauacauucacuaacauggaagcacaacugauaagacagauggagagugagggcauauuuucuccuagcgaacucgagaccccaauccuggcggaacgggucuuggauugguuagagaaguaugggguugaaaggcugaagcgcauggccaucuccggagacgacugugugguaaaacccauugaugacagauucgcuacggcccucaccgcacuuaacgauauggguaaggugcggaaagacauaccgcagugggagccuucaaagggcuggaaugauuggcagcaaguccccuuuugcagucaucacuuccaccagcugaucaugaaagacgggagggagauugugguuccaugucgaaaccaggaugagcuagugggacgugcuagagucucucagggcgccgguuggagccugcgcgagacagcaugccucgggaaguccuacgcccaaauguggcaguugauguauuuucaucggagggaccugagacuugcggcuaaugccaucuguucagcagugccuguagauuggauucccacuagccgcaccacauggucuauccacgcccaucaccaguggaugacuaccgaagacaugcuguccguuuggaaccggguguggauagaggaaaauccauggauggaggauaagacgcauaucaguagcuggggagacguccccuaccucggcaaaagggaggaccaauggugcggcucguuaauugggcugacagcucgagccaccugggcaacuaacauccagguggcuauuaaucagguuagacgguugaucggaaacgaaaauuaccuggauuauaugacauccaugaagagguucaaaaacgagucugacccugaaggugcccucugguga

SEQ ID NO: 13615 - RNA, 9879 nt, Artificial Sequence
  derived and/or modified CDS sequence (opt3) from DENV-1__FJ205881__SS-prME
agcgugaccaugcugcuccuucugaugcccacagccuuggcuuuccacuuaacuacgagaggaggggaaccucauaugaucgucuccaagcaggaaagaggaaaaucucugcuauuuaagaccucagccgguguuaauaugugcacacucauugccauggaccugggcgagcuuugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuggcaccccaugucggcuugggucucgagaccagaacagaaacuuggauguccucugagggggcauggaaacagauccagaggguggaaaccugggcccugcggcacccuggauucacaguuauugcucuguuucucgcacaugccaucggcaccucgauuacgcagaagggcaucauauucaucuuacugaugcuugugacuccaucaauggcuaugcgcugcgucgggauuggaagcagagauuuuguggaggguuugaguggcgccacauggguagacguugugcuggagcacggguccugugucaccacuauggcgaaggauaaacccacacuagacaucgaacuccugaagaccgaggugacgaacccugcagugcuuaggaaacugugcauugaagccaagaucucuaauaccacaacugauagccgguguccaacccaaggagaggcuacauuggucgaagaacaagacgccaacuucguuugccgccgaacuuuuguggauagaggcugggguaauggguguggacucuucggcaaaggcucccugauaaccugcgcaaaguuuaagugcguaacaaaauuagaggggaagauugugcaguacgaaaaccugaaauauucagucaucgugaccguucacacuggagaccagcaucaaguggguaaugagaguacggaacacggcacaaccgcuacuauuacaccccaagccccuaccaccgagauccagcucacugacuacggggcgcuuacacuggauuguagcccaaggacgggauuggacuucaacgaaaugguccuacugaccaugaaggagaaaucuuggcucgugcauaagcagugguuucuggaucuuccgcugcccuggacuuccggcgccucaacaagccaagagaccuggaaucggcaggacuugcucguaacauucaaaacugcacacgcuaagaagcaggaaguugugguccuggguagucaagagggggccaugcacaccgcuuuaacgggcgccaccgaaauccagacaucuggaacuaccacaauuuuugcaggccaucugaaaugccgucuaaagauggauaaacucacucugaaggggauguccuaugugauguguaccgggucguucaaacuugagaaggaauuggccgagacgcagcacgguacaguccuggugcagauaaaguacgagggcaccgacgcuccuugcaaaaucccauucucgacucaagaugaaaaggggguuacacagaacggacgccucauuaccgcgaaucccaucgugacugacaaagagaagccuguaaacauagaagcagagccacccuuuggcgagucuuauauugucaucggugccggggaaaaagcucugaaacuuuccugguucaagaaaggcucaaguaucggaaagauguuugaggccaccgcaagaggcgccaggcggauggcuauucugggggauacagccugggacuucggaagcaucgguggcguguuuacguccguugggaaauuggugcaucagauuuucggaaccgcauacggcguccucuuuucuggugugagcuggacuaugaagauagggaucggcguacuguuaacauggcugggacuaaauucacgaaguaccucccucagcaugacauguauugcggugggccugguuacucuuuacuugggggucauggugcaggcugauucuggaugcgugaucaacuggaaaggccgcgaacugaagugugguucagggaucuucgucaccaaugagguucacacguggacagaacaauauaaguuucaggccgacaguccgaaaagacucagcgcagccauuggaaaggcuugggaggagggcgugugcgguauaagguccgccacccggcuggaaaacaucauguggaaacagauuucuaacgaguuaaaucauauccugcuugaaaacgacaugaaguucacugugguagucggcgauguggcagggauuuuggcucagggcaagaagaugauccgcccucaacccauggaguacaaauauucguggaaaagcuggggcaaggccaagauaaucggggcggacguucagaauaccacauuuauuaucgauggaccaaacacuccugaaugucccgacgaucagagagccuggaauauuugggagguggaggacuacggcuucgguaucuuuaccacaaacauauggcucaagcugagggauuccuauacgcaggucugcgaccaccgucuaaugucagcugcaauuaaagauaguaaggccgugcacgcugacaugggguacuggaucgaaucugagaaaaaugaaaccuggaagcuggcccgggcauccuucauugagguuaagacuuguaucuggccaaaaucccauacacucuggucaaacggagugcuggaaagcgagaugauaauccccaagauuuauggcgguccuaucucucaacacaauuaccgaccaggcuacuucacccagacugcggggccguggcaucuuggaaaauuggagcuggauuuugacuuaugcgaaggcacaaccguagucguggaugagcacugcgggaacagaggacccucccucaggacgacuaccgugacaggcaagauuauccacgaaugguguugccgcaguuguacccugccuccacuucgguucagaggugaggacgggugcugguauggaauggagauaaggcccgucaaagaaaaggaggaaaaucugguuaagagcauggugucugccggcuccggugagguagacucauuuaguuugggccuccuguguauuagcaucaugaucgaagaggugaugcgcucgcgauggucccggaaaaugcuaaugacugggacacuggcugucuucuuucuccugauuaugggacagcuuaccuggaacgauuugauccgucugugcauuauggugggcgccaaugcaucugacagaauggggaugggaacaacuuacuuagcucucauggccaccuucaagaugaggccuauguuugcaguuggccugcuuuuccgccggcugacgagcagagaggugcuacuccugacaauagguuugucacuggucgccaguguggaauuaccaaacucccucgaggaacugggggauggacuugcuaugggcaucaugauucugaaauugcucaccgacuuucaaucucaucagcugugggcgacucuacugagccuuaccuucaucaagacaacuuuuucccuccacuaugccuggaaaaccauggcaaugguucugucaauugugagcuuguucccccuguguuuaaguacgacaucucagaagaccacuuggcucccgguccugcuuggcucccuggggugcaagccuuugacaauguuucucaucgcugagaauaaaauauggggaaggcgaagcuggccacugaacgaagguaucauggccguaggcauugugucgauccuacugucaucucuucucaagaacgauguuccccuggccgggccuuugauugcuggaggcauguuaaucgcauguuacgugauaagugguuccagcgccgaccugucucucgagaaagcggcugaggucagcugggaagaggaagccgagcauuccggggcaucacacaauauucugguggaaguacaggaugacggaaccaugaagaucaaagaugaggagcgcgacgauacucuuacaauccuguugaaggccacccuacuggcugugaguggcgucuauccccucagcauuccagcaacgcuguucguuugguacuucuggcagaaaaagaagcagcggucuggcgugcuuugggacacuccuucacccccagaaguggagagagccgucuuagaugacgggauauauaggaucaugcagcguggacugcucggucgcagccaggugggcguugggguauuucaagaaaacguguuccauaccauguggcacgucacacggggagcgguguugauguaccagggcaaaagacuggagccgaguugggcuagcguuaagaaagaccucauuuccuacggugggggauggaggcugcagggcucuuggaauaccggcgaggaagugcaggucaucgccguggagccugggaagaaccccaaaaauguacaaacagcaccaggaacuuuuaagacccccgaaggugaggucggcgccauugcucuugauuucaagccugggacgucgggaagcccaaucgugaaccgagaaggcaaaauaguuggucuguaugggaauggaguggucacaacuucaggcaccuacguguccgccaucgcacaggcuaagacaagucaggagggccccuugccugagauugaagacgagguuuuucggaaacgcaaccuaaccaucauggaucugcacccggggucuggaaagacuagaagguaucucccagccauugugcgggaagcgaucaaacgaaaguuaagaacccugauacuugcccccacacgcgucguggcaagcgagauggcugaagcccugaaggguaugccuauuagguaccaaacgacugcuguaaaauccgagcauaccggcaaggagaucguggaccucaugugccacgcaacauucaccaugcguuugcugucaccaguucggguccccaauuauaacaugaucauuauggaugaagcccauuuuacugacccuucuagcaucgccgcuagaggguacauaaguacaagggugggaaugggcgaggcggcagccauuuucaugaccgcuacgccgcccgguuccguggaagccuuuccacagagcaaugcagucauccaggaugaggaacgcgacauuccugagcgaucuuggaacucaggguaugaguggaucacugauuuccccggaaaaacaguaugguuugugccauccauaaagaguggcaaugacauugccaacugucucaggaaaaauggcaagcggguuauccagcugagcaggaagaccuucgauaccgaauaccagaaaacuaagaacaacgacugggacuacguggucacaaccgauaucucggagaugggggcuaauuuccgcgcggaccgugugauugauccuagacggugccuuaaacccguuauccuaaaggacggaccagaaagggugauucuggccgguccgaugccugucacaguggcaucugcugcccagcgccgaggcagaauagggcggaaccacaauaaagagggagaucaguauaucuacaugggccagcccuugaacaaugacgaggaucaugcacacuggacugaagccaagauguuacuggacaacauuaauacgccagaggguaucauccccgcucucuuugaaccugagagggaaaaguccgccgcgauugauggggaguaucgccugagaggcgaggcaaggaaaaccuucguagaacuuaugcggcguggagaccugccaguguggcucagcuacaagguugccucagagggcuuucaauauagugaucgccgauggugcuucgacggggaaagaaacaaucaggucuuggaggaaaacauggauguggagauauggacaaaagagggagaaaggaagaaacugcggccccgcuggcuagacgcuagaacuuacucugacccucuggcccucagggaguuuaaggaguucgcugcaggucggcgauccgugagcggcgaucuuauccuggagauugggaaauuaccgcagcacuugacccagagagcccaaaaugcucuggacaaccucgucaugcugcauaauucagaacagggaggccgcgccuauaggcacgcaauggaggagcuuccagauacaaucgaaacccugaugcucuuggcgcugauugccguuuuaacugguggggugacgcuauuuuuccugaguggccggggacucggcaagaccagcaucgggcuucuguguguaauggcuuccucuguguugcuguggauggccagcgucgagccccauuggauagcagcuuccaucauucucgaauuuuuccugauggugcuucucaucccugagcccgaccgucagagaacaccacaggauaaccaacuggccuacguugugauuggauugcuguuuaugaucuuaacugucgcagccaaugagaugggucuacuggaaaccacaaagaaagaccucggcauagggcacguagcuguggagaaccaccaucacgcggccaugcuugauguugaccugcauccugcaucagcuuggaccuuguacgccguggccacuacaauuaucacgcccaugaugaggcacaccauugaaaacacuacagcaaauaucucucugaccgcuauagccaaccaggcggcuauccucaugggacuggauaagggcuggccaauuaguaaaauggacaucggugucccucuuuuagcccuggggugcuauagccaggugaauccgcucaccuugacagcagccguccugaugcuaguggcucauuacgcaauuaucggccccggacugcaagccaaggcgacucgcgaggcucagaaacggacggccgcaggcauaaugaagaacccaaccguugaugggauuguggccaucgaccucgauccuguaguguaugacgcuaaguucgaaaaacagcuuggacagaucaugcuguugauucuguguacaagccaaauccuccugaugcgaacuaccugggccuuaugcgaguccauaacacuugcaaccggcccccugacuacgcucugggaggguucuccagggaaguuuuggaauacaaccauugcugucucaauggccaacaucuucagaggaagcuaccuagcgggcgccggucuggcauucuccuugaugaaaagucugggcgggggaaggcgcggcacuggggcucagggagaaacccucggcgagaaguggaaacggcagcuuaaucagcugucuaagagcgaauuuaacacauauaagagaucagguauuauggagguugaccguuccgaagccaaagagggguugaagaggggagagacuaccaaacacgcagugagucggggcacagcuaagcugcgcugguucgucgaacgaaaucucgugaaaccugaggguaagguaaucgauuuaggcugugggagaggaggcuggagcuacuauugcgccgggcugaagaaagugacggaaguuaagggauacaccaaaggcggucccgggcacgaggaaccgauaccaauggccacuuacggauggaaccuugugaagcugcauucuggcaaagacgucuuuuucaucccucccgagaagugugauacacuacucugcgacauuggcgaguccucaccaaaucccaccaucgaagaggggaggacucugcggguguugaaaauggucgaaccuuggcugcgcggaaaccaauuuuguauuaagauccucaauccguauaugcccagcgugguugagacacuugagcagaugcagagaaagcacgguggcaugcugguaaggaacccauuaucgcgaaauucuacccaugaaauguacugggugaguugcgggacgggaaacauugucuccgcggugaauaugaccagccggaugcuguugaaccguuucacaauggcucacagaaaaccuacuuaugagcgcgauguugaccucggcgcagguaccaggcacguggccgucgaacccgagguggcuaaccuggauaucauagggcagcggauugaaaauaucaagcaugagcacaaaucaacauggcauuacgacgaggauaacccuuauaagacuugggccuaccacggauccuaugaaguaaaaccaucuggcagcgcaaguuccauggugaauggcguugucaagcuacuuaccaagcccugggacgugaucccuauggugacacaaauugccaugaccgauacuacgccauuugggcagcagagagucuucaaagagaagguugacacacgcacccccaaagcuaagaggggaacugcgcaaauaauggaagugaccgccaaauggcugugggguuuucucagccgaaacaagaagccgcggaucuguacaagagaggaguucacgaggaaaguacgcucuaaugcagcuauuggcgccguguuugucgacgagaaccaguggaacucagcaaaggaggccguggaagaugagcguuucugggaccugguucaucgggaaagagaguugcacaaacaggggaagugcgcuaccugcguguacaacaugaugggaaaaagggaaaagaagcugggcgaguuugguaaagccaaggggagucgcgcgaucugguacauguggcucggagcacgauuccuugaguucgaagcccugggcuuuaugaaugaggaucacugguucucccgggaaaacagcuuaucuggcgucgagggggagggacugcauaaauuggguuauauucucagagacaucucgaagauaccuggcgggaauauguacgcugaugacacugccggaugggauacaaggaucaccgaagacgaucugcagaacgaggcacgcauuacugacaucauggaaccagagcacgcucuacuugccaaaucaauuuuuaagcugacauaucaaaauaaagugguaagaguucagcggcccgcuaagaacggcaccgugauggaugucaucagcaggcgugaccagcgagguuccggacaggugggaacauacggccucaauacuuucaccaacauggaagcccaacugauacgccagauggagagugagggcauauuuucuccuagcgaauuggagacgccaaacuuagcagaaagagugcuggauuggcucgagaaguauggggucgaacggcuuaaaaggauggcgaucuccggagacgacuguguugugaagcccaucgaugaccgcuucgccaccgcucugacagcccuaaaugauauggguaaaguaagaaaggacauuccgcagugggagccuucaaaaggcuggaacgauuggcagcaagugcccuuuugcagucaucacuuccaccagcugauaaugaaggacgggcgggagaucgucgugccauguaggaaucaggaugaacucguuggacgagcacgugugucucagggcgcugguuggagcuugagagagacugccugccuggggaaguccuacgcacaaauguggcagcuuauguauuuucaucgccgggaccugaggcucgccgcgaacgcuauuuguucagccgucccuguggauuggauccccaccagcagaacaacuuggucuauucacgcacaucaccaguggaugaccacggaagacauguuauccguauggaaucgcguuuggaucgaggaaaacccauggauggaggauaaaacacauauaaguagcuggggagacgugcccuaccugggcaagcgggaggaccaauggugcggcucguugaucgggcugaccgccagggcuacuugggccacaaauauucaggucgcaaucaaccaggugcgaagacucauuggaaaugaaaacuaccuugauuauaugaccuccaugaaacgguucaagaaugagucugacccugaaggugcucugugguga

SEQ ID NO: 13616 - RNA, 9879 nt, Artificial Sequence
  derived and/or modified CDS sequence (opt3) from DENV-1__FJ205882__SS-prME
agcgugaccaugcugcucaugcuuaugccaacagcacuggcuuuccacuugacuacgcgaggaggggaaccucauaugaucgucuccaagcaggaaaggggaaaaucuuuacuguuuaagaccucagccgguguuaacaugugcacacuaauugccauggaccucggcgaacugugugaagauacuaugaccuacaaaugcccacggauuacagaagcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuagcaccgagauccagcugacagacuacggggcccucacccuugauuguucuccaaggacuggacuggacuucaacgaaauggucuugcuaacaaugaaggagaaauccuggcuggugcauaagcagugguuucucgaucugccgcuucccuggacgucaggcgcaagcaccagucaagagacuuggaaucggcaggaccuguugguaacauucaaaaccgcucacgccaagaagcaggaaguugugguccucgguucucaagagggggcuaugcacacagcccugacuggcgcaaccgaaauccagacguccggaaccacaacuauuuuugccggccauuuaaaaugccgucugaagauggauaaacuaacccucaaggggaugagcuaugugauguguacaggaucguucaaacuggagaaggaagucgcugagacucagcacgguaccgugcuuguucagauaaaguacgagggcacggacgcgccuugcaaaaucccauucucuacacaagaugaaaagggggugacccagaacggacgcuugauuacugcaaaucccaucguaacagacaaagagaagccugucaacauagaagccgagccacccuuuggcgaguccuauauugugaucggugcuggggaaaaagcccugaagcucucaugguucaagaaaggcaguagcaucggaaagauguuugaggcaaccgccagaggcgcuaggcggauggccauucugggggauacugcaugggacuucggauccaucgguggcguuuuuaccucuguggggaaacuuguccaucagauuuucggaacagcguacggcgugcuguuuagcgguguaucauggacgaugaagauagggaucggcguguugcucaccuggcugggauuaaauagucgauccacuagccugucuaugacauguauugcuguuggccuagucacccucuaccugggggugauggugcaggccgauucaggaugcgucaucaacuggaaaggccgcgaacuuaagugugguagugggaucuucguuacaaaugaggugcacacuuggaccgaacaauauaaguuucaggcagacagcccgaaaagauuguccgccgcuauuggaaaggccugggacgagggcgugugcgguauaaggucugcaacgcggcuggagaacaucauguggaaacagauuucgaacgaacucaaucauauccuguuagagaacgauaugaaguucacaguagucgugggcgacguugcugggauucuggcccagggcaagaagaugauccgcccucaacccauggaauacaaauauagcuggaaguccuggggcaaggcgaaaauaaucggggccgaugugcagaauaccacuuuuauuaucgacggaccaaacaccccugagugucccgaugaccagagagcuuggaauauuuggaaggucgaagaucacggcuucgguaucuuuccaacaaacauauggcuuaaauugagggacucauacacucaggugugcgaucaccgucucaugagugcagccauuaaggacucuaaagcuguucaugccgauaugggguauuggaucgagagcgagaagaaugaaaccuggaagcuggcacgggcguccuucauugaggugaaaacauguaucuggcccaagucacacacgcuauggagcaacggaguacuggaaucugagaugauaaucccuaaaauuuacggcgguccaaucucccaacauaauuaucgaccgggcuacuucacccagacugccgggcccuggcaccucggaaagcuggaacuugacuuuaacuugugcgagggcacaaccgucgugguggaugagcacugcgggaauagaggaccuagucugaggacuacaaccgucacgggcaaaauuauccaugaaugguguugccgcagcuguacuuuaccaccccuccgguucaagggugaggacgggugcugguacggaauggaaauaagaccuguuaaggagaaagaggaaaaccuggugaagucuaugguauccgcuggcucaggugagguggacaguuuuagccuuggccuguuguguauuucgaucaugaucgaagaggucaugaggucccgcuggucucgaaaaaugcucaugaccgggacacuggccguguucuuucuacugauuaugggacagcucaccuggaaugaucugauccggcuuugcauuaugguuggcgcaaacgcuagcgaccguauggggaugggaacuacauauuuggcccugauggcaaccuucaagaugagaccaauguuagccgugggccuccuguuuaggcgccuuacaucacgggaaguccugcuacucacuauaggucugaguuugguggcuuccguugagcugcccaauucuuuagaggaacucggggauggacuggcgaugggcaucaugauucuuaaacuguugaccgacuuccaaagccaccagcucugggccacgcugcuaucccugacauuuaucaagaccacuuacucacuucauuaugcauggaagaccauggcuauggugcucagcauugucagucuguucccguugugucugucuacaacuucccagaaaaccacgugguuaccuguacuccugggcagccuugggugcaagccacugacaauguuuuugaucgccgagaacaaaauauggggaagaaagucguggccccucaacgaagguaucauggccgugggcauuguuucaauccugcuaucuagucugcuuaaaaaugaugugccucucgcugggccccugauugcaggaggcauguugaucgccuguuacgucauauccgguagcucugcggacuuaagccuggagaaggcugccgaaguguccugggaggaggaagcagagcacucaggggccagucauaacauucucguagaagugcaggaugacggaaccaugaaaaucaaggaugaggaaagggacgauacucugacaauccuucugaaggcuaccuugcuagcagucagcggcguuuauccacugucuauuccugccacucucuucgugugguacuuuuggcagaagaagaaacagcgauccggcgugcugugggacacacccucaccaccggaggucgagcgcgcggugcuugaugacgggauauaucggaucaugcagagaggauuacuggguaggagucagguuggcguagggguguuccaagaaaaugucuuccacaccauguggcacgugacgcguggagcuguucucauguaccagggcaagcgcuuggagccuagcugggccuccgugaaaaaggaccugauuucuuacggugggggauggcggcuccagggcucguggaacacuggcgaagagguccaggugaucgcaguagagcccgggaagaaucccaagaauguccaaaccgcccccggaacauuuaagaccagcgaaggugaggugggcgcuauugcccuggauuucaaaccugggacaucaggauccccaaucguuaauagagaaggcaagauagugggucuuuaugggaacggagucgugacuaccaguggcacguacguuucugcaaucgcucaggccaaagcgagccaggagggcccccugccugaaauugagaaugagguguuuaggaagcgaaacuugacaaucauggaccuacauccgggguccggaaagacucggcgcuaucugccagccauugucagagaagcaaucaaaaggaagcuccggaccuuaauacuggcucccacacgagugguagccucagagauggcugaagcacuuaaagguaugccuauuagauaccaaaccacugccgugaagucugagcacaccggcaaagaaaucguugaucugaugugccaugccacauucacgaugcgccucuugagcccagucagggugcccaauuauaacaugaucauuauggacgaggcucacuuuacugauccuaguuccaucgcggcacguggguacauaagcacccgggugggaaugggcgaggccgcugccauuuucaugacagcaaccccgcccgguucugucgaagccuuuccacagucaaaugcuguaauccaggacgaggaaagagauauuccugagagguccuggaacaguggguaugaauggaucacugacuuccccggaaagacagugugguuuguuccaagcauaaagucgggcaaugauauugcgaacugucugcgcaaaaacggcaagcgagugauccagcucucuagaaaaaccuucgacacggaguaccaaaagacuaaaaauaacgauugggacuacgucgugacaaccgacaucuccgagaugggggccaauuuucgggcagauaggguuauugacccucgccguugccugaagcccgugauccuuaaggauggaccagaaagagucauucuagcugguccgaugccugugaccguagccagcgcagcccagcggaggggccgcauagggcgaaaccauaauaaagagggagaccaguauaucuacaugggccagccccugaacaaugaugaagaccacgcucacuggacugaggccaagauguuguuagauaacauuaauacaccagaggguaucauccccgcgcuguucgaaccugagagagaaaaaucagcagccauugacggggaguaucggcucaggggcgaagcucgcaagaccuucguggagcugaugagaaggggagaucuuccaguuuggcugaguuacaaagucgccucugagggcuuucaauauuccgaccggcguuggugcuucgauggggaacgcaacaaucaggugcucgaggaaaacauggacguggagauauggacaaaggaaggagagaggaaaaaguugagacccagauggcuggaugcucggacuuacagcgacccucuagcacugcgcgaguuuaaggaguucgccgcugguagaaaaucagucaguggcgaccucauccuugagauugggaagcugccgcagcauuuaacgcagagggcccaaaaugcauuggauaaccugguuaugcuccacaauagcgaacagggaggccgggcguaucgacaugccauggaggaacugccagacaccaucgagacacuuaugcugcucgcuuugauugccgugcugacuggugggguaaccuuauuuuuccuauccggcagaggacugggcaaaacaucuaucgggcuccuuugugugauggcaagcuccguccuguuguggauggcuucaguggagccccacuggauagccgcaucuaucauucuggaauuuuuccucaugguucugcuuaucccugagcccgaucgccagaggaccccacaggacaaccaacucgccuacguggucauuggacuguuguuuaugauccugacuguagcugcgaacgaaauggguuuacuagagacgaccaagaaagaucugggcauagggcacguggccguugagaaucaucaccaugcagcuaugcucgacguggaucuucacccugccagugccuggacacuguacgcagucgcuacuaccauuaucacacccaugaugcggcauaccauugaaaacacuacagccaauaucucguugacggcgauagcuaaccaggccgcaauccugaugggacucgacaagggcuggccaauuagcaagauggauaucggugugccucugcuugccuuagggugcuauucccaggucaauccgcugacccucacugcugcaguguugaugcugguugcccacuacgcgauuaucggccccggacuacaagcuaaagccacacgugaggcacagaagagaaccgccgcuggcauaaugaaaaacccaaccguggacgggauuguagccaucgaucuggacccuguggucuaugaugcaaaguucgaaaaacagcucggacagaucaugcuucugauuuuguguacaucucaaauccugcucaugaggacuacgugggcucugugcgagucaauaaccuuagccacaggcccccuuacuacccugugggaagguagcccagggaaguuuuggaauacaaccauugcgguuuccauggccaacaucuuccgcggaaguuaccucgcaggcgcuggucuagccuuuucucugaugaaaucauugggcgggggacggcgaggcacuggggcacagggagagacgcugggcgagaaauggaagagacagcucaaucagcuuagcaaauccgaguucaacacauauaagaggagugguauuauggagguggaccgcagcgaagcuaaagaggggcugaagcggggagaaaccacuaagcacgccgucucuagaggcaccgccaaauugcguugguucguggagaggaaucugguaaagccugaggguaaagugaucgaccucggcugugggcggggaggcugguccuacuauugcgcgggguuaaagaaaguuacagaagugaagggauacacuaaaggcggucccgggcaugaggaaccgauaccaauggcuaccuacggauggaaccuggucaaacuucacucaggcaaggauguguuuuucaucccucccgagaaaugugacacacugcuaugcgauauuggcgaaagcucgccaaaucccacgaucgaggaggggcgcacccuccgaguccugaagaugguggaaccuugguugagaggaaaccaauuuuguauuaaaauccugaauccguauaugcccucuguuguagagacucucgaacagaugcagaggaagcaugguggcaugcuugugcggaacccacugagucgcaauuccacacacgagauguacugggucagcugcgggaccggaaacauugugucagcaguuaacaugacuuccagaauguuacugaauagguucacaauggcccaccgaaaaccuaccuaugagcgggacguggauuugggcgcugguacgcgucaugucgccguggaacccgagguagcaaaccucgacaucauagggcagagaauugaaaauaucaagcacgagcauaagucuaccuggcacuacgaugaagacaacccuuauaaaacaugggccuaccauggaagcuaugaggugaagccaaguggcuccgcuagcucuaugguuaauggcgucgugaaacugcuaacuaagcccugggaugugaucccuauggucacccaaauugcgaugacagacacuaccccauuugggcagcagcgcguuuucaaagagaagguggauacaaggacccccaaggccaaacggggaacugcacaaauaauggaaguaacggcuaaguggcuuugggguuuucugucaagaaacaaaaagccgcgcaucuguacaagggaggaguucacccgaaaagugcggaguaaugccgcaauuggcgccgucuuuguggacgagaaccaguggaacuccgcuaaggaagccguugaggacgagagauucugggaucucgugcacagggaacgcgagcugcacaagcaggggaaaugcgcgacuugcgucuacaacaugaugggaaagcgugagaaaaaguugggcgaguuugguaaagcaaaggggagccgggccaucugguacauguggcugggagcuagauuccucgaauuugaggcccuuggcuucaugaaugaggaccauugguucucuagggaaaacucgcugucaggcguggagggggaaggauuacacaaacuggguuauauuuugcgcgauaucagcaagauaccuggcgggaauauguacgcagacgauaccgcuggaugggacacacgaaucacggaggaugaccuccagaacgaggccaagauuaccgauaucauggaaccagagcaugcucugcuagccaaauccauuuuuaaacuuacuuaucaaaauaaaguaguucgggugcagagacccgcaaagaacggcacagucauggacgugaucaguaggcgcgaucagagagguucugggcaagugggaaccuacggccugaacacuuucacaaauauggaagcgcaacucauacggcagauggagagcgaaggcauauuuuccccuucagagcuggagaccccaaacuuggccgggagggucuuagacuggcuggaaaaacacggaguugagcgucucaagcgaauggcuaucaguggugaugacugugugguaaagcccaucgacgaucgcuucgccacagcacuuacugcucugaaugacaugggcaaagugagaaaggauauuccgcagugggaaccuucuaaaggguggaacgacuggcagcaaguccccuuuugcagccaccauuuccaccagcuaauaaugaaggauggacgggagaucgugguuccauguaggaaucaggacgaacuggugggccgcgccagagucucccagggugcaggguggucacuccgggagaccgccugcuugggaaaaagcuaugcgcaaauguggcagcugauguacuuucauaggcgagaucuucgucuggcugccaacgcaauuuguucugccgugccuguagacuggguucccacguccagaaccacauggaguauccacgcucaucaccaguggaugacuaccgaggauaugcucagcguguggaaucgcgucuggauugaagagaacccauggauggaagacaagacacacaucucguccuggggcgaugugcccuauuuaggcaagcgggaggaccaauggugcgggucucugauaggauugacugccagggcaaccugggcuacgaauauccagguugccauuaaccaggugagacgccugaucgguaaugaaaacuaccucgacuacaugacaucaaugaaacgguucaagaaugagagcgauccugagggcgcgcuuugguga

SEQ ID NO: 13617 - RNA, 9879 nt, Artificial Sequence
  derived and/or modified CDS sequence (opt3) from DENV-1__FJ390388__SS-prME
agcgugaccaugcugcucaugcuuaugcccacagcccuggcuuuccacuugacuacgaggggaggggagccucauaugaucgucuccaagcaggaaaggggaaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucagacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagccgggauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggaucggggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaaggggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacucaugacauggcugggauuaaauucacgaaguaccucccugagcaugacauguauugcggugggccuaguuacucucuaccugggggucauggugcaggcugauucuggaugcgugaucaacuggaaaggccgcgaacuuaagugugguucagggaucuucgucaccaaugagguucacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacugugguagucggcgauguggcagggauucuggcucagggcaaaaagaugauccgcccucaacccauggagcacaaauacucguggaaaagcuggggcaaggccaagauaaucggggcggacguucagaauaccacauuuauuaucgauggaccaaacacuccugaaugucccgacgaucagagagccuggaauauuugggagguggaggacuauggcuucgguaucuuuaccacaaacauauggcuuaaguugagggauuccuacacgcaggucugcgaccaccgucucaugucagcugcaauuaaagauaguaaggccgugcaugcugacaugggguauuggaucgaaucugagaaaaaugaaaccuggaagcuggcccgggcauccuucauugagguuaagacuuguaucuggccaaaaucccacacacuauggucaaacggagugcuggaaagcgagaugauaauccccaagauuuacggcgguccuaucucucaacauaauuaucgaccaggcuacuucacccagacugcggggccguggcaccucggaaaacuggagcuugauuuugacuugugcgaaggcacaaccguagucguggaugagcacugcgggaacagaggacccucccugaggacgacuaccgugacaggcaagauuauccaugaaugguguugccgcaguuguaccuuaccuccacuccgguucagaggugaggacgggugcugguacggaauggagauaaggcccgucaaagaaaaggaggaaaaucugguuaagagcauggugucugccggcuccggugagguagacucauuuagucuuggccuguuguguauuagcaucaugaucgaagaggugaugcgcucgcgauggucccggaaaaugcucaugacugggacacuggcugucuucuuucuacugauugugggacagcucaccuggaacgaucugauccgucuuugcauuaugguuggcgccaaugcaucugacagaauggggaugggaacaacuuauuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaccaguugugggcgacucuccugagccuaaccuucaucaagacaacuuuuucccugcauuacgccuggaaaaccauggcaauggugcuuucagucguaagccucuucccccuguguuugaguacgacaucucagaagaccacuuggcugccgguguuacucggcucccuggggugcaagccucuuacaauguuucugauugcugagaauaaaaucuggggaaggcgaagcuggccauugaacgaagguauaauggccguuggcaucgugucgauucuccugucaucucuacugaagaacgaugucccccuugccgggccucucaucgcuggaggcaugcugauugcauguuaugugaucagugguuccagcgccgacuugucuuuagagaaagcggcugagguaagcugggaagaggaagccgagcacuccggggcaucacauaauauacugguggaaguccaggaugacggaaccaugaagauuaaagaugaggagcgcgacgauacucucacaauccugcuuaaggccacccuguuggcuguuaguggcguguacccccuaagcaucccagcaacgcuguucgugugguauuucuggcagaaaaagaagcagcggucuggcguccucugggacacuccuucacccccagaaguggagagagccguucuggaugacgggauuuacaggauaaugcagcguggacuuuuaggucgcagccagguaggcgugggggucuuucaagaaaacguguuccacaccauguggcacguuacacggggagcggugcugauguaucagggcaaaagacucgagccgaguugggcuagcgucaagaaagacuugaucuccuacggugggggauggaggcugcagggcucuuggaauaccggcgaggaagugcagguaauugccgucgagccugggaagaaccccaaaaaugugcaaacagcaccaggaacuuuuaagacccccgaaggugagguuggcgccaucgcucucgauuucaagccugggacgucgggaagcccaauugugaaccgagaacggaaaaucgucggccuguacgguaauggggugguuacaacuucaggaaccuauguguccgccauagcacaggcuaaggccagucaggagggcccccuuccugagaucgaagacgaggucuuucgcaaaagaaaccugacaauuauggauuugcauccgggcucugggaagaccaggcgguaccuaccagcgaucgugcgagaagccauuaaaagaaagcugcgcacucucaucuuagcacccaccaggguaguggcuagcgagauggccgaagcucugaagggaaugccuauacguuaucaaacaacggcaguuaaauccgagcacacugguaaggagauugucgaccuuaugugccaugccaccuucacaaugcggcugcucucaccagugagagugcccaauuacaacaugaucaucauggaugaagcccacuuuaccgacccuucuagcauugcugcgaggggcuauaucaguacucgcgucgggaugggagaggcagccgcuauauucaugacagccaccccgcccggcuccguagaagcauuuccacagagcaaugccgugauucaggaugaggaacgagacaucccugagagaucuuggaacucagguuacgaguggauuacggauuuccccgggaaaacuguuugguuugugccauccaucaagaguggaaaugacauagcuaacuguuugcggaaaaauggcaagagggucauucagcugagccgcaagacauucgauaccgaauaucagaaaaccaagaacaacgacugggacuacgugguuacuacagauaucucggagaugggcgcgaauuuccgugccgacagagugaucgauccucggaggugccucaaacccgucauucugaaggacgggccagaacgcgugauccuugcaggaccgaugccuguaaccguggcuucugccgcacagcgaagaggucggauuggcaggaaccauaauaaagagggggaucaguacauauauaugggacagccccuaaacaaugacgaggaucacgcccacuggacagaagcuaagaugcuguuggacaacaucaauacuccagagggcauuauccccgccuuauuugaaccugagcgcgaaaaguccgcggcaaucgauggugaguacagacugagaggggaagcccggaaaacguucguugaacucaugcgucgcggcgaccugccagucuggcuuagcuauaagguggcuucagagggauuucaauacagugaucgaagauggugcuucgacggcgaaaggaacaaucaggugcuggaggaaaacauggaugucgagauuuggaccaaagagggggaacggaagaaacuccgccccagaugguuggacgccaggacauauucugacccucuggcucuacgggaguuuaaggaguucgcagccggacgaagauccguuagcggugaucugauacucgagaucggcaaacuuccgcagcaucugacucagcgcgcucaaaaugccuuagacaacuuggugaugcugcacaauucagaacaagggggaagggcauaccggcaugcgauggaggagcucccagauaccauugaaacacugaugcuucuggcccucaucgcuguauugaccggcggugugacucuguuuuucuuaagugggcguggccuaggaaagacgagcauuggccugcucugugucauggccuccucugugcuucuguggauggcaagcguugagccccacuggaucgcugccuccauaaucuuggaauuuuuccugauggugcuccugauuccugagcccgacagacagaggaccccacaggauaaccaacuugcauaugucguaaucgggcuccuguuuaugauuuugacaguggccgcuaaugagaugggacuguuagaaacuaccaagaaagaccuagguaucggccacguugcgguggagaaccaucaccaugccgcaaugcuggaugucgaccuccacccugcuucagccuggacacuuuacgccguggcaaccacuauaauuacacccaugaugcgccauacgaucgaaaacaccacugcuaauauuucucugacagccaucgcgaaccaggcugccauauugauggggcuggauaagggauggccaaucaguaaaauggacauuggcgucccucuccuggcacuugguugcuacagccaggugaauccguuaacccugaccgccgcuguucucauguugguggcacacuaugccaucauugggcccggccugcaagcgaaggcuacacgggaggcccagaaacgaacugcagccggaaucaugaagaacccaacgguagauggcauaguggcuauugaccuagauccugucguuuacgacgccaaguucgaaaaacagcuggggcagaucaugcuccuuauccuguguaccagccaaauuuugcugaugagaacaacuugggcacucugcgaguccaucacccuggcuacaggacccuuaaccacucuuugggagggcucuccagguaaguuuuggaauacgacaauagccgugucaauggcgaacauuuucagggggagcuaucuggccggagcaggccucgcuuucucccuaaugaaaagucuggguggcgggcgccggggaaccggcgcccagggggaaacuuugggagagaaguggaaaagacagcugaaucagcucucuaagagcgaauuuaacaccuacaagcguucaggcaucauggaggucgacagguccgaagcaaaagagggucuuaagagaggggaaacaacuaaacacgcugugagucgcggaaccgccaagcugcgaugguucguagaaagaaauuuggugaaaccugagggcaagguuauugaucuggguuguggcagagggggauggagcuauuacugcgccggccucaagaaagugacagaagucaagggguauacgaaaggaggccccggucaugaggaaccgaucccaauggcgaccuacggguggaacuuagugaagcugcacucuggaaaagacgucuuuuucauaccucccgagaagugugauacucuucugugcgacaucggcgaguccucaccaaaucccacaauugaagagggccggacccuacgcgugcucaaaaugguugaaccuuggcugagagggaaccaauuuuguaucaagauuuugaauccguacaugcccagcguaguggagacucuggagcagaugcagaggaagcauggagguaugcucguccgaaacccacuuucgagaaauucuacacacgaaauguauugggugaguugcggcaccgggaacaucguuuccgcugugaauaugacgagccguaugcuguuaaacagauucaccauggcacaccgcaaaccuacauacgagagggaugucgaccugggagccggcacucggcauguggcuguagaacccgagguggccaacuuggauauuaucggucagagaauagaaaauauuaagcacgagcauaaaucaaccuggcacuaugacgaggauaacccuuacaagacaugggcauaucauggguccuacgaaguuaaaccaucuggaagcgccaguuccauggucaauggcguggugaagcuccugacuaagcccugggacgucaucccuaugguuacccaaaucgcuaugacagauaccacuccauuuggccagcagcgcguguucaaagagaagguagacacgaggacacccaaagcgaagcgagggaccgcccaaauuauggaagugacugcaaaauggcuauggggauuucuuagccggaacaagaagccgagaauauguaccagggaggaguucacacgcaaaguccguucuaaugcugccaucggugcaguguuuguugacgagaaccaguggaacucagccaaggaggcuguggaagaugagcgguucugggaccugguccacagagaaagggagcuccacaaacagggcaagugcgccacgugcguguauaacaugauggggaaacgcgaaaagaagcugggagaguuuggcaaagcgaaggguagucgagcaauuugguacaugugguugggggcccgguuccuggaguucgaagcucucggauuuaugaaugaggaucauugguucuccagagaaaacagccuuucuggcguagagggcgaggggcugcacaaauuaggauacauccugagggacauuucgaagaucccugguggcaauauguaugccgaugacaccgcagggugggauacucgcauaacagaagacgauuugcagaacgaggcuagaaucaccgacauuauggaaccagagcaugcccuccuggcuaaaucaaucuuuaagcuaacuuaccaaaauaaaguugugcggguccagaggcccgccaagaacggaacagugauggaugugauuagccgucgagaccagcgcggcuccggucaggucgggaccuauggacuuaauacauucacuaacauggaagcacaacugaucagacagauggagagugagggcauauuuucuccuagcgaacucgagaccccaaaccuggcggaacggguuuuggauugguuagagaaguacggcguggaaaggcugaaacgcauggccauuuccggggacgacuguguagugaagcccaucgaugacagauucgcuacggcccucaccgcacuuaaugauaugggaaaaguccggaaggacaucccgcagugggagccuucaaaagguuggaacgauuggcagcaagugcccuuuugcagucaccacuuccaucagcugauuaugaaggacggcagggagauaguugugccaugucgaaaucaggaugagcuagucgggcgugcuagagugucucagggagccggcuggagccugcgcgagacagcaugccucgguaaguccuaugcccaaauguggcaguugauguacuuucaccggagggaccugagacuugcggcuaacgccaucuguucagcaguaccuguugauuggauucccacuagccgcaccacauggucuauccaugcccaccaucaguggaugacuaccgaagacaugcuguccguguggaaucgggucuggauugaggaaaacccauggauggaggauaaaacgcacaucaguagcuggggagacgugcccuaucucggaaagagggaggaccaauggugcggcucguuaauaggccugacagcucgagccaccugggcaacuaauauccagguugcuauuaaccaggugagacgguugaucgggaaugaaaacuaccuggauuacaugacauccaugaaaagguucaagaaugagucugacccugaaggagcccucugguga

SEQ ID NO: 13618 - RNA, 9879 nt, Artificial Sequence
  derived and/or modified CDS sequence (opt3) from DENV-1__FJ024464__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacgcugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgugaggcggauggccauucuuggggauacagcuugggacuucggaagcaucgguggcguuuuuacguccguggggaaacugguccaucagauuuucggaaccgccuacggcguguuguuuucugguguaagcuggacuaugaagauagggaucggcgugcuccugacaugguuaggacuaaauucacgaaguaccucccuaagcaugacauguauugcaguuggccucgucacucuguaccuuggggugauggugcaggcggauucuggaugcgucaucaacuggaaaggccgcgaauugaagugugguucagggaucuucguuaccaaugaggugcacacguggacagaacaauauaaguuucaggcugacaguccgaaaagacugagcgccgcaauuggaaaggccugggaggagggcgugugcgguauaagguccgcuacccggcucgaaaacaucauguggaaacagauuucuaacgagcugaaucauaucuuacuggaaaacgacaugaaguucacuguagucgugggcgauguugccgggauucuugcacagggcaagaagaugauccgcccucaacccauggaguacaaauauucguggaaaagcuggggcaaggcuaagauaaucggggccgacgugcagaauaccacauuuauuaucgauggaccaaacacuccugaaugucccgacgaucagagagcguggaauauuugggaggucgaggacuacggcuucgguaucuuuaccacaaacauaugguugaagcucagggauuccuauacacaggugugcgaccaccgucugaugucagccgcuauuaaagauaguaaggcaguucacgccgacaugggguacuggaucgaaucugagaaaaaugaaaccuggaagcuagcucgggccagcuucauugaggugaagacuuguaucuggccaaaaucccauacacuguggucaaacggaguacucgaaagcgagaugauaauccccaagauuuauggcgguccuaugucucaacacaauuaccgaccaggcuacuucacccagacugcagggccguggcaucugggaaaacuugaguuggauuuugaccugugcgaaggcacaaccgucgugguggaugagcacugcgggaacagaggacccuccuuaaggacgacuaccgucacaggcaagaucauucacgaaugguguugccgcaguuguacccucccuccacugcgguucagaggugaggacgggugcugguauggaauggagaucaggcccguuaaagaaaaggaggaaaaucuugugaaguccaugguaucugcgggcuccggugagguggacucauuuagucugggcuugcucuguauaagcauuaugaucgaagaggucaugcgcucgcgauggucccggaaaaugcugaugacugggacacuagccguguucuuucugcucaucaugggacagcugaccuggaacgaucuuauucguuugugcaucaugguuggcgcuaaugccucugacagaauggggaugggaacaacuuaccuggcauuaauggcuaccuucaagaugaggccuauguuugccgugggccuccuguuccgccggcuuacgagcagagagguccugcuacucacaauuggucugucauugguggcaaguguugaacugccaaacuccuuagaggaacucggggauggacuggccaugggcauaaugauccuuaaacuguugaccgacuuucaaucucaucagcucugggcuacucugcuaagccugaccuucauuaagacaacuuuuucccuucacuaugcguggaaaaccauggccauggugcucucaaucgucagccuguuccccuugugucugaguacgacaucucagaagaccacuugguuaccgguacuccugggcucccuugggugcaagccucugacaauguuuuugauugcagagaauaaaaucuggggaaggcgaagcuggccacucaacgaagguauaauggcugugggcaucguuucgauucugcuaucaucucugcuuaagaacgaugugccccucgccgggccucugaucgccggaggcauguugauugcuuguuacgucaucagugguuccagcgcagacuuaucucuggagaaagccgcggaggugagcugggaagaggaagcugagcauuccggggccucacacaauauacucguagaagugcaggaugacggaaccaugaagauuaaagaugaggagcgcgacgauacucugacaauccuucugaaggcaaccuugcuagccgucaguggcguuuauccccugagcaucccagcuacacucuucgugugguacuucuggcagaagaagaagcagcggucuggcgugcugugggacacuccuucacccccagaagucgagagagcagugcuugaugacgggauuuauaggauaaugcagcguggauuacugggucgcagccagguuggcguagggguguuucaagaaaacgucuuccauaccauguggcacgugacacggggagccguucucauguaccagggcaaaagauuggagccgaguugggcgagcgugaagaaagaccugaucuccuacggugggggauggaggcuccagggcucuuggaauaccggcgaggaaguccaggugauugcuguagagccugggaagaaccccaaaaauguccaaacagccccaggaacuuuuaagacccccgaaggugaggugggcgcaaucgcccuggauuucaagccugggacgucgggaagcccaauuguuaaccgagaaggcaaaaucgugggucuuuaugggaauggagucgugacaacuucaggcaccuacguuuccgcuauagcccaggcaaaggcuagucaggagggcccccugccugagaucgaagacgagguguuucggaaacgcaacuugacaauuauggaucuacacccggggucuggaaagaccagaagguaucugccagccaucguccgggaagcgauuaaacgaaagcucagaacuuuaauccuggcccccacccgcgugguagcaagcgagauggcugaagcccuuaaggguaugccuauaagguaccaaacaacggcugugaaauccgagcauacuggcaaggagauuguugaccugaugugccacgcaaccuucacaaugcgucucuugucaccaguccgggugcccaauuauaacaugaucaucauggaugaagcccauuuuaccgacccuucuagcauugccgcuagaggguacaucaguacuagggugggaaugggcgaggcggcagccauauucaugacagcuaccccgcccgguuccgucgaagccuuuccacagagcaaugcaguaauucaggaugaggaacgcgacaucccugagcgaucuuggaacucaggguaugaguggauuacggauuuccccggaaaaacugugugguuuguuccauccaucaagaguggcaaugacauagccaacugucugaggaaaaauggcaagcgggugauucagcucagcaggaagacauucgauaccgaauaccagaaaaccaagaacaacgacugggacuacgucgugacuacagauaucucggagaugggggcuaauuuccgcgcggaccguguuaucgauccuagacggugccugaaacccgugauucuuaaggacggaccagaaagggucauccuagccgguccgaugccugugaccguagcaucugcugcccagcgccgaggcagaauugggcggaaccacaauaaagagggagaucaguauauauacaugggccagccccugaacaaugacgaggaucaugcacacuggacagaagccaagauguuguuagacaacaucaauacuccagaggguauuauccccgcucuguuugaaccugagagggaaaaguccgccgcgaucgauggggaguaucgccucagaggcgaggcaaggaaaacguucguggaacugaugcggcguggagaccuuccaguuuggcugagcuacaaggucgccucagagggcuuucaauauagugaucgccgauggugcuucgacggggaaagaaacaaucaggugcucgaggaaaacauggauguggagauuuggaccaaagagggagaaaggaagaaauugcggccccgcuggcuggacgcuagaacauacucugacccucuagcccugagggaguuuaaggaguucgcugcaggucggcgauccgucagcggcgaucucauacuugagaucgggaaacugccgcagcacuuaacucagagagcccaaaaugcuuuggacaaccugguuaugcuccauaauucagaacagggaggccgcgccuauaggcacgcaauggaggagcugccagauaccauugaaacacuuaugcugcucgcguugaucgccgugcugaccggugggguaacuuuauuuuuccuaaguggccggggacugggcaagacgagcauugggcuccuuugugugauggcuuccucuguccuguuguggauggccagcguggagccccauuggaucgcagcuuccauaauccuggaauuuuuccucaugguucugcuuauuccugagcccgaccgucagagaaccccacaggauaaccaacucgccuacguggucaucggacuguuguuuaugauucugacaguagcagccaaugagauggguuuacuagaaacuaccaagaaagaccugggcaucgggcacguggcuguugagaaccaccaucacgcggccaugcucgauguggaccuucauccugcaucagcuuggacacuguacgccgucgccaccacuauaauuacacccaugaugaggcacacgaucgaaaacaccacugcaaauauuucuuugacagcuaucgccaaccaggcggcuauacugaugggacucgauaagggcuggccaaucaguaaaauggacauuggugugccucugcuugccuuagggugcuauucgcaggucaauccgcugacccucaccgcagccguguugaugcugguugcucauuacgcaaucauuggccccggacuacaagccaaggcgacacgcgaggcucagaaacggacugccgcaggcaucaugaagaacccaacgguggaugggauaguagccauugaccuggauccuguggucuaugacgcuaaguucgaaaaacagcucggacagaucaugcuucugaucuuguguaccagccaaauucugcucaugcgaacaacuugggcccugugcgaguccaucaccuuagcaacaggcccccuuaccacucugugggaggguucuccagggaaguuuuggaauacgacaauagcuguuucaauggccaacauuuucagaggaagcuaccucgcgggcgccggucuagcauucucccugaugaaaaguuugggcgggggaaggcgcggcaccggggcucagggagaaacucugggcgagaaguggaaacggcagcucaaucagcuuucuaagagcgaauuuaacaccuauaagagaucagguaucauggagguggaccguuccgaagccaaagaggggcugaagaggggagagacaacuaaacacgcagucagucggggcaccgcuaaguugcgcugguucguggaacgaaaucugguaaaaccugaggguaaggugauugaucucggcugugggagaggaggcuggagcuacuauugcgccggguuaaagaaaguuacagaagugaagggauacacgaaaggcggucccgggcacgaggaaccgaucccaauggccaccuacggauggaaccuggucaaacuucauucuggcaaagacguguuuuucauaccucccgagaagugugauacucugcuaugcgacaucggcgaguccucaccaaaucccacaauugaagaggggaggacccuccggguccugaaaaugguggaaccuugguugcgcggaaaccaauuuuguaucaagauucugaauccguauaugcccagcguuguagagacucucgagcagaugcagagaaagcacgguggcaugcuugugaggaacccacugucgcgaaauucuacacaugaaauguacugggucaguugcgggaccggaaacaucguguccgcgguuaauaugacgagccggauguuacugaaccguuucaccauggcucacagaaaaccuacauaugagcgcgauguggacuugggcgcagguacuaggcacgucgccguggaacccgagguagcuaaccucgauauuaucgggcagcggauagaaaauauuaagcaugagcacaaaucaaccuggcauuacgacgaggauaacccuuauaagacaugggccuaccacggauccuaugaagugaaaccaucuggcagcgcaaguuccaugguuaauggcgucgugaagcugcuaacuaagcccugggacgugaucccuauggucacccaaaucgccaugacagauaccacuccauuugggcagcagagaguuuucaaagagaagguggacacgcgcacacccaaagcuaagaggggaaccgcgcaaauuauggaaguaacugccaaauggcuuugggguuuucugagccgaaacaagaagccgcggauauguaccagagaggaguucacaaggaaagugcgcucuaaugcagcuaucggcgccgucuuuguggacgagaaccaguggaacucagcaaaggaggccguugaagaugagcguuucugggaccucgugcaucgggaaagagagcugcacaaacaggggaagugcgcuacgugcgucuacaacaugaugggaaaaagggaaaagaaguugggcgaguuugguaaagccaaggggagucgcgcgauuugguacauguggcugggagcacgauuccucgaguucgaagcccuuggcuuuaugaaugaggaucacugguucucccgggaaaacagccugucuggcguggagggggagggauuacauaaacuggguuauaucuugagagacauuucgaagaucccuggcgggaauauguacgcugaugacaccgccggaugggauacuaggauaacagaagacgaucuccagaacgaggcacgcaucaccgacauuauggaaccagagcacgcucugcuagccaaaucaaucuuuaaacuuacuuaucaaaauaaaguaguuagagugcagcggcccgcuaagaacggcacagucauggaugugauuagcaggcgugaccagcgagguuccggacaggugggaaccuacggccugaauacauucacuaacauggaagcccaacucauccgccagauggagagugagggcauauuuucuccuagcgaacuggagaccccaaacuuggcaaagagagucuuagauuggcuggaaaaauaugggguugagcggcucaagaggauggcgauuuccggagacgacugugugguaaaacccaucgaugaccgcuucgccacggcucuuaccgcccugaaugauauggguaaggugagaaaagacaucccgcagugggaaccuucaaagggcuggaacgauuggcagcaaguccccuuuugcagucaucacuuccaccagcuaauuaugaaggacgggcgggagauagugguuccauguaggaaucaggaugagcuggugggacgagcacgugucucucagggcgcugguuggagccucagagaaacagccugcuuggggaaauccuacgcacaaauguggcagcugauguauuuucaucgccgggaccuuaggcuggccgcgaacgcuaucuguucagccgugccuguagauuggauucccacuagcagaaccacauggucuauccacgcacaucaccaguggaugacuaccgaggacaugcucuccguuuggaaucgcguguggauugaagagaacccauggauggaagauaagacgcauaucaguagcuggggagacguccccuacuuaggcaaacgggaggaccaauggugcggcucgcugauaggguugacagccagggcuaccugggccacuaauauccagguggcaauuaaccagguucgaagacugaucggaaaugagaacuaccucgauuauaugacauccaugaagcgguucaaaaaugaaucugacccugagggugcucuuugguga

SEQ ID NO: 13619 - RNA, 9879 nt, Artificial Sequence
  derived and/or modified CDS sequence (opt3) from DENV-1__FJ410191__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaagguggaaacuugggcuuugaggcacccuggauuuaccguuauugcacucuuccuggcccaugcuaucggcacaucgauuacccagaagggcaucauauuuauccugcucauguuagugacgccaucaauggccaugcggugcgucgggauuggaagccgcgauuucguggagggucugaguggcgcgacuuggguagacguugugcuugagcacggguccugugucacaaccauggcaaaagauaagcccacuuuggacaucgaacugcuaaaaacagaggugaccaacccugccgugcucagaaagcugugcauugaagcuaaaaucucuaauacgaccacagauagcagguguccaacucaaggagaggccacccuugucgaagagcaggacgcaaacuuuguuugccggcgcacauucguggaucgaggcugggguaauggguguggacuguuuggcaagggcuccuugauaacuugcgcuaaguucaaaugcguaaccaagcucgaggggaaaacagugcagcacgaaaaccugaaguacucagucauugugaccguucauacuggagaccagcaccaaguggguaaugagaguacggaacauggcacaaccgccacuaucaccccccaggcgccuagcacagagauucaguuaaccgacuauggggcccugacucucgauuguucuccaagaacaggacuugacuuuaacgaaaugguccuguugacgaugaaagagaaguccuggcuagugcacaaacagugguuccuggaucucccgcugcccuggaccucaggcgcaagcacuagucaagagacauggaauaggaaggaccuucugguaaccuuuaagacagcucacgccaaaaagcaggaaguuguggucuuggguucucaggagggggcuaugcauacugcccucaccggcgcaacggaaauccaaaccuccggaacaacuaccaucuucgccggccaccugaaaugccgguuaaagauggauaaacugacacuaaaggggacuagcuacgugauguguaccggaucguucaagcucgagaaagaagucgcugagacgcagcaugguacagugcugguucagauuaaguaugagggcaccgacgcgccuugcaaaauaccauuuucuacucaggaugaaaagggggugacacaaaacggacgucuuaucaccgcaaaucccauuguaacugacaaagagaagccugucaacaucgaagccgagccacccuucggcgaguccuacauagugauuggugcuggggaaaaggccuugaaacugucaugguuuaagaaaggcaguagcaucggaaagauguucgaggcaaccgcccgcggcgcuagaaggauggccauccucggggauacagcaugggacuuuggauccauugguggcguuuucacgucuguggggaaacugguccaccagaucuuuggaaccgcguauggcgugcuuuucagcgguguaucauggacuaugaagauugggauaggcgugcuguugacauggcucggacugaauagucgguccaccagcuuaucuaugacauguaucgcuguuggccuggucacucuauaccucggggugauggugcaggccgauucaggaugcgucauuaacuggaagggccgagaacugaaaugugguagugggaucuuuguuaccaaugaggugcauacguggacagaacaguacaaguuccaagcagacagcccgaaacgccuuuccgccgcuaucggaaaggccugggaggagggcgugugcgguauuagaucugcaaccagguuggaaaacauaauguggaaacagaucucgaacgagcugaaucacauucuccuggaaaacgacaugaaguuuacuguagucgugggcgauguugcugggaucuuagcccagggaaaaaagaugauucggccucagcccauggaguauaaguacagcuggaaauccuggggcaaggcgaaaaucauaggggccgacgugcaaaauaccacauucaucauugauggaccaaacacuccugaaugucccgacgaucagcgcgcuuggaauaucugggaggucgaggacuauggcuuugguauuuucaccacaaacaucuggcugaagcuuagagauucauacacgcaggugugcgaccacagguugaugagugcagccauaaaagauucuaaggcuguucaugccgacaugggguauuggauugaaagcgagaagaaugaaaccuggaaacucgcacgugcguccuucaucgaggugaagacuuguauuuggccaaaaucacacacacuguggagcaacggaguacuagaaucugagaugaucauacccaagaucuacggcgguccuaccucccagcauaauuaucggccaggcuacuuuacucaaacagccgggccguggcaccugggaaaacucgagcuggauuucgaccuuugcgaaggcaccacggucgugguggaugagcacugcgggaaccgaggacccaguuugagaacuaccacagucaccggcaagauuauccaugaaugguguugcaggagcuguacucugccuccauuacgcuuuaagggugaggacgggugcugguacggaauggagauucggcccguuaaagaaaaggaggaaaaucucgugaaaucuaugguauccgcuggcucaggugagguggacaguuucagccugggccuucuguguaucucgauaaugauugaagaggucaugagauccagguggucucgcaagauguugaugacagggacccucgccguguuuuuccugcuaaucaugggacagcugacauggaacgaucucauccgacugugcauuaugguuggcgcaaaugcuagcgaccggauggggaugggaacuaccuaucuugccuugauggcaacguuuaaaaugcguccuauguucgccgugggccuguuauuuagaaggcucacaucacgcgagguccugcuucugaccaucggucuaagucucguggcuuccguugaacugccaaacucuuuggaggaacugggggauggauuagcgaugggcauuaugauacucaagcugcuuacugacuuccagagccaccaacugugggccaccuugcucucccugacauuuaucaagacuaccuucucacuacauuacgcauggaaaacgauggcuauggugcugagcauugucagucuuuuuccccucugucugucuacaaccucccagaagacuacaugguugccgguacuguuaggcagccucgggugcaaaccucugaccauguuccuuaucgccgagaauaagauuuggggacggaaaucguggccacugaacgaagguaucauggccgugggcauaguuucaaucuugcucucuagucugcuaaagaacgaugugccccuggcugggccucuuauugcaggaggcaugcucaucgccuguuaugucauuuccgguagcucugcggaccugagcuuggagaaagcugccgagguguccugggaagaggaagcagagcacucaggggccagucauaauaucuuaguagaagugcaggaugacggaacuaugaagauaaaggaugaggagagagacgauacacugaccauucuccugaaagcuacgcuucuggcagucagcggcguuuaccccuugucuaucccagccacucuauucgugugguauuuuuggcagaagaaaaagcaaagguccggcgugcugugggacaccccuucacccccagaagucgagcgagcggugcucgaugacgggaucuaccgcauuaugcagcggggacugcuugguagaagucagguuggcguagggguguuccaggaaaacgucuuucacacaauguggcacgugaccaggggagcuguuuuaauguaucaaggcaaacgucuggagccgagcugggccuccgugaagaaggaccucauaucuuacggugggggauggcgcuugcagggcucguggaauacaggcgaggaaguccaggugaucgcaguagagccugggaaaaaccccaagaauguccagacugccccaggaaccuucaaaacgagcgaaggugaggugggcgcuauugcccuggauuuuaagcccgggacaucaggauccccuaucguuaaccgggaaggcaaaauugugggucucuacgggaauggagucgugacuaccaguggcacauauguuucugcaaucgcucaagccaaggcgagccaggagggcccacugcccgagauagaagacgagguguucagaaagaggaaccuuaccaucauggaucugcauccuggguccggaaaaacucgacgguacuugccggccauuguccgcgaagcaaucaagagaaaacuaaggacccugauucucgcuccaacacgggugguagccucagagauggcugaagcauuaaaggguaugcccauccgauaucagacgacugccgugaaaggcgagcacaccgggaaggagauaguugaccugaugugccaugccacauuuaccaugagacuucugucuccuguccgcgugccaaauuacaacaugauuaucauggaugaagcucacuucacugaccccagcaguaucgcggcaaggggauauauuuccacacgugugggcaugggugaggccgcugccaucuuuaugaccgcaacgccuccggggagcgucgaagccuucccccaaucuaaugcuguaauacaggaugaggaacgggacauuccagagagaucauggaacuccggauacgaguggaucacugauuuuccuggcaagacagugugguucguucccaguauuaaaagcggcaaugacaucgcgaacugucucaggaagaaugggaaacgcgugauacaguugucgcgaaagaccuucgauaccgaauaucagaaaacuaagaacaacgacugggacuacgucgugacaaccgauauuucugagaugggagccaauuuuagagcagaccggguuaucgauccaaggcgcugccugaagccugugauccucaaagacggucccgaacgugucauucuggcuggcccaaugccggugacaguagccuccgcagcccaaagacgggggaggaucggacgcaaccauaauaaggagggcgaucaguacauuuauaugggucagccucuuaacaaugacgaggaucacgcucacuggacugaagccaaaaugcuacuggacaacauaaauacgcccgaggggaucauuccagcguuguucgaacccgagcgagaaaagagcgcagccaucgauggcgaguacagauuacggggagaggcuaggaaaaccuuuguggaacugaugcgcagaggcgaccucccuguuuggcugucauauaaggucgccagugagggguuccaguacucugauaggcgguggugcuuugacggagaacguaacaaucaagugcuugaggaaaacauggauguggagaucuggacaaaagagggugaacgcaagaagcugcgaccaagauggcucgacgcuaggacuuauuccgaccccuuggcacugcgggaguucaaagaauuugccgcuggccgcagaagcgucucaggggaucuaauucuggagauaggaaagcucccucagcaucuuacccagagggcccagaaugcacuggacaacuuaguuauguugcacaauagugaacaaggcggucgggcguaccgacaugccauggaggagcugccggauacaaucgaaacccucaugcugcuugcucugauugccgugcucacugggggcguaacguuguucuuucugagcggaagaggcuuagggaaaaccuccaucggacuacugugugugauggcaucuagcgcucuccuuuggauggccuccgucgagccacacuggauugcagccucaaucauacuggaauucuuuuugauggugcugcucauccccgagccugaccgccagaggacaccccaggauaaccagcuggcuuauguugugauuggucuucucuucaugauccugacugucgcggccaaugagaugggcuugcuggaaaccacaaagcgggacuuagggauuggacacguagcaguggagaaccaucaccaugcugccaugcuagauguugaccugcacccagccucugcauggacccucuacgcuguggccacuacaaucauaacgccuaugaugcgucauaccauugaaaacacuacagcgaauaucagucuuaccgcuauugccaaccaagcagccauccugaugggcuuggauaaagguuggcccauaucgaagauggacaucggggucccacugcucgcucugggcugcuacagccaggugaauccucuuaccuuaacagcagccguccugaugcucguggcgcacuaugcuauuaucggaccgggcuugcaggccaaggcaacuagagaggcccaaaaaaggacggcugccgggauuaugaagaaccccaccguugauggaaucguggcaauagaccuggauccaguaguguacgacgcuaaauuugaaaagcagcuaggccagauuaugcugcucguccuuuguacaucccagauccuguugaugcgcacuaccugggcccugugcgagucuaucacacucgcgaccgguccucugacuacguuaugggaggggucacccggaaaauucuggaauacaaccauugccguuagcauggcaaacaucuuccggggcuccuaucuugcuggugccggccuggcauuuagucucaugaagucucuagggggaggccgaagagggacuggagcucaaggcgaaacccugggugagaaguggaaaaggcaguugaaucagcugagcaagucagaauucaacacauacaaacgcuccgggauaauggagguggaccggagugaagccaaggagggacucaaaagaggcgagacuaccaagcacgccgucagccgugguacagcgaagcuuaggugguuuguggaacggaaucugguaaaaccagagggcaaggugauugauuugggguguggacgcggcggguggucuuauuacugcgcuggacugaaaaagguuacggaagugaaaggcuauaccaagggugggccuggacaugaggaacccaucccgauggcaacuuacggcuggaaccucgucaaauuacacuccggcaaggacguguucuuuauuccaccugagaagugugauacacugcuuugcgacaucggggagucaagccccaauccaaccauagaagagggacgaacucugagaguccuaaaaaugguggaacccuggcucagggguaaccaguucuguaucaagauucugaauccuuacaugccgucgguuguagagacauuggagcaaaugcagcggaaacauggcgggaugcuggugcgcaacccccucucuagaaauaguacccacgaaauguauugggucuccugcggaacgggcaacaucgugagcgccguuaauaugaccucaaggaugcuucugaaccgauuuacaauggcucaccggaagccaacuuacgagcgugauguggacuuaggugccgggaccagacaugucgcaguggaaccugagguagccaaccuggauauuaucggacagcgcauugaaaauaucaaacacgagcauaaguccacauggcacuaugacgaggauaaccccuacaagacuugggcuuaucauggcucuuacgaagugaaaccuagcggcagugcguccagcaugguuaauggggucgugaaguugcucaccaaaccaugggacgugauacccauggucacacagauugccaugaccgauacuacgccuuucggacaacagaggguuuuuaaggagaaaguggacacacggaccccaaaggcaaagagagguacugcucagaucauggaaguaaccgccaaauggcuguggggcuuccuaucucgcaacaagaaacccaggaucuguacacgagaggaauuuacgcggaaggugagaucaaaugcagccauuggggcugucuucguggacgagaaccaauggaauagugccaaagaggcgguugaagaugagagguuuugggaccuugugcaccgcgaacgugagcugcacaagcagggaaagugcgcaaccugcgucuauaacaugaugggcaaacgggaaaagaaacucggugaguucgggaaggccaaaggauccagagcuauaugguacauguggcugggcgccagguucuuggaguuugaagcacugggcuucaugaaugaggaucauugguuuagccgcgaaaacucucucucggggguggagggagagggucuucacaagcugggcuacaucuuacgagacauuucaaaaaucccggggggaaauauguaugcugaugacacugccggcugggauacacggauuaccgaagacgaucugcagaacgaggcuaagaucacugacauaauggaaccugagcaugccuugcucgcaaagagcaucuucaaacugacauaccagaauaagguaguuagagugcaaaggccagcgaaaaacgguaccgucauggaugugauuucccgcagagaccagcgggggaguggacaggugggcacauauggccuaaauacuuuuaccaacaucgaagcccagcuuauuaggcaaauggagucugaggaaaucuucagccccuccgagcuggaaacgccuaaccucgcugggcguguccuggauugguuggagaagcacggaguugaacgauuaaaacgcauggccauaucaggugacgacugugugguaaagccaauugaugacagauuugcaaccgcucugacagcccucaaugauaugggcaaggugcggaaagacaucccccagugggagccgaguaagggguggaacgauuggcagcaggucccuuucugcucucaccauuuucaccaacuuaucaugaaagacggaagggagauugugguucccugucgcaaucaggaugaacuggugggcagagcacgggucagccagggugccggguggucccuaagggagacugcgugccugggaaagucauacgcucagauguggcaacucauguauuuccaucgacgugacuugagacuggccgcaaacgccauauguagcgcugugccaguagauuggguuccuaccucucgcacaacuugguccauccacgcccaucaccaguggaugaccacggaagacaugcuuaguguguggaaucgggucuggauugaggaaaaccccuggauggaggauaaaacacacaucagcucguggggcgacgugccauaccugggcaagagggaggaccaguggugcgggucccucauuggauuaaccgcaagagcuacuugggccacaaauauccaaguugcgauaaaccaggugcgccggcugaucgguaaugaaaacuauuuggauuacaugaccucuaugaagagguuuaaaaaugagucagaccccgaaggcgcucugugguga

SEQ ID NO: 13620 - RNA, 9879 nt, Artificial Sequence
  derived and/or modified CDS sequence (opt3) from DENV-1__FJ432723__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaagaagaugauccgcccucaacccauggagcacaaauacucguggaaaagcuggggcaaggccaaaauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggcauccuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggcuccggugagguggacucauuuagucuuggccuguuguguauuagcaucaugaucgaagaggucaugaggucgcgcuggucccgaaagaugcucaugaccgggacucuggcuguguuccuacugcucauuaugggacagcugacauggaacgaucuuauccgguugugcauuaugguuggcgccaaugcaucugaccguauggggaugggaaccacauaucuggcuuuaauagccacuuuuaaaaugagaccuauguucgcagugggccuccuguuuaggcgccuuaccagccgggagguccugcuacucacgaucggucugucauugguggccaguguugaacugccaaacuccuuagaggaacucggggauggacuggcuaugggcauuaugauccuuaagcuguugacagacuuccaaucucaccagcucugggcgacccugcugagcuuuacuuucauuaaaaccacauuaucccuucauuacgccuggaagacuauggcaauggugcucucaaucgucagccuguuucccuugugucugaguaccacgucucagaagacaaccugguuaccgguacuccugggcucccuugggugcaaaccucugacuauguucuugauagcugagaauaagaucuggggaagaaaaagcuggccacucaacgaagguauuauggccgugggcguugugucgauccugcuaucaucucugcuuaagaacgaugucccccucgccgggccucugauugcuggaggcauguugaucgcauguuaugugauaagugguuccagcgccgacuuaucucuggagaaagcggcugagguaagcugggaagaggaagccgagcacuccggggcaucacauaauauucucguggaaguccaggaugacggaacaaugaagaucaaagaugaggagagggacgauacccugacuauccuucugaaggccacauugcuagcuguuaguggcguguacccccugagcauuccagcaacccucuuugugugguauuucuggcaaaagaaaaagcagcgaucuggcguccugugggacacgccuucacccccagaaguggagcgcgccguucuugaugacgggauauaccggaucaugcagagaggauuacuggguaggagccagguaggcgugggggucuuccaagaaaacguguuucacacuauguggcacguuacccguggagcggugcucauguaucagggcaaacgcuuggagccgaguugggcuagcgucaagaaagaccugauuuccuacggugggggauggcggcuccagggcucuuggaauacaggcgaggaagugcagguaaucgccgucgagccugggaagaaccccaagaaugugcaaaccgcaccaggaacauucaaaacucccgaaggugagguuggcgccauugcucuggauuuuaagccugggaccucgggaagcccaaucgugaacagagaaggcaaaauagucggucuuuacgggaauggagugguuacgacaucaggcacuuauguguccgccaucgcacaggcuaaggccagucaggagggcccccugccugagauugaagacgaggucuucaggaaacgaaacuugaccaucauggaucuacauccggggucuggaaagacacggcgcuaccugccagcgauugugagagaagccaucaagaggaaacuccggaccuuaauacuggcacccacucgaguaguggcuagcgagauggccgaagcucuuaaggguaugccuauuagauaucaaaccacagcaguuaaauccgagcacacgggcaaggagaucgucgaccugaugugccaugccacuuuuaccaugcgccucuugucaccagugagggugcccaauuacaacaugaucauuauggaugaagcccacuucacagacccuucuagcaucgcugcgcguggguauauaaguacccgggucggaaugggcgaggcagccgcuauuuuuaugacugccacaccgcccgguuccguagaagcauucccacagagcaaugccgugauccaggaugaggaaagagacauuccugagaggucuuggaacucaggguacgaguggaucaccgauuuucccggaaaaacgguuugguucgugccauccauaaagaguggcaaugacauugcuaacugucugcgcaagaauggcaaacgagucauccagcucagcagaaagacuuuugauacagaauaucagaaaaccaagaacaacgacugggacuacgugguuaccacugauaucucggagaugggggcgaauuuccgggccgacagggugauugauccucgccguugccugaaacccgucauccuuaaggacggaccagaaagagugauucuagcagguccgaugccuguaacaguggcuucugccgcacagcggaggggccgcauagggcgaaaccauaauaaggagggagaucaguacaucuauaugggccagccccugaacaaugacgaggaucacgcccacuggaccgaagcuaaaauguuguuagacaacauuaauacaccagaggguaucauccccgcccuguucgaaccugagagagaaaaguccgcggcaauugauggggaguaccggcucaggggcgaggcccgcaaaacuuuuguugaacugaugagaaggggagaccuuccagucuggcugagcuauaagguggcuucagagggcuuccaauacagugaucggcguuggugcuuugacggggaacgcaacaaucaggugcucgaggaaaacauggaugucgagauauggacgaaagagggagaacgaaagaaauugagacccagguggcuggacgcccggaccuauucugacccucuagcucugcgcgaguucaaggaauuugcagccgguagaagguccguuagcggcgaucucauccuugagauugggaagcugccgcagcauuuaacacagcgggcucaaaaugccuuggacaaccuggugaugcuccacaauucagaacagggaggccgagcauacagacaugcgauggaggagcugccagauacuaucgaaacccuuaugcugcucgccuugauugcuguacugacagguggggugaccuuauucuuucuaaguggccgcggacugggcaaaacuagcaucgggcuccuuugugucauggccuccucugugcuguuguggauggcaagcguugagccccacuggauagcugccuccaucauucuggaguucuuucucauggugcugcuuaucccugagcccgacaggcagcggacgccacaggauaaccaacucgcauaugucguaauuggacuguuguucaugauccugaccguggccgcuaaugagauggguuuacuagaaacaacuaagaaagaccugggcauagggcacguugcgguggagaaccaucaccaugccaccaugcucgaugucgaccuucacccugcaucagcuuggacacuguacgccguggccaccacuauuaucacacccaugaugcgucauacgauugaaaacaccacugcaaauaucucuuugacagcuauagccaaccaggcggcuauccugaugggacucgauaagggcuggccaauuaguaaaauggacaucggugucccucugcuugccuuagggugcuacagccaggugaauccgcugacccucaccgcagccguuuugaugcugguggcucacuaugcaauuaucggccccggacuacaagccaaggcgacaagagaggcucagaagaggacugccgcaggcauaaugaaaaacccaacgguagaugggauuguggccaucgaccuggauccugucguuuacgacgcuaaguuugaaaaacagcucggacagaucaugcuucugauuuuguguaccagccaaauccugcucaugcgcacaacuugggcccugugcgaguccauaaccuuagcaacaggcccccuuaccacucugugggaggguucuccagggaaguucuggaauacgacaauugcugugucaauggccaacaucuuucggggaagcuaucucgcgggcgccggucuagcauucucccugaugaaaaguuugggcgggggacgaagaggcaccggggcucagggagaaacucugggcgagaaguggaagaggcagcucaaucagcuuucuaaaagcgaguucaacaccuacaagcgcucagguauuauggaggucgaccgguccgaagccaaagaggggcugaagagaggagagacaacucgucacgcagugaguaggggcaccgcuaaauugcggugguuuguagaacgcaaucuggugaagccugaggguaagguuaucgaucucggcugugggcgaggaggcuggagcuauuacugcgccgggcuaaagaaggugacagaagucaaaggauauacgaagggcggucccgggcaugaggaaccgauaccaauggccaccuacggauggaaccuggugaaacuucacucuggcaaggacgucuucuuuacuccucccgagaaaugugauacacugcuaugcgacaucggcgaguccucaccaaaucccaccauugaagaggggagaacucucagggugcugaagaugguugaaccuugguugcggggaaaccaauucuguaucaagauucugaauccguacaugcccagcguaguggagacacucgagcagaugcagcgcaaacaugguggcaugcuugucagaaacccacugucgagaaauucuacccacgaaauguauugggugaguugcgggacgggaaacaucguuuccgcggugaauaugaccagccgaauguuacugaaccgguuuacaauggcucaccguaagccuacuuacgagagagaugucgacuugggcgcagguacccgccauguggccguagaacccgagguggcuaaccucgauauuaucgggcagaggauagaaaauauuaaacacgagcauaagucaacauggcacuaugacgaggauaacccuuacaaaacuugggccuaucauggauccuacgaaguuaagccaucuggcagcgcaaguuccauggucaauggcguggugaagcugcuaaccaaacccugggacgucaucccuaugguuacacaaaucgccaugaccgauacuacgccauucgggcagcagcggguguuuaaggagaaaguagacacaagaacccccaaggcuaaacgcggaacugcgcaaauuauggaagugaccgccaaguggcuuugggguuuccugagcaggaacaagaaaccgcgaauauguacacgggaggaauuuacgagaaaggucaggucuaaugcagcuaucggcgccguguucguugacgagaaccaguggaacucagcaaaagaggccguggaagaugagcgcuuuugggaccucguccagaaggaacgugagcugcacaaacaggggaagugcgcuaccugcguguauaacaugaugggaaagcgggagaaaaaguugggcgaguucgguaaagccaaggggaguagagcgauuugguacauguggcugggagcaagguuucucgaguucgaagcccuuggcuucaugaaugaggaucacugguuuucccgcgaaaacagccugucuggcguagagggggagggauuacauaaacuggguuacaucuugcgagacauuucgaagaucccuggcgggaauauguaugcugaugacacugccggaugggauacacggauaaccgaagacgaucuccaaaacgaggcaaaaaucacugacauuauggaaccagagcacgcucugcuagccacaucaaucuucaaacuuaccuaccagaauaagguugugagaguccagaggcccgcuaaaaacggcacagugauggaugugauuagccgcagagaccagcgggguuccgggcaagucggaacuuauggccugaauaccuuuacgaacauggaagcccagcucaucaggcagauggagagugagggcauauuccugccuggggaauuggagaccccaaacuuagcagaacguguucuggauuggcucgagaaguacggaguggaacgacuuaaacgcauggcgauuucuggugacgacuguguagugaagcccaucgaugacagauuugccacagcucugacugcccuaaaugauaugggcaaaguccggaaggacaucccgcagugggagccuagcaagggguggaacgauuggcaacaggugcccuucugcucccaucacuuucaccagcugauuaugaaagacggaagggagauaguugugccaugucgcaaucaggaugaacucgucggcagagcacgggugucacaaggugcuggguggaguuugagggagaccgccugccugggaaagucuuaugcacagauguggcagcuuauguacuuccaucgacgugaccugagacucgccgcgaacgcuaucuguagcgccguaccuguugauugggugcccacaucccgcacuaccuggucaauucacgcacaucaccaauggaugacgacagaagacauguuaagcgucuggaaucggguguggaucgaggaaaacccauggauggaggauaaaacccauguuucuuccuggggcgacgugcccuaucugggcaagagggaggaccaguggugcgggaguuugauuggacugacugccagagcuacaugggccagcaauauccaggucgcaauaaaccaggugcgccggcucaucgguaaugaaaacuaccuugauuacaugaccucgaugaaaagguuuaagaaugagggcgacccugaaggggcucugugguga

SEQ ID NO: 13621 - RNA, 9879 nt, Artificial Sequence
  derived and/or modified CDS sequence (opt3) from DENV-1__FJ410192__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaacuugccgagacgcagcacggaacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggaguacaaauauucguggaaaagcuggggcaaggccaagauaaucggggcggacguucagaauaccacauuuauuaucgauggaccaaacacuccugaaugucccgacgaucagagagccuggaauauuugggagguggaggacuacggcuucgguaucuuuaccacaaacauaugguugaagcucagggauuccuauacgcaggucugcgaccaccgucugaugucagcugcaauuaaagauaguaaggccgugcacgcugacaugggguacuggaucgaaucugagaaaaaugaaaccuggaagcuagcccgggcauccuucauugagguuaagacuuguaucuggccaaaaucccauacacuguggucaaacggagugcucgaaagcgagaugauaauccccaagauuuauggcgguccuaucucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauuaugggacagcugaccuggaacgaucuuauccguuugugcauuauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaauaggucugucauuggucgccaguguggaacugccaaacuccuuagaggaacucggggauggacuggcuaugggcaucaugauucuuaaacuguugaccgacuuucaaucucaucagcucugggcgacucugcuaagccugaccuucaucaagacaacuuuuucccuucacuaugccuggaaaaccauggcaaugauucucucaaucguuagccuguuccccuugugucugaguacgacaucucagaagaccacuugguuaccggugcuccugggcucccuugggugcaagccucugacaauguuuuugauagcugagaauaaaaucuggggaaggcgaagcuggccacucaacgaagguauuauggccgucggcaucguaucgauucugcuaucaucucugcuuaagaacgaugugccccucgccgggccucugaucgcuggaggcauguugauagcauguuacguuauuagugguuccagcgccgacuuaucucuggagaaagcggcugaggugagcugggaagaggaagccgagcauuccggggcaucacacaauauccucgucgaagugcaggaugacggaaccaugaagaucaaagaugaggagcgcgacgauacucugacaauucuucugaaggccaccuugcuagcuguaaguggcguguauccccugagcauaccagcaacacucuucgucugguacuucuggcagaagaagaagcagcggucuggcguucugugggacacuccuucacccccagaaguggagagagccgugcuugaugacgggaucuauaggauuaugcagcguggauuacugggucgcagccaggucggcguggggguuuuucaagaaaacguauuccauaccauguggcacgugacacggggagcgguccucauguaccagggcaaaagauuggagccgaguugggcuagcgugaagaaagaccugaucuccuacggugggggauggaggcuccagggcucuuggaauaccggcgaggaaguucaggugauugccgucgagccugggaagaaccccaaaaaugugcaaacagcaccaggaacuuuuaagacccccgaaggugagguaggcgccaucgcucuggauuucaagccugggacgucgggaagcccaauagucaaccgagaaggcaaaaucgugggucuuuaugggaauggaguugugacaacuucaggcaccuacgucuccgccauugcacaggcuaaggccagucaggagggcccccugccugagaucgaagacgagguguuucggaaacgcaacuugacaauuauggaucuacacccggggucuggaaagaccagaagguaucugccagcgaucguucgggaagccauaaaacgaaagcucagaacuuuaauucuggcacccacccgcguggucgcuagcgagauggccgaagcucuuaaggguaugccuaucagguaccaaacaacggcagugaaauccgagcauacuggcaaggagaucguagaccugaugugccacgccaccuucacaaugcgucucuugucaccagugcggguucccaauuauaacaugauuaucauggaugaagcccauuuuaccgacccuucuagcauagcugcgagaggguacauuaguacuagggucggaaugggcgaggcagccgcuaucuucaugacagccaccccgcccgguuccguggaagcauuuccacagagcaaugccgugauucaggaugaggaacgcgacaucccugagcgaucuuggaacucaggguaugaguggauaacggauuuccccggaaaaacugucugguuuguaccauccauuaagaguggcaaugacaucgcuaacugucugaggaaaaauggcaagcgggugauccagcucagcaggaagacauucgauaccgaauaccagaaaaccaagaacaacgacugggacuacguugugacuacagauauuucggagaugggggcgaauuuccgcgccgaccgugucaucgauccuagacggugccugaaacccgugauucuuaaggacggaccagaaaggguuauacuagcagguccgaugccugugaccgucgcuucugccgcacagcgccgaggcagaaucgggcggaaccacaauaaagagggagaucaguauauuuacaugggccagccccugaacaaugacgaggaucaugcccacuggacagaagcuaagauguuguuagacaacaucaauacuccagaggguaucauucccgcccuguuugaaccugagagggaaaaguccgcggcaauagauggggaguaucgccucagaggcgaggccaggaaaacguucguggaacugaugcggcguggagaccuuccaguauggcugagcuacaagguggcuucagagggcuuucaauauagugaucgccgauggugcuucgacggggaaagaaacaaucagguucucgaggaaaacauggaugucgagaucuggaccaaagagggagaaaggaagaaauugcggccccgcuggcuggacgccagaacauacucugacccucuagcucugagggaguuuaaggaguucgcagccggucggcgauccgugagcggcgaucucauucuugagaucgggaaacugccgcagcacuuaacucagagagcucaaaaugccuuggacaaccuggugaugcuccauaauucagaacagggaggccgcgcauauaggcacgcgauggaggagcugccagauaccauugaaacacuuaugcugcucgccuugaucgcuguccugaccggugggguuacuuuauuuuuccuaaguggccggggacugggcaagacgagcauagggcuccuuugugugauggccuccucuguacuguuguggauggcaagcguggagccccauuggaucgcugccuccauuauccuggaauuuuuccucaugguccugcuuauuccugagcccgaccgucagagaaccccacaggauaaccaacucgcauacgugguuaucggacuguuguuuaugauacugacaguggccgcuaaugagauggguuuacuagaaacuaccaagaaagaccugggcauugggcacgucgcgguagagaaccaccaucacgccgcaaugcucgauguggaccuucauccugcuucagccuggacacuguacgccguugcaaccacuaucauuacacccaugaugaggcacacgaucgaaaacaccacugcuaauauaucuuugacagccaucgcgaaccaggcugccauucugaugggacucgauaagggcuggccaaucaguaaaauggacauuggugugccucugcuugcauuagggugcuauucgcaggucaauccgcugacccucaccgccgcuguguugaugcuggucgcacauuacgccaucauaggccccggacuacaagcgaaggcuacacgcgaggcccagaaacggacugcagccggcauuaugaagaacccaacgguggaugggaucguugcuaucgaccuggauccugugguauaugacgccaaguucgaaaaacagcucggacagauuaugcuucugaucuuguguaccagccaaauacugcucaugcgaacaacuugggcacugugcgaguccauuaccuuagcuacaggcccccuuaccacucugugggaggguucuccagggaaguuuuggaauacgacaaucgccgugucaauggcgaacauuuucagaggaagcuaccucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuauaagagaucagguaucauggaggucgaccguuccgaagcaaaagaggggcugaagaggggagagacaacuaaacacgcuguuagucggggcaccgccaaguugcgcugguucguggaacgaaaucuggucaaaccugaggguaaggugauagaucucggcugugggagaggaggcuggagcuacuauugcgccggguuaaagaaaguaacagaagugaagggauacacgaaaggcggucccgggcacgaggaaccgaucccaauggcgaccuacggauggaaccugguuaaacuucauucuggcaaagacguguuuuucauuccucccgagaagugugauacucugcuaugcgacaucggcgaguccucaccaaaucccacaauugaagaggggaggacccuccggguccugaaaaugguggaaccuugguugcgcggaaaccaauuuuguaucaagauucugaauccguauaugcccagcgucguggagacucucgagcagaugcagagaaagcacgguggcaugcuuguuaggaacccacugucgcgaaauucuacacaugaaauguacuggguaaguugcgggaccggaaacaucguguccgcugucaauaugacgagccggauguuacugaaccguuucaccauggcacacagaaaaccuacauaugagcgcgauguggacuugggcgccgguacuaggcacguugcuguggaacccgaggucgccaaccucgauauaauugggcagcggaucgaaaauaucaagcaugagcacaaaucaaccuggcauuacgacgaggauaacccuuauaagacaugggcauaccacggauccuaugaagugaaaccaucuggcagcgccaguuccaugguaaauggcgugguuaagcugcuaacuaagcccugggacgucauuccuauggugacccaaauagcuaugacagauaccacuccauuugggcagcagagaguguucaaagagaaggucgacacgcgcacacccaaagcgaagaggggaaccgcccaaaucauggaaguuacugcaaaauggcuuugggguuuucugagccgaaacaagaagccgcggauuuguaccagagaggaguucacaaggaaagugcgcucuaaugcugccaucggcgcaguauuuguggacgagaaccaguggaacucagccaaggaggcugucgaagaugagcguuucugggaccucgugcaucgggaaagagagcugcacaaacaggggaagugcgccacgugcguuuacaacaugaugggaaaaagggaaaagaaguugggcgaguuugguaaagcgaaggggagucgcgcaauuugguacauguggcugggagcccgauuccucgaguucgaagcucuuggcuuuaugaaugaggaucacugguucucccgggaaaacagccugucuggcguggagggggagggauuacauaaacuggguuauaucuugagagacauaucgaagaucccuggcgggaauauguacgccgaugacaccgcaggaugggauacuaggauuacagaagacgaucuccagaacgaggcucgcaucaccgacauuauggaaccagagcacgcccugcuagcuaaaucaaucuuuaaacuuacuuaucaaaauaaagucgugagaguacagagccccgccaagaacggcacaguuauggaugugauaucccggagggaccagcgugguagugggcaggucggaaccuacggccugaauacauucacuaacauggaagcacaacucauucgacagauggagucugagggcaucuuuagcccuuccgaacuggagaccccaaacuuggcggaacgcguguuagauuggcuggagaaguaugggguggaaagacucaaacggauggccaucucaggagacgacugugucguuaagcccauugaugacagguucgcuacggcccuuaccgcacugaaugauauggguaaagugcgcaaggacauaccgcagugggagccuaguaaaggcuggaacgauuggcagcaaguacccuuuugcucucaucacuuccaccagcuaaucaugaaggacgggagagagauuguggucccaugucggaaucaggaugaacuggugggaagggcucgaguuagccagggcgccgguuggucccuccgugagacagcaugcuuggggaagucauacgcccaaauguggcagcugauguauuuucauagacgcgaccuucggcuggcggcuaacgccaucuguagcgcagugccugucgauuggauucccacuucuaggaccacaugguccauccacgcccaucaccaguggaugacuaccgaagacaugcucaguguguggaauagaguauggauagaggaaaacccauggauggaggauaaaacgcauaucagcucguggggagacguucccuacuuaggcaagcgcgaggaccaauggugcggcucccugauuggguugacagcucgggccaccugggcaacuaauauccagguggcuauuaaccaggucaggcgacugaucggaaaugaaaacuaccucgauuauaugacaucuaugaaaagauucaagaaugagucagacccugaaggugcccuuugguga

SEQ ID NO: 13622 - RNA, 9879 nt, Artificial Sequence
  derived and/or modified CDS sequence (opt3) from DENV-1__FJ410194__SS-prME
agcgugaccaugcugcucaugcuuaugcccaccgcccuggcuuuccacuugacuacgcggggaggggaaccucauaugaucgucuccaagcaggaaagggggaaaucuuuacuguuuaagaccucagccgguguuaauaugugcacgcuaauugccauggaccucggcgaacugugugaagauacuaugaccuacaaaugcccacggaucacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguauuagcaucaugaucgaagaggucaugcgcucgcgauggucccggcguaugcucaugaccgggacucuggccguguucuuucuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaaaaccacauuuucccugcacuaugcauggaagacuauggcuauggugcuuucaauugucagccucuucccccuguguuugaguaccacgucucagaaaacaaccuggcugccgguauuacucggcucccuggggugcaagccucuuacuauguuucugaucgccgagaauaagauauggggacgacgcagcuggccauugaacgaagguaucauggccgugggcauuguuucgauccuccugucaucucuacugaaaaacgaugugccccuugcugggccucucauugcaggaggcaugcugaucgccuguuacgucauaagugguuccagcgcggacuugucuuuagagaaggcugccgaggugagcugggaagaggaagcagagcauuccggggccucacacaauauucugguagaagugcaggaugacggaacaaugaaaaucaaggaugaggagcgggacgauacccucacuauccugcuuaaagcuacacuguuggcagucaguggcguuuauccccuaagcauuccagccacccuguucgugugguacuucuggcaaaagaaaaagcagagaucuggcgugcucugggacacgccuucacccccagaagucgagagggcggugcuggaugacgggauauaucguaucaugcagcgcggacuuuuaggucggagccagguuggcguagggguguuucaagaaaacgucuuccauacuauguggcacgugaccagaggagcuguucugauguaccagggcaagaggcucgagccgaguugggccagcgugaaaaaggacuugauuuccuacggugggggauggcgacugcagggcucuuggaauacaggcgaggaaguccaggugaucgcaguagagccugggaaaaaccccaagaauguccaaaccgccccaggaacauuuaaaacucccgaaggugaggugggcgcuauugcccucgauuucaagccugggaccucgggaagcccaaucguuaaccgggaaggcaagauagugggucuguaugggaauggagucgugacgacaucaggcacuuacguuuccgcaaucgcucaggccaaagcgagucaggagggcccccuuccugagauugaagacgagguguuucgcaagagaaaccugaccaucauggauuugcacccggggucuggaaaaacaaggcgguaucuaccagccauuguccgagaagcaaucaagagaaaacugcgcacccucauauuagcucccacuagggugguagccagcgagauggcugaagcacugaaggguaugccuauucguuaccaaaccacagccgugaaguccgagcauacgggcaaagagaucguugaccuuaugugccacgccacuuucaccaugcggcugcucucaccagucagagugcccaauuauaacaugaucauuauggaugaagcucauuuuacagacccuucuagcaucgcggcaaggggguacauaaguacccgcgugggaaugggcgaggccgcugccauuuucaugacugcaacaccgcccgguuccgucgaagccuuuccacagagcaaugcuguaauccaggaugaggaacgagacauuccugagagaucuuggaacucaggguaugaguggaucaccgauuuccccggaaagacggugugguuuguuccauccauaaaaaguggcaaugacauugcgaacuguuugcggaagaauggcaaaagggugauccagcugagccgcaagacuuucgauacagaauaccaaaagaccaaaaacaacgacugggacuacgucgugaccacugauaucucggagaugggggccaauuuccgugcagacagaguuauugauccucggaggugccucaagcccgugauccugaaagacggaccagaacgcgucauucuugcugguccgaugccugugacaguagccucugcagcccagcgaagaggccggauagggaggaaccacaauaaggagggagaucaguauaucuacaugggccagccccuaaacaaugacgaggaucaugcucacuggaccgaagccaaaaugcuguuggacaacauuaauacaccagaggguaucauccccgcguuauuugaaccugagcgcgaaaaguccgcagccauugauggggaguauagacugaggggcgaggcucggaagacuuucguggaacucaugcgucgcggagaccugccaguuuggcuuagcuacaaagucgccucagagggcuuucaauauagugaucgaagauggugcuucgacggggaaaggaacaaucaggugcuggaggaaaacauggauguggagauauggacgaaggagggagaacggaaaaagcuccgccccagaugguuggacgcuaggaccuacucugacccucuggcacuacgggaguuuaaagaguucgccgcuggucgaagauccgucagcggcgaucugauccucgagauugggaaacuuccgcagcaccugacacagcgcgcccaaaaugcauuagacaacuugguuaugcugcauaauucagaacagggaggcagggcguaucggcacgccauggaggagcucccagauacuaucgaaacccugaugcuucuggcucucauugccguguugacaggugggguaacccuguuuuucuuaaguggccguggacuaggcaaaacuagcaucgggcugcucugugugauggcauccucuguccuucuguggauggcuagcguggagccccauuggauagccgcauccaucauuuuggaauuuuuccugaugguucuccugaucccugagcccgacagacagaggacgccacaggauaaccaacuugccuacguggucauuggacuccuguuuaugaucuugaccguagcugcgaaugagaugggucuguuagaaacaacuaagaaggaccuaggcauagggcacguggccguugagaaccaccaucacgcagcuaugcuggauguggaccuccauccugccucagccuggacccuuuacgcagucgcuacaaccauuaucacucccaugaugcgccacacaauugaaaacacgaccgccaauaucucucugacugcgauagcuaaccaggccgcaaucuugaugggacuggauaaaggcuggccaauuaguaagauggacaucggugugccucuccuggcccuugggugcuauucgcaggucaauccguuaacacugaccgcugcagugcucauguugguugcccauuacgcgauuaucggccccggacugcaagcuaaagccacccgggaggcacagaagcgaacagccgcuggcauaaugaaaaacccaacuguggaugggauuguagccaucgaccuagauccuguggucuaugacgcaaaguucgaaaagcagcugggacagaucaugcuccuuauucuguguacgagccaaaucuugcugaugagaaccacaugggcucucugcgaguccauaacucuggccaccggccccuuaacaacccuuugggaggguucuccagggaaauuuuggaauacuacgauugcgguuucaauggccaacaucuucaggggaagcuaccuggcaggcgcuggucucgccuucucccuaaugaagagucugggcgggggacgccggggcacaggggcacagggagaaaccuugggcgagaaauggaagagacagcugaaucagcucucuaaaagcgaauuuaacacuuauaagcguucagguauuauggagguggacagguccgaagcuaaggaggggcuuaaacggggagagaccacaaagcacgccgucagucgcggcacugccaaacugcgaugguucguggaaagaaauuugguaaagccugaggguaaagugaucgaucugggcugugggaggggaggcuggagcuacuauugcgcggggcucaagaagguuaccgaagugaaaggauacacaaagggcggucccgggcacgaggaaccgauaccaauggcuacguacggauggaacuuagucaaacugccuucuggcaaggacguguuuuucauacccccagagaaaugugauacccuucugugcgacauuggcgaguccucacccaauccuacuaucgaagaggggcggacacuacgcguccucaagaugguggaaccguggcugagaggaaaccaauuuuguauuaaaaucuugaaucccuauaugccaagcguuguagagacccuggagcagaugcagaggaagcaugguggcaugcucgugcgaaacccucuuucgagaaauucuacucacgaaauguacugggucaguugcgggacaggaaacauuguguccgcaguuaauaugaccagccguaugcuguuaaacagauucacgauggcccaucgcaagcccaccuaugagagggauguggaccugggcgcugguacacggcacgucgccguggaaccugagguagcaaacuuggauaucauagggcagagaauugaaaauaucaaacacgagcauaagucaacuuggcacuacgacgaggauaacccauauaaaaccugggccuaccauggauccuaugaagugaagcccucuggcagcgcuaguuccaugguuaauggcgucgugaaacuccugacaaagccuugggacgugaucccaauggucacucaaauugcgaugaccgauacaacccccuuugggcagcagcgcguuuucaaggagaaaguggacacuaggacgccgaaggccaaacgaggaacagcacaaauaauggaaguaaccgcuaaguggcuaugggguuuucuuagccggaacaaaaagccuagaaucuguacuagggaggaguucacccgcaaggugcguucuaaugccgcaauuggcgccgucuuuguggacgagaaccaguggaacucagcuaaagaggccguugaagaugagcgguucugggaccuggugcacagagaaagggagcuccauaagcaggggaaaugcgcgacaugcgucuacaacaugaugggaaagcgcgagaagaagcugggcgaguuugguaaggcaaaagggagucgagccaucugguacaugugguugggagcucgguuccuggaguucgaagcccucggcuuuaugaaugaggaucacugguucuccagagaaaacagccuuucuggcguggagggggagggacugcacaaguuagguuauauucugagggacaucucgaaaauaccaggcgggaauauguacgcagaugacacggcuggaugggauacccgcaucacugaagacgauuugcagaacgagcccagaauuacagacaucauggaaccugagcaugcccuccuggcuaagucaauuuuuaaacuaaccuaucaaaauaagguaguucgggugcagagcccagccaaaaacggcacugucauggaugugaucuccaggcgugaccagcgagguaguggacaggugggaacauacggccuuaauaccuucacaaacauggaagcacaacugauacgccagauggagucugagggcauuuuuagccccuccgaacucgagacuccgaaccuggcggaaagagucuuggauugguuagagaaguaugggguugaacggcugaagaggauggccaucucaggagacgacugugugguaaaaccuaucgaugaccgcuucgcuaccgcccucacggcacuuaaugauauggguaaggugagaaaagacauuccccagugggagccaaguaagggcuggaacgauuggcagcaagucccuuuuuggucucaccauuuccaccagcugauaaugaaagacgggcgggagaucgugguucccugcaggaaucaggaugagcuagugggacgagcucgugucagccagggcgccgguuggucccugagagagaccgcaugucucgccaagucauacgcgcaaauguggcaguugauguauuuucaccgccgggaccugaggcuugcugccaacgcaauuugcagcgccgugccaguagauuggauccccacaucuagaacuaccugguccauucaugcucaccaucaguggaugacaacugaagacaugcugaguguuuggaaucgcguguggaucgaggaaaacccuuggauggaggauaagacccacauaagcucguggggagacgucccauaccucggaaaacgggaggaccaaugguguggcuccuuaaucggccugacggccagggcaacaugggcuaccaauauucagguggccaucaaccagguucgaagauugauugggaaugaaaacuaccuggauuauaugacuucuaugaagcgguucaaaaaugagucagacccggaaggagcgcucugguga

SEQ ID NO: 13623 - RNA, 9879 nt, Artificial Sequence
  derived and/or modified CDS sequence (opt3) from DENV-1__FJ432725__SS-prME
agcgugaccaugcugcucaugcuuaugcccaccgcccuggcuuuccacuugacuacgcggggaggggaaccucauaugaucgucuccaagcaggaaaggggaaaaucuuuacuguuuaagaccucagccgguguuaauaugugcacgcuaauugccauggaccucggcgaacugugugaagauacuaugaccuacaaaugcccacggaucacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguauuagcaucaugaucgaagaggucaugcgcucgcgauggucccggcguaugcucaugaccgggacucuggccguguucuuucuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaaaaccacauuuucccugcacuaugcauggaagacuauggcuauggugcuuucaauugucagccucuucccccuguguuugaguaccacgucucagaaaacaaccuggcugccgguauuacucggcucccuggggugcaagccucuuacuauguuucugaucgccgagaauaagauauggggacgacgcagcuggccauugaacgaagguaucauggccgugggcauuguuucgauccuccugucaucucuacugaaaaacgaugugccccuugcugggccucucauugcaggaggcaugcugaucgccuguuacgucauaagugguuccagcgcggacuugucuuuagagaaggcugccgaggugagcugggaagaggaagcagagcauuccggggccucacacaauauucugguagaagugcaggaugacggaacaaugaaaaucaaggaugaggagcgggacgauacccucacuauccugcuuaaagcuacacuguuggcagucaguggcguuuauccccuaagcauuccagccacccuguucgugugguacuucuggcaaaagaaaaagcagagaucuggcgugcucugggacacgccuucacccccagaagucgagagggcggugcuggaugacgggauauaucguaucaugcagcgcggacuuuuaggucggagccagguuggcguagggguguuucaagaaaacgucuuccauacuauguggcacgugaccagaggagcuguucugauguaccagggcaagaggcucgagccgaguugggccagcgugaaaaaggacuugauuuccuacggugggggauggcgacugcagggcucuuggaauacaggcgaggaaguccaggugaucgcaguagagccugggaaaaaccccaagaauguccaaaccgccccaggaacauuuaaaacucccgaaggugaggugggcgcuauugcccucgauuucaagccugggaccucgggaagcccaaucguuaaccgggaaggcaagauagugggucuguaugggaauggagucgugacgacaucaggcacuuacguuuccgcaaucgcucaggccaaagcgagucaggagggcccccuuccugagauugaagacgagguguuucgcaagagaaaccugaccaucauggauuugcacccggggucuggaaaaacaaggcgguaucuaccagccauuguccgagaagcaaucaagagaaaacugcgcacccucauauuagcucccacuagggugguagccagcgagauggcugaagcacugaaggguaugccuauucguuaccaaaccacagccgugaaguccgagcauacgggcaaagagaucguugaccuuaugugccacgccacuuucaccaugcggcugcucucaccagucagagugcccaauuauaacaugaucauuauggaugaagcucauuuuacagacccuucuagcaucgcggcaaggggguacauaaguacccgcgugggaaugggcgaggccgcugccauuuucaugacugcaacaccgcccgguuccgucgaagccuuuccacagagcaaugcuguaauccaggaugaggaacgagacauuccugagagaucuuggaacucaggguaugaguggaucaccgauuuccccggaaagacggugugguuuguuccauccauaaaaaguggcaaugacauugcgaacuguuugcggaagaauggcaaaagggugauccagcugagccgcaagacuuucgauacagaauaccaaaagaccaaaaacaacgacugggacuacgucgugaccacugauaucucggagaugggggccaauuuccgugcagacagaguuauugauccucggaggugccucaagcccgugauccugaaagacggaccagaacgcgucauucuugcugguccgaugccugugacaguagccucugcagcccagcgaagaggccggauagggaggaaccacaauaaggagggagaucaguauaucuacaugggccagccccuaaacaaugacgaggaucaugcucacuggaccgaagccaaaaugcuguuggacaacauuaauacaccagaggguaucauccccgcguuauuugaaccugagcgcgaaaaguccgcagccauugauggggaguauagacugaggggcgaggcucggaagacuuucguggaacucaugcgucgcggagaccugccaguuuggcuuagcuacaaagucgccucagagggcuuucaauauagugaucgaagauggugcuucgacggggaaaggaacaaucaggugcuggaggaaaacauggauguggagauauggacgaaggagggagaacggaaaaagcuccgccccagaugguuggacgcuaggaccuacucugacccucuggcacuacgggaguuuaaagaguucgccgcuggucgaagauccgucagcggcgaucugauccucgagauugggaaacuuccgcagcaccugacacagcgcgcccaaaaugcauuagacaacuugguuaugcugcauaauucagaacagggaggcagggcguaucggcacgccauggaggagcucccagauacuaucgaaacccugaugcuucuggcucucauugccggugugacagggggcguaaccuugguguuucugaguggacguggcuuagggaaaacuagcaucggacuacugugugucauggcauccucugugcuccuuuggauggcuagcguugagccccauuggauagccgcauccaucauucuggaguucuuuuugauggugcugcucaucccugagcccgacagacagaggacgccacaggauaaccaacuggccuacgucguaauuggucuucucuucaugauccugaccguggcugcgaaugagaugggcuugcuggaaacaacuaagaaggacuuagggauaggacacguugccguggagaaccaccaucacgcagcuaugcuagaugucgaccugcauccugccucagccuggacccucuacgcaguggcuacaaccauuaucacucccaugaugcgccacacaauugaaaacacgaccgccaauaucucucuuacugcgauagcuaaccaggccgcaauccugaugggcuuggccaaagguuggccaauuaguaagauggauaucggggucccucugcucgcucugggcugcuauagccaggugaauccgcuuacauuaaccgcacccguucugaugcucguggcccauuacgcgauuaucggaccaggcuugcaagcuaaagccacccgggaggcacagaagcgaacagccgcugggauaaugaaaaacccuacuguagacggaauuguggccaucgaucuggaccccgucguuuaugaugcaaaguuugaaaagcagcuaggccagaucaugcugcucauucuuuguacgagccaaauccuguugaugagaaccacaugggcucugugcgaguccauaacucucgccaccgguccacugacaaccuuaugggaggggucuccuggaaaauucuggaauacuacgauugcggugucaauggccaacaucuuuaggggcagcuaccuugcaggagcuggccuggccuucucccucaugaagagucuagggggaggccgccgggggacaggagcacagggcgaaacccugggugagaaauggaagagacaguugaaucagcugucuaaaagcgaguucaacacuuauaagcguucagggauuauggaggucgacagguccgaagcuaaggagggacucaaacggggcgagaccacaaagcacgccgugagucgcgguacugccaaacuucgaugguuuguagaaagaaaucuggugaagcccgagggcaaaguuaucgacuugggguguggaaggggcggguggagcuacuauugcgcgggacugaagaaggugaccgaagucaaaggcuacacaaagggugggccgggacacgaggaaccaauaccuauggcuacguacggcuggaaccucgugaaauuacauucuggcaaggaugucuucuuuauacccccagagaaaugugacacccugcuuugcgauauuggggaguccucacccaauccuacuaucgaagagggacggacacugcgcgugcuaaagaugguugaaccguggcucagagguaaccaauucuguauuaaaauccugaaucccuauaugccaagcguaguggagaccuuggagcagaugcagaggaagcacggcgggaugcugguccgaaacccucucucgagaaauucuacucaugaaauguacugggugaguugcggaacaggcaacauuguuuccgcagugaauaugaccagccguaugcuucugaacagauuuacgauggcccaccgcaagcccaccuaugagagggacgucgauuuaggugcugggccucggcacguggccguagaaccagagguggcaaaccuggacaucauaggacagagaauugaaaauaucaaacaugagcacaagucaacauggcauuacgaugaggacaaccccuauaaaacuugggccuaccacggcuccuaugaaguuaagccuucuggcagcgcuaguuccauggucaaugggguggugaaauugcucaccaagccaugggaugucauccccaugguuacacaaauugcgaugacugacaccacaccguucggacagcagcgcguguuuaaggagaaaguagauaccaggacuccuaaggccaaacgagguacggcacaaauaauggaagugacagcuaaguggcuguggggcuuccuaagccggaacaaaaagccaagaaucuguaccagggaggaauuuacucgcaagguccguucuaaugccgcaauuggggccguguucguugacgagaaccaguggaacucagcuaaagaggccguggaagacgagcgguuuugggaucuuggacauagagaaagggagcugcacaagcagggcaaaugcgcgaccugcgucaguaacaugauggguaagcgcgagaagaagcucggggaguucggaaagcccaaaggcucccgaccuaucugguacauguggcugggcgcacgguuuuuggaguucgaagcccugggguucaugaaugaggaccacugguuuagcagagaaaacucucucucgggaguggagggugagggccuucauaagcugggguacauuuuaagggauaucucaaaaauaccaggaggcaauauguaugcugacgauacagccgguugggacacgcgcaucaccgaagaugaccugcagaacgaggcaagaauuacugauaucauggaacccgagcacgcuuugcucgccaagagcauuuucaaacugacauaccaaaauaagguaguucgggugcagaggccggcuaaaaacgggaccgucauggacgugaucuccagucgugaucagcgaggaucuggccaggugggcacuuaugggcuaaauacauuuaccaacauggaagcccaacuuauacgccagauggagagcgagggaauuuucuccccuucagaacuggagacacccaaccucgcagaaagaguccuggacugguuggagaaguacgguguugaacgguuaaagaggauggcgaucaguggcgaugacugugugguaaaaccaaucgacgaucgcuuugccacugcucugaccgcccucaaugacauggggaaggugagaaaagauauuccucagugggagcccucuaagggauggaacgacuggcagcaagucccauucugcagccaucacuuucaccagcuuauaaugaaagauggccgggagaucgugguucccuguaggaaucaggacgaacuggugggucgagcacgugucucccagggggcuggauggucacuaagagagacggccugccugggcaagagcuaugcacaaauguggcagcucauguacuuccaucgccgggauuugaggcuggccgcgaacgcuauuuguucugccgugccuguagacuggaucccaaccuccagaacaacuuggaguauucacgcacaucaccaguggaugaccacagaagauaugcuuagcguuuggaaucgcguguggaucgaggaaaacccguggauggaggacaagacucauauaucguccuggggcgauguccccuaucuggggaaacgggaggaccaauggugcggaucucucaucgguuuaaccgccagggcuacgugggccacaaauauucagguggcaaucaaccagguucgaagacugauuggcaaugaaaacuacuuggacuacaugaccucaaugaagcgguuuaaaaaugagagcgauccugaaggggcucugugguga

SEQ ID NO: 13624 - RNA, 9879 nt, Artificial Sequence
  derived and/or modified CDS sequence (opt3) from DENV-1__FJ432729__SS-prME
agcgugaccaugcugcucaugcuuaugcccacagcccuggcuuuccacuugacuacgaggggaggggagccucauaugaucgucaccaagcaggaaaggggaaaauccuuacuguuuaagacaucugcugguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcuccccaugucggccuggguuuggagaccagaacagaaacuuggaugagcuccgagggggccuggaaacagauccagaggguggaaaccugggcucuccggcacccuggauucacaguuauugcacuguuucuggcccaugugaucggcaccucuauuacgcagaagggcaucauauucauccucuuaaugcuggucacuccaucgauggcuaugcgcugcguggggauuggaucaagagauuuuguagagggucuuagcggcgccacauggguugacguggucuuggagcacgggaguugugugaccacuauggcgaaggauaaacccacacuggacaucgaacuacucaagaccgaggugacgaacccugcaguccugaggaaacuuugcauugaagccaagaucuccaauaccacaacugauucucgguguccaacccaaggagaggcuacacugauggaagaacaagacgccaacuucguuugccgccgaacuuuuguggauagaggcugggguaauggguguggauuguucggcaaaggcagccucauaaccugcgcaaaguuuaagugcguaacaaaacuggaggggaagauugugcaguacgaaaacuuaaaauauuccgucaucgugaccguucacacuggagaccagcaucaaguggguaaugagucaacggaacacggcacaauugcuaccaucacuccccaggccccuaccagugagauccagcugacagacuacggggcgcucacccuugauuguagcccaaggacuggacuggacuucaacgaaauggucuugcuaacaaugaaggagaaaucuuggcuggugcauaagcagugguuucucgaucugccgcuucccuggacguccggcgccucaaccagccaagagacuuggaaucggcaggaccuguugguaacauucaaaaccgcacacgcuaagaagcaggaaguugugguccucgguagucaagagggggccaugcacacagcucugacuggcgccaccgaaauucagacgucuggaaccacaacuauauuugcaggccauuuaaaaugccgucugaagauggauaaacuaacccucaaggggauguccuaugugauguguacagggagcuucaaacuggagaaggaagucgccgagacucagcacgguaccgugcuuguucagaucaaguacgagggcacggacgcuccuugcaaaauuccauucucgacacaagaugaaaagggggugacccagaacggacgcuugaucacugcgaaucccauaguaacagacaaagagaagccugucaacauugaagcagagccacccuuuggcgagucuuauaucgugaucggugccggggaaaaagcucugaagcucuccugguucaagaaaggcucaaguauuggaaagauguuugaggccaccgcaagaggcgccaggcggauggcuauccugggggauacugccugggacuucggaagcauugguggcguuuuuaccuccguggggaaacuuguccaucagauauucggaacagcauacggcgugcuguuuucugguguaagcuggacgaugaagaucgggauuggcguguugcucaccuggcugggauuaaauucacgaaguacuucccugagcaugacauguaucgcgguuggccuagucacccucuaccugggggugauggugcaggcugauucuggaugcgucaucaacuggaaaggccgcgaacuuaagugugguucagggauuuucguuacaaaugaggugcacacuuggaccgaacaauauaaguuucaggccgacaguccgaaaagauugagcgcagccauaggaaaggcuugggaggagggcgugugcgguaucagguccgccacgcggcuggaaaacauuauguggaaacagaucucuaacgagcucaaucauauucuguuagaaaacgacaugaaguucacaguagucgugggcgauguuguggggauccuggcacagggcaagaagaugauacgcccucaacccauggagcacaaauacucguggaaaagcuggggcaaggcuaagaucauuggggccgacguccagaauaccacuuuuaucauugauggaccaaacaccccugaaugucccgacgaucagagagcguggaauaucugggagguggaggacuauggcuucgguauauuuacaacuaacauuuggcuuaaguugagggauucccacacccagguuugcgaccaucgucucaugucagccgcuaucaaagauaguaaggcagugcacgccgacaugggguacuggauugaaucugagaaaaaugaaacauggaagcuggcucgggccagcuucaucgagguaaagacguguauauggccaaaaucccauacccuauggucaaacggaguccuggaaagcgagaugaucauucccaagaucuauggcgguccuauuucucaacacaauuaccgaccaggcuauuucacucagacagcagggccguggcaccucggaaaacuggagcuugauuuugacuugugcgaaggcaccacugugguggucgaugagcauugcgggaacagaggacccucccugaggacaaccacgguuacuggcaagaucauacacgaaugguguugccgcaguuguaccuuaccuccacuccgguucaaaggugaggacgggugcugguacggaauggagauuagacccgugaaggaaaaggaggaaaaucugguaaaaagcauggugucugcgggcuccggugaggucgacucauuuagucuuggccuguuguguaucagcaucaugauugaagaggugaugaggucgcgcuggucccgaaagaugcucaugacagggacccuggccguuuuccuacugcucaucaugggacagcugacuuggaacgaucuuauucgguugugcauaauggugggcgcuaaugccucugaccguauggggaugggaacaaccuaccuggcauuaauggcuacauuuaaaaugagaccuauguucgccgucggccuccuguuuaggcgccuuacuagccgggaggugcugcuacucaccaucggucugucauugguugcaaguguggaacugccaaacuccuuagaggaacucggggauggacuggccaugggcauuaugauccuuaagcuguugacggacuuccaaucucaucagcucugggcuacacugcuaagccugaccuuuauuaaaacuacccuuucccuccacuaugcguggaagacaauggccaugguccugucaaucguauccuuguucccccuguguuuaaguacuaccucucagaagacgacauggcucccggugcugcuuggcucccuggggugcaaaccuuuggcaaugcuccugauagcugagaauaagaucuggggaagaaaaagcuggccacuaaacgaagguauuauggccguuggcguggucucgauccugcuuucaucucuccugaagaacgaugugcccuuggccgggccuuuaauugcuggaggcaugcugaucgcauguuacguaauaagugguuccagcgccgaccucucucuggagaaagcggcugaggugagcugggaagaggaagccgagcauuccggggcaucacacaauauucuugucgaaguucaggaugacggaaccaugaagaucaaagaugaggagagggacgauacucugacaaucuugcuaaaggccacccugcucgcugugaguggcguguauccccugagcauuccagcaacucuuuuugucugguacuucuggcaaaagaaaaagcagcgaucuggcguguuaugggacacaccuucacccccagaaguugagcgcgccguacuggaugacgggauauaucggaucaugcagagaggacucuuggguaggagccaggugggcgucgggguguuucaagaaaacguuuuccacaccauguggcaugugacgcguggagcgguccugauguaccagggcaaacgccucgagccgaguugggcuagcgugaagaaagaccugauuuccuauggugggggauggcggcuucagggcucuuggaauacuggcgaggaaguacaggucaucgccguggagccugggaagaaccccaagaauguucaaaccgcaccaggaacauucaaaacccccgaaggugaggugggcgccauugcucuggauuuuaagccugggacaucgggaagcccaaucgucaacagagaaggcaaaauaguggguuuguacgggaauggaguugugacuaccucaggcacguacgucuccgccaucgcacaggcuaaggccagucaggagggcccccuaccugagauugaagacgagguguucaggaaacgaaaccugacaaucauggaucuccacccggggucuggaaagacucggcgcuauuuaccagcgauuguaagagaagccaucaagaggaaacugcggacccuuauacuggcacccacacgagugguugcuagcgagauggccgaagcucucaaggguaugccuauuagauaccaaaccacugcagucaaauccgagcauaccggcaaggagaucguggacuugaugugccacgccacauuuacgaugcgccugcucucaccagugaggguccccaauuauaacaugaucauuauggaugaagcccauuucacugacccuucuagcaucgcugcgcguggguacauaaguacccggguaggaaugggcgaggcagccgcuauuuuuaugacagccaccccgcccgguuccguggaagcauucccacagagcaaugccguuauccaggaugaggaaagagacauuccugagaggucuuggaacucaggguaugaguggaucacugauuuucccggaaaaacagugugguucgucccauccauaaagaguggcaaugacauugcuaacugucugcgcaagaauggcaaacgagugauccagcuuagcagaaagaccuuugauacggaauaccagaaaacuaagaacaacgacugggacuauguugugacaaccgauaucucggagaugggggcgaauuuccgggccgacagggucauugauccucgccguugccuaaaacccgugauccugaaggacggaccagaaagaguaauuuuggcagguccgaugccugugaccguugcuucugccgcacagcggaggggccgcauagggcgaaaccacaauaaggagggagaucaguacaucuacaugggccagcccuuaaacaaugacgaggaucacgcccauuggacugaagcuaaaaugcugcucgacaacauuaauacaccagaggguaucauccccgcccuguuugaaccugagagagaaaaguccgcggcaauugauggggaguaucggcuuaggggcgaggcccgcaaaaccuucgucgaacugaugagaaggggagaccucccagugugguugagcuacaagguggcuucagagggcuuccaauauagugaucggcguuggugcuuugacggggaacgcaacaaucagguccuggaggaaaacauggauguugagauauggacaaaagagggagaacgaaagaaacuaagacccagguggcuggacgcccggacuuacucugacccucucgcacuucgcgaguucaaggaauuugcagccgguagaagguccgugagcggcgaucugaucuuagagauugggaaguugccgcagcaccugacgcagcgggcucaaaaugcccucgacaaccugguaaugcuucauaauucagaacagggaggccgagcauauagacacgcgauggaggagcugccagauaccaucgaaacacucauguugcuggccuuaauugcugugcuaacugguggggucacccuguucuuucucaguggccgcggacuuggcaaaacaagcaucgggcuguugugugugauggccuccucuguucugcucuggauggcaagcguggagccccacuggauagcugccuccaucauucuggaguucuuucuuaugguccuccugaucccugagcccgacaggcagcggaccccacaggauaaccaauuggcauacguagugauuggacuguuauucaugauccuaacuguugccgcuaaugagaugggucugcucgaaacgaccaagaaagaccuuggcauagggcauguggcggucgagaaccaccaucacgccacaaugcuggauguggacuugcauccugcaucagcuuggacucuguaugccgucgccaccacaauuaucacccccaugaugcgucacacuauugaaaacacaacggcaaauaucucucucaccgcuauagccaaccaggcggcuauccugaugggacuugauaagggcuggccaauuaguaaaauggacaucggugugccuuuacuggcccucgggugcuacucgcagguuaauccguugacucugacagcagccgugcuaaugcugguagcucacuacgcaauuaucggccccggacuccaagccaaggcgaccagagaggcucagaagaggaccgccgcaggcauaaugaaaaacccaacaguggaugggauugucgccaucgaccuugauccuguuguguaugacgcuaaguuugaaaaacagcugggacagaucauguugcugauucucuguacuagccaaauccuguuaaugcgcacgaccugggcccuuugcgaguccauaacacuggcaacuggcccccucaccacacuaugggaggguucuccagggaaguucuggaauaccacuauugcugucucaauggccaacaucuuucggggaagcuaccuggcgggcgccgguuuggcauucucccugaugaaaagucucggcgggggacgaagaggcacgggggcucagggagaaacacuuggcgagaaguggaagaggcagcugaaucaguugucuaaaagcgaauuuaacauuuauaagcgcucagguaucauggagguggaccgguccgaagccaaagaggggcugaagagaggagagaccacucgucaugcaguaaguaggggcaccgcuaaacuccggugguucguggaacgcaauuuaguuaagccugaggguaaggugauagaucugggcugugggcgaggaggcuggagcuacuauugcgccgggcuuaaaaaggucacagaagugaaaggauacacuaagggcggucccgggcacgaggaaccgaucccaauggccaccuauggauggaaccuggucaaacuacauucuggcaaggacguguucuuuacaccucccgagaaaugugauacgcuccugugcgacauuggcgaguccucaccaaaucccaccaucgaagaggggagaacuuugaggguucugaagaugguagaaccuuggcuccggggaaaccaauucuguauuaagauccuuaauccguacaugcccagcguggucgagacacuggagcagaugcagcgcaaacacgguggcauguuagugagaaacccacugucgagaaauucuacccacgaaauguacuggguuaguugcgggacuggaaacauuguguccgcggucaauaugacaagccgaauguugcucaaccgguuuaccauggcucaucguaagccuacguaugagagagauguggaccugggcgcagguacccgccacguagccguggaacccgagguugcuaaccuagauaucauagggcagaggauugaaaauaucaaacaugagcacaagucaacauggcauuacgacgaggauaacccuuauaaaacuugggccuaccacggauccuaugaagucaagccaucuggcagcgcaaguuccauggugaauggcguggucaaacuucugaccaaacccugggacguuaucccuauggugacacaaauugccaugacugauaccacaccauucgggcagcagcggguauuuaaggagaaaguggacaccagaacucccaaggcuaaacgcggaacggcgcaaauaauggaagucacagccagguggcucugggguuuccugagccgaaacaagaagccgcggaucuguaccagagaggaauuuacuaggaaagugcgcucuaaugcagcuauuggcgccguuuucguggacgagaaccaguggaacucagcaaaggaggccgucgaagaugagcguuuuugggacuuggugcagaaagaacgggagcugcacaagcaggggaaaugcgcuaccugcguauacaacaugaugggaaagagagaaaagaaacucggcgaguucgguaaggccaaagggaguagggcgaucugguauauguggcuuggagcacgcuuucuggaguucgaagccuuaggcuuuaugaaugaggaucauugguucucccgagaaaacagccugucuggcguugagggggagggauugcacaagcucgguuacauucugcgggacaucucgaaaauaccuggcgggaauauguacgcugaugacacagccggaugggauacgagaaucaccgaagacgaucuacaaaacgaggcaaggauuacugacaucauggaaccagagcaugcacuucuggccacaucaauuuucaagcucaccuaucagaauaaagugguccgcgugcagagacccgcuaagaacggcacugugauggaugucaucagccggagggaccagcgugguuccgggcaaguuggaacauacggccugaauaccuuuacaaacauggaagcccaguugauacgacagauggagagugagggcauuuucuuaccuucugaacuggagacucagaaccucgcagaacgcgugcuugauuggcuggagaaguaugggguagaaagacuaaaacggauggcgaucagcggagacgacuguguggucaagccaaucgaugacagguuugccaccgcucugacggcccucaaugauauggguaaagugcgcaaggacauuccccaaugggagccguccaaaggcuggaacgauuggcagcagguuccuuucugcucacaccacuuucaucaguugauaaugaaggacgggagagagaucgugguccccugucggaaucaagaugaacuggugggaagggcacgaguaagucagggcgcugguuggucucuucgugagaccgccugccugggaaagagcuacgcacagauguggcaacucauguauuuccacagacgcgacuuacggcuggccgcgaacgcuauuuguuccgccguuccaguggauugggucccuacaucaaggacuaccuggagcauccaugcacaccaucaguggaugacaacugaagacauguugucuguguggaauagaguuuggauugaggaaaaccccuggauggaggauaaaacccacguguccaguuggggagacgucccauaccugggcaagcgcgaggaccaguggugcggcagccucaucgggcuuacggcccgggcuacaugggccucgaauauacagguggcaaucaaccaaguaaggcgacugauuggaaaugaaaacuaucuagauuacaugaccuccaugaaaagauuuaagaaugagggugaccccgaaggcgcucugugguga

SEQ ID NO: 13625 - RNA, 9879 nt, Artificial Sequence
  derived and/or modified CDS sequence (opt3) from DENV-1__FJ432730__SS-prME
agcgugaccaugcugcuaaugcuuaugcccacagcacuggcuuuccacuugacuacgcgaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggggagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaaugacaacuaucuucgccggccaucugaagugccguuuaaaaauggauaagcugacccuaaaagggaugagcuaugugauguguacaggaucguucaagcucgagaaggaagucgcugagacucagcacgguaccgugcugguucagauuaaauacgagggcacggacgcgccuugcaagauaccauuuucuacacaggaugaaaaaggggugacccaaaacggacgccuuaucacugcaaaucccauuguaacagacaaggagaaaccugucaacaucgaagccgagccacccuucggcgaguccuauauagugauuggugcuggggaaaaggccuugaagcugucaugguuuaaaaagggcaguagcaucggaaaaauguucgaggcaaccgccagaggcgcuaggcggauggccauccucggggauacugcaugggacuuuggauccauugguggcguuuucaccucuguggggaagcugguccaucagaucuuuggaacagcguacggcgugcuuuucagcgguguaucauggacgaugaaaauugggauaggcgugcuguugaccuggcucggacugaauagucgauccacuagcuuaucuaugacauguaucgcuguuggccuggucacccuauaccucggggugauggugcaggccgauucaggaugcgucauuaacuggaagggccgcgaacugaagugugguagugggaucuuuguuacaaaugaggugcacacuuggaccgaacaguauaaauuccaagcagacagcccgaagagacuuuccgccgcuaucggaaaagccugggaggagggcgugugcgguauuaggucugcaacgcgguuggaaaacauaauguggaagcagaucucgaacgagcugaaucauauucuccuggaaaacgacaugaaauuuacaguagucgugggcgauguugcugggaucuuagcccagggaaagaaaaugauucgcccucagcccauggaguacaaguauagcuggaaguccuggggcaaagcgaagaucauaggggccgacgugcaaaauaccacuuucaucauugauggaccaaacaccccugaaugucccgacgaucagagagcuuggaauaucugggaggucgaggacuacggcuuugguauuuucacaacuaacaucuggcugaaacuuagggauucauauacccaggugugcgaccaccguuugaugagugcagccauaaaggauucuaaagcuguucacgccgacaugggguacuggauugaaagcgagaagaaugaaacauggaagcucgcacgggcguccuucaucgaggugaaaacguguauuuggccaaagucacauacccuguggagcaacggaguacuagaaucugagaugaucauacccaaaaucuauggcgguccuauuucccagcacaauuaccgaccaggcuacuuuacucaaacagccgggccguggcaucugggaaagcucgagcuggauuucgaccuuugcgaaggcaccacugucgugguggaugagcacugcgggaacagaggacccaguuugaggacaaccacggucacuggcaaaaucauucacgaaugguguugccgcagcuguacccugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugacagggacccucgccguguuuuuccugcuaaucaugggacagcugacuuggaacgaucucauucggcugugcaucaugguuggcgcaaaugcuagcgaccguauggggaugggaacaaccuaccuugccuugauggcaacauuuaagaugagaccuauguucgccgugggccuguuauuuaggcgccucacuucacgggagguccugcuucugaccauuggucuaagucucguggcuuccguugaacugccaaacucuuuggaggaacugggggauggauuagcgaugggcauaaugauccucaaacugcuuacggacuuccagagccaucaacugugggccacauugcucucccugaccuuuauuaagacuaccuucucacuacacuaugcauggaagacaauggcuauggugcugagcaucgucagucuuuuuccccucugucugucuacuaccucccagaaaacgacaugguugccgguacuguuaggcagccucgggugcaagccucugaccauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacuaugaaaauuaaggaugaggagagggacgauacacugaccauccuccugaaggcuacucuucuggcagucagcggcguuuaucccuugucuaucccagccacacuauucgugugguacuuuuggcagaaaaagaaacaacgauccggcgugcugugggacaccccuucacccccagaagucgagcgcgcggugcucgaugacgggauuuaucggauaaugcagagaggacugcuugguaggagucagguuggcguagggguguuccaggaaaacgucuuucauacgauguggcacgugacucguggagcuguuuuaauguaccaaggcaagcgccuggagccgagcugggccuccgugaaaaaggaccucaucucuuacggugggggauggcgguugcagggcucguggaauaccggcgaggaaguccaggugauugcaguagagccugggaagaaccccaaaaauguccagacagccccaggaaccuucaagacaagcgaaggugaggugggcgcuaucgcccuggauuuuaaacccgggacuucaggauccccuauuguuaacagagaaggcaagaucgugggucucuaugggaauggagucgugaccacgaguggcacauacguuucugcaauagcucaagccaaagcgagccaggagggcccacugcccgagaucgaagacgagguguucaggaagcgaaaccuuacuauuauggaucugcacccuggguccggaaagacccggcgcuauuugccggccaucgucagagaagcaauuaaaaggaagcuacggacacugauccucgcuccaacccgagugguagccucagagauggcugaagcauuaaaagguaugcccauaagauaccagacuaccgccgugaagucugagcauacaggcaaagagauuguugaccugaugugccacgccacguuuacuaugcgccuucugagcccugucagggugccaaauuauaacaugaucaucauggaugaagcucauuucaccgaccccaguuccauugcggcacguggguacaucagcacacgggugggaaugggcgaggccgcugccauauuuaugaccgcaacuccuccggguucugucgaagccuucccccaaucaaaugcuguaauucaggaugaggaaagagacaucccagagagguccuggaacaguggguaugaguggauuacagauuuuccuggaaagaccgugugguucguucccagcaucaagucgggcaaugacauagcgaacugucuccgcaaaaauggcaagcgagugauucaguugucuagaaaaacguucgauacugaauaccagaagacuaagaacaacgacugggacuacgucgugaccaccgauaucuccgagaugggggccaauuuucgggcagacaggguuaucgauccacgccguugccugaagccugugauucucaaggacggacccgaaagagucauccuggcugguccaaugccggugacuguagccagcgcagcccaacggaggggccgcauugggcgaaaccacaauaaagagggagaucaguauauauacaugggccagccucuuaacaaugacgaggaucaugcucacuggacagaagccaagaugcuacuggacaacaucaauacccccgaggguauuaucccagcguuguucgaacccgagagagaaaaaucagcagccaucgauggggaguaucgguuaaggggcgaggcucgcaagacauuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauuuggacuaaggagggagaaaggaaaaagcugagaccaagauggcucgacgcucggacguacagcgaccccuuggcacugcgcgaguucaaggaauuugccgcugguagaaggucagucaguggcgaucuaauacuggagaucgggaaacucccucagcaccuuacccagcgggcccagaaugcacuggacaacuuaguuauguugcauaauagcgaacaaggaggccgagcguauagacacgccauggaggagcugccggauacaauugaaacucucaugcugcuugcucugaucgccgugcucaccggugggguaacauuguucuuucuguccggccgcggauuaggcaagaccucuauugggcuacugugugugauggcaagcuccguccuccuuuggauggcuucaguggagccacauuggaucgccgcaucuauaauccuggaguucuuuuugaugguucugcucauucccgagccugacaggcagcggacuccccaggauaaccagcuggccuacguggucaucggacuucucuucaugauucugacgguagcugcgaaugagauggguuugcuggaaaccaccaaaaaggacuuaggcaucgggcacguggccguugagaaccaccaucacgcagcuaugcuagauguggaccugcauccagccagugccuggacucucuacgcagucgcuaccacaauaauuaccccuaugaugcgucacacuaucgaaaacacaacggccaauauuucgcuuaccgcgaucgcuaaccaagccgcaauacugaugggauuggauaaaggcuggcccaucagcaagauggacauuggugugccacugcucgcccuggggugcuauucccaggucaauccucuuacuuuaacagcugcagugcugaugcucguugcccauuacgcgaucauuggcccgggauugcaggcuaaggccaccagagaggcacagaaaaggaccgccgcuggcaucaugaagaaccccacaguggaugggauaguagccauugaccuggauccaguggucuaugacgcaaaauuugaaaagcagcuaggacagaucaugcugcucauccuuuguacuucucagauucuguugaugcgcacgaccugggcucugugcgagucaaucacacucgccacuggcccucugaccacauuaugggaggguagccccgggaaauucuggaauaccacuauagcgguuuccauggccaacauuuuccggggaaguuaccuugcaggcgcuggucuggccuuuucucucaugaaaagccuaggcgggggacgaagaggcacgggggcacaaggagaaacacugggcgagaaguggaaaaggcaguugaaucagcugucaaaguccgaguucaacaccuauaaacgcagugguaucauggagguggaccggagcgaagcuaaggaggggcucaaaagaggagagacuaccaagcacgccgucucucguggcacagccaaacuuaggugguuuguggaacggaaucugguaaaaccagaggguaaggugauugauuugggcugugggcgcggaggcugguccuacuauugcgcggggcugaaaaagguuacugaagugaaaggauacaccaagggcgguccugggcacgaggaacccaucccgauggcuacauacggauggaaccucgucaaauuacauucaggcaaggacguguucuuuauaccaccugagaagugugauacgcugcuuugcgacaucggcgagagcucgcccaauccaaccauugaagaggggcgaacucugagaguccuaaaaaugguggaacccuggcucaggggaaaccaguucuguaucaagauucugaauccuuauaugccgucuguuguagagacauuggagcaaaugcagcggaaacacgguggcaugcuggugcgcaacccccucaguagaaauuccacccaugaaauguacugggucagcugcgggacuggaaacaucgugucagcaguuaauaugacauccaggaugcuucugaaccgauuuaccauggcccaccggaagccaacguaugagcgugauguggacuuaggcgcugguaccagacacgucgccguggaaccugagguagcaaaccuggauauuaucgggcagcgcauagaaaauauuaaacaugagcacaagucuacauggcauuacgacgaggauaaccccuauaagacuugggccuaccacggaagcuaugaagugaaaccuaguggcuccgcuagcucuaugguuaauggcgucgugaaguugcucaccaaaccaugggacgugauccccauggucacacagaucgcgaugacugauaccacaccuuucgggcaacagaggguuuuuaaggagaaaguggacacccggacuccaaaggccaagagaggaacggcacagauuauggaaguaacagcuaaauggcugugggguuuccuaucacgcaacaagaaacccaggauauguacccgagaggaauuuacucggaaggugagaaguaaugccgcaaucggcgccgucuucguggacgagaaccaauggaacuccgcuaaagaggccguugaagaugagagguuuugggaccuugugcaucgcgaacgugagcugcacaagcaggggaagugcgcgaccugcgucuacaacaugaugggaaaacgggaaaagaaacucggcgaguucgguaaggcaaaagggagcagagccauuugguacauguggcugggagcuagguucuuggaguuugaagcccugggcuucaugaaugaggaucacugguuuucucgcgaaaacucgcucucaggcguggagggggagggacuucauaagcuggguuauaucuuacgagacauuagcaaaaucccgggcgggaauauguacgcagaugacacagcuggaugggauacgcggauaaccgaagacgaucugcagaacgaggccaagaucacugacauuauggaaccugagcacgcuuugcucgccaaguccaucuucaaacugacauaucagaauaagguaguuagagugcaaaggccagccaaaaacggcaccgucauggaugugauuagucgcagagaccagcgggguucuggacaggugggaacuuacggccuaaauacauuuaccaacauggaagcgcagcuuaucaggcaaauggagagcgagggcauauucucccccucagaacuggagacaccuaaccucgcccgucgaguccuggauugguuggaaaagcaugggguugagcgcuuaaaaagaauggcuauuaguggagacgacugugugguaaagccaaucgaugaccgguuugccacugcacugaccgcucucaaugauauggguaaggugaggaaagacaucccccagugggaaccgucuaagggcuggaacgauuggcagcaggucccuuucugcagccaccacuuucaucaacuuauuaugaaagacgggcgcgagauagugguucccuguagaaaucaggaugagcuggugggacgggccagggucucccagggcgcagguuggucacuacgagaaacggccugccugggaaagagcuaugcgcagauguggcaacucauguacuuccaccguagagacuugcgccuggcugccaacgcaaucuguucugccgugccaguagauuggguuccuaccucccggacaacuuggaguauucaugcucaccaucaguggaugaccacagaggacaugcuuagcguguggaauagggucuggaucgaagagaaccccuggauggaagauaaaacucacauuucguccuggggagacgugccauaucugggcaagagagaggaccaguggugcggcucucucaucggguuaaccgcccgcgcaacgugggcuacaaauauacaaguugccaucaaccaggugcggaggcugauuggaaaugagaacuacuuggauuacaugaccucaaugaagcgauuuaaaaaugaaagcgaccccgagggugcgcugugguga

SEQ ID NO: 13626 - RNA, 9879 nt, Artificial Sequence
  derived and/or modified CDS sequence (opt3) from DENV-1__FJ432732__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugugaucggcaccucgauuacgcagaagggcaucauauucauccucuuaaugcuggucacuccaucaauggccaugcgcugcguggggauuggaagcagagauuuuguagagggucuuaguggcgcuacauggguugacguggucuuggagcacggguccugugugaccacuauggccaaggauaaacccacacuggacaucgaacuacucaagaccgaggugacgaacccugcgguccugaggaaacuuugcauugaagcaaagaucucuaauaccacaacugauagccgguguccaacccaaggagaggccacacugguugaagaacaagacgcuaacuucgugugccgccgaacuuuuguagauagaggcugggguaauggguguggauuguucggcaaaggcucccucauaaccugcgccaaguuuaagugcgugacaaaacuggaggggaagauuguccaguacgaaaacuuaaaauauucagugaucguuaccgugcacacuggagaccagcaucaagucgguaaugagaguacggaacacggcacaaccgcaacuauuacaccccaagcuccuaccaccgagauccagcugacugacuacggggcccucacacuugauuguagcccaaggacgggacuggacuucaacgaaaugguguugcuaaccaugaaggagaaaucuuggcugguacauaagcagugguuucucgaucugccgcuucccuggacuuccggcgcgucaacaagccaagagaccuggaaucggcaggaccuguugguuacauucaaaacugcccacgcaaagaagcaggaaguggucgugcucgguagucaagagggggcuaugcacaccgcccugacgggcgcuaccgaaauccagacaucuggaacuaccacaauuuuugccggccauuuaaaaugccgucugaagauggauaaacuaacucucaaggggauguccuaugucauguguaccgggagcuucaaacuggagaaggaaguggcagagacgcagcacgguacaguucuugugcagauaaaguacgagggcaccgacgccccuugcaaaaucccauucucgacucaagaugaaaaggggguaacacagaacggacgcuugauuaccgcuaaucccaucgucacugacaaagagaagccugugaacauagaagcggagccacccuuuggcgagucuuauauuaccaucggugcaggggaaaaagcccugaagcucuccugguucaagaaaggcucaaguaucggaaagauguuugaggcuacagccagaggcgcaaggcggauggccauucugggggauacggcuugggacuucggaagcaucgguggcguuuuuaccuccguggggaaacuuguccaucagauuuucggaacugccuacggcgugcuguuuucugguguaagcuggacaaugaagauagggaucggcguguugcucaccuggcugggauuaaauucacgaaguacaucccugagcaugacuuguauugcaguuggccuagucacccucuaccugggggugauggugcaggcggauucuggaugcgucaucaacuggaaaggccgcgaacuuaagugugguucagggaucuucguuacgaaugaggugcacacauggaccgaacaauauaaguuucaggcugacaguccgaaaagauugagcgccgcaauuggaaaggccugggaggagggcgugugcgguauaagguccgcuacucggcuggaaaacaucauguggaaacagauuucuaacgagcucaaucauauccuguuagaaaacgacaugaaguucaccguagucgugggcgauguugccgggauuuuugcacagggcaagaagaugauccgcccucaacccauggaguacaaauauucguggaaaagcuggggcaaggcuaagauaaucggggccgacgugcagaauacaacuuucauuaucgauggaccaaacaccccugaaugucccgacgaucagagagcguggaauauuugggaggucgaggacuacggcuuugguaucuucacaacgaacauauggcugaaacuuagggauuccuauacccaggugugcgaccaccguuugaugucagccgcuauuaaagauaguaaggcaguucacgccgacaugggguacuggaucgaaucugagaaaaaugaaacuuggaagcucgcucgggccagcuucauugaggugaagacauguaucuggccaaaaucccauacccuguggucaaacggaguacuagaaagcgagaugauaauccccaagauuuauggcgguccuaucucucaacacaauuaccgaccaggcuacuuuacucagacagcagggccguggcaucugggaaaacucgagcuggauuucgaccuuugcgaaggcaccacggucgugguggaugagcacugcgggaacagaggacccuccuugaggacuaccacagucaccggcaagauuauccacgaaugguguugccgcaguuguacucugccuccauuacgguuuagaggugaggacgggugcugguauggaauggagauaaggcccguuaaagaaaaggaggaaaaucucgugaaguccaugguaucugcgggcuccggugagguggacucauucagucugggccuucuguguauuagcaucaugaucgaagaggucaugcgcucgcgauggucccggaaaauguugaugacagggacccucgccguguuuuuccugcuaauuaugggacagcugacauggaacgaucucauccgucugugcauuaugguuggcgcuaaugccucugacagaauggggaugggaacuaccuaccuugcauugauggcuacguuuaagaugaggccuauguucgccgugggccuguuauuucgccggcucacaagcagagagguccugcuucugaccauaggucuaucacucguggcaaguguugaacugccaaacuccuuggaggaacugggggauggauuagccaugggcaucaugauucucaaacugcuuacugacuuccaaucucaucagcugugggcuaccuugcucagccugacauuuaucaagacuaccuucucccuacacuaugcguggaaaacgauggccauggugcugucaauugucagccuuuuuccccucugucugaguacaaccucucagaagacuacaugguugccgguacuguuaggcucccucgggugcaagccucugaccauguuccuuaucgcagagaauaaaauauggggaaggcgaagcuggccacugaacgaagguaucauggcugugggcauuguuucgaucuugcucucaucucugcuaaagaacgaugugccccuggccgggccucuuauugccggaggcaugcucaucgcuuguuacgucauaagugguuccagcgcagaccugucuuuggagaaagccgcggaggugagcugggaagaggaagcugagcauuccggggccucacacaauauuuuaguagaagugcaggaugacggaacuaugaagaucaaagaugaggagcgcgacgauacacugaccauccuccugaaggcaacgcuucuggccgucaguggcguuuaucccuugagcauuccagcuacucuauucgugugguacuuuuggcagaagaagaagcagcggucuggcgugcugugggacaccccuucacccccagaagucgagagagcagugcucgaugacgggauauauaggaucaugcagcguggacugcuuggucgcagccagguuggcguagggguguuccaagaaaacgucuuucauacaauguggcacgugacccggggagccguuuuaauguaccagggcaaaagacuggagccgaguugggcgagcgugaagaaagaccucauuuccuacggugggggauggagguugcagggcucuuggaauacaggcgaggaaguccaggugaucgcuguagagccugggaagaaccccaaaaauguccaaacugccccaggaaccuucaagacgcccgaaggugaggugggcgcaauugcccuggauuuuaagccugggacaucgggaagcccaaucguuaaccgagaaggcaaaauagugggucucuaugggaauggagucgugacuaccucaggcacauacguuuccgcuaucgcccaggcaaaggcuagucaggagggcccccugccugagauugaagacgagguguuccggaaacgcaaccuuaccaucauggaucugcacccggggucuggaaagacuagaagguauuugccagccauuguccgggaagcgaucaaacgaaagcuaagaacccugauacucgcccccacacgcgugguagcaagcgagauggcugaagccuuaaaggguaugccuauuagguaccaaacgacugcugugaaauccgagcauaccggcaaggagaucguugaccugaugugccacgcaacauuuaccaugcgucuucugucaccaguccgggugcccaauuauaacaugaucauuauggaugaagcccauuucacugacccuucuagcaucgccgcuagaggguacauaaguacaagggugggaaugggcgaggcggcagccauuuuuaugaccgcuacgccgcccgguuccgucgaagccuucccacagagcaaugcaguaauccaggaugaggaacgcgacauuccugagcgaucuuggaacucaggguaugaguggaucacugauuuucccggaaaaacagugugguucguuccauccauaaagaguggcaaugacauugccaacugucucaggaaaaauggcaagcgggugauccaguugagcaggaagaccuucgauaccgaauaccagaaaacuaagaacaacgacugggacuacgucgugacaaccgauaucucggagaugggggcuaauuuucgcgcggaccguguuauugauccuagacggugccugaaacccgugauccucaaggacggaccagaaagggucauucuggccgguccgaugccugugacaguagcaucugcugcccagcgccgaggcagaauagggcggaaccacaauaaagagggagaucaguauaucuacaugggccagccccuuaacaaugacgaggaucaugcacacuggacugaagccaagaugcuacuggacaacauuaauacgccagaggguaucauccccgcuuuguucgaaccugagagggaaaaguccgccgcgauugauggggaguaucgcuuaagaggcgaggcaaggaaaaccuuuguggaacugaugcggcguggagaccucccaguuuggcugagcuacaaggucgccucagagggcuuccaauauagugaucgccgauggugcuuugacggggaaagaaacaaucaggugcuugaggaaaacauggauguggagauauggacaaaagagggagaaaggaagaaacugcggccccgcuggcucgacgcuagaacuuacucugacccuuuggcccugagggaguucaaggaauuugcugcaggucggcgauccgucagcggcgaucuaauccuggagauugggaaacucccgcagcaccuuacccagagagcccaaaaugcucuggacaacuuaguuauguugcauaauucagaacagggaggccgcgccuauaggcacgcaauggaggagcugccagauacaaucgaaacccucaugcugcuugcgcugauugccgugcucacuggugggguaacguuguucuuucugaguggccggggauuaggcaagaccagcaucgggcuacugugugugauggcuuccucuguccuccuuuggauggccagcguggagccccauuggauagcagcuuccaucauucuggaguucuuuuugaugguucugcucaucccugagcccgaccgucagagaacaccacaggauaaccaacuggccuacguggucauuggacuucucuucaugauccugacuguagcagccaaugagauggguuugcuggaaaccacaaagaaagacuuaggcauagggcacguggcuguugagaaccaccaucacgcggccaugcuagauguggaccugcauccugcaucagcuuggacccucuacgccgucgccacuacaauuaucacgcccaugaugaggcacaccauugaaaacacuacagcaaauaucucucuuaccgcuauagccaaccaggcggcuauccugaugggauuggauaagggcuggccaauuaguaaaauggacaucggugugccucugcucgcccuggggugcuauucgcaggucaauccgcuuaccuuaacagcagccgugcugaugcucguugcucauuacgcaauuaucggccccggauugcaagccaaggcgacucgcgaggcucagaaacggacggccgcaggcauaaugaagaacccaaccguggaugggauuguagccaucgaccuggauccuguggucuaugacgcuaaguuugaaaaacagcuaggacagaucaugcugcucauucuuuguacaagccaaauccuguugaugcgaacuaccugggcccugugcgaguccauaacacucgcaaccggcccccugacuacguuaugggaggguucuccagggaaguucuggaauacaaccauugcuguuucaauggccaacaucuucagaggaagcuaccuugcgggcgccggucuggcauuuucccucaugaaaagucuaggcgggggaaggcgcggcacuggggcucagggagaaacccugggcgagaaguggaaacggcaguugaaucagcugucuaagagcgaguucaacacauauaagagaucagguauuauggagguggaccguuccgaagccaaagaggggcucaagaggggagagacuaccaaacacgcagucagucggggcacagcuaaacuucgcugguuuguggaacgaaaucugguaaaaccugaggguaaggugaucgauuugggcugugggagaggaggcuggagcuacuauugcgccgggcugaagaaaguuacggaagugaagggauacaccaaaggcggucccgggcacgaggaaccgauaccaauggccacuuacggauggaaccucgucaaguuacauucuggcaaagacguguucuuuaucccucccgagaagugugauacacugcuuugcgacauuggcgaguccucaccaaaucccaccaucgaagaggggaggacucugcggguccuaaaaaugguggaaccuuggcuccgcggaaaccaauucuguauuaagauccugaauccguauaugcccagcguuguagagacauuggagcagaugcagagaaagcacgguggcaugcuggugaggaacccacucucgcgaaauucuacccaugaaauguacugggucaguugcgggacgggaaacauuguguccgcgguuaauaugaccagccggaugcuucugaaccguuuuacaauggcucacagaaaaccuacuuaugagcgcgauguggacuuaggcgcagguaccaggcacgucgccguggaacccgagguagcuaaccuggauaucauagggcagcggauugaaaauaucaagcaugagcacaaaucaacauggcauuacgacgaggauaacccuuauaagacuugggccuaccacggauccuaugaagugaaaccaucuggcagcgcaaguuccaugguuaauggcgucgugaaguugcucaccaagcccugggacgugaucccuauggucacacaaauugccaugaccgauacuacgccauucgggcagcagagaguuuuuaaagagaagguggacacacgcacccccaaagcuaagaggggaacugcgcaaauaauggaaguaaccgccaaauggcugugggguuuccuaagccgaaacaagaagccgcggaucuguacaagagaggaauuuacgaggaaagugcgcucuaaugcagcuauuggcgccgucuucguggacgagaaccaguggaacucagcaaaggaggccguugaagaugagcguuuuugggaccuugugcaucgggaaagagagcugcacaaacaggggaagugcgcuaccugcgucuacaacaugaugggaaaaagggaaaagaagcucggcgaguucgguaaagccaaggggagucgcgcgaucugguacauguggcugggagcacgauucuuggaguuugaagcccugggcuucaugaaugaggaucacugguuuucccgggaaaacagccucucuggcguggagggggagggacuucauaaacuggguuauauuuuaagagacaucucgaagauaccuggcgggaauauguacgcugaugacacugccggaugggauacaaggaucaccgaagacgaucugcagaacgaggcacgcauuacugacaucauggaaccagagcacgcuuugcucgccaaaucaauuuucaagcugacauaucaaaauaaaguaguuagagugcagcggcccgcuaagaacggcaccgucauggaugugaucagcaggcgugaccagcgagguuccggacaggugggaacauacggccuaaauacuuuuaccaacauggaagcccaacuuauacgccagauggagagugagggcauuuucucuccuagcgaacuggagacgccaaaccucgcagaaagaguccuggauugguuggagaaguaugggguugaacgguuaaaaaggauggcgaucuccggagacgacugugugguaaagcccaucgaugaccgcuuugccaccgcucugacagcccucaaugauauggguaaagugagaaaggacauuccgcagugggagccuucaaaaggcuggaacgauuggcagcaaguccccuucugcagucaucacuuucaccagcuuauaaugaaggacgggcgggagaucgugguuccauguaggaaucaggaugaacuggugggacgagcacgugucucucagggcgcugguuggagccuaagagagacugccugccuggggaaguccuacgcacaaauguggcagcucauguauuuccaucgccgggacuugaggcuggccgcgaacgcuauuuguucagccgugccuguagauuggauccccaccagcagaacaacuuggucuauucacgcacaucaccaguggaugaccacggaagacaugcuuuccguuuggaaucgcguguggaucgaggaaaacccauggauggaggauaaaacacauauaaguagcuggggagacguccccuaccugggcaagcgggaggaccaauggugcggcucgcucaucggguuaaccgccagggcuacuugggccacaaauauucagguggcaaucaaccagguucgaagacugauuggaaaugaaaacuacuuggauuauaugaccuccaugaaacgguuuaagaaugagucugacccugaaggugcucugugguga

SEQ ID NO: 13627 - RNA, 9879 nt, Artificial Sequence
  derived and/or modified CDS sequence (opt3) from DENV-1__FJ432733__SS-prME
agcgugaccaugcugcucaugcuuaugcccacagcccuggcuuuccacuugacuacgaggggaggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgagguggaaccggacgauguagacuguuggugcaaugcgacugauacaugggugaccuaugggacguguucacagacuggagagcaccgccgagacaagcguagugucgcucuugcaccccaugugggccuggguuuggagaccagaacagaaacuuggaugagcuccgagggggcauggaaacagauccagaggguugaaaccugggcccuccggcacccuggauucacagugauugcucuguuucuggcccaugucaucggcaccucuauuacgcagaagggcaucauauucauccucuuaaugcuggugacuccaucgauggccaugcgcugcguagggauuggaucaagagauuuuguugagggucuuagcggcgcuacauggguggacgucguguuggagcacgggaguugugugaccacuauggccaaggauaaacccacacuggacaucgaacuacucaagaccgaggucacgaacccugcgguucugaggaaacuuugcauugaagcaaagaucuccaauaccacaacugauucucgguguccaacccaaggagaggccacacugauggaagaacaagacgcuaacuucgugugccgccgaacuuuuguagauagaggcugggguaauggguguggauuguucggcaaaggcagccucauaaccugcgccaaguuuaagugcgugacaaaacuggaggggaagauuguccaguacgaaaacuuaaaauauuccgugaucguuaccgugcacacuggagaccagcaucaagucgguaaugagucaacggaacacggcacaauugcaaccaucacuccccaggcuccuaccagugagauccagcugacagacuacggggcccucacccuugauuguagcccaaggacuggacuggacuucaacgaaaugguguugcuaacaaugaaggagaaaucuuggcugguacauaagcagugguuucucgaucugccgcuucccuggacguccggcgcgucaaccagccaagagacuuggaaucggcaggaccuguugguuacauucaaaaccgcccacgcaaagaagcaggaaguggucgugcucgguagucaagagggggcuaugcacacagcccugacuggcgcuaccgaaauucagacgucuggaaccacaacuauauuugccggccauuuaaaaugccgucugaagauggauaaacuaacccucaaggggauguccuaugucauguguacaggaucguucaaacuggagaaggaaguggcagagacucagcacgguaccguucuugugcagaucaaguacgagggcacggacgccccuugcaaaauuccauucucgacacaagaugaaaaggggguaacccagaacggacgcuugaucacugcuaaucccauagucacagacaaagagaagccugugaacauugaagcggagccacccuuuggcgagucuuauaucguuaucggugcaggggaaaaagcccugaagcucuccugguucaagaaaggcucaaguauuggaaagauguuugaggcuaccgccagaggcgcaaggcggauggccauccugggggauacugcuugggacuucggaagcauugguggcguguuuaccuccgucgggaaacuugugcaucagauauucggaacagccuacggcguacuguuuucuggugugagcuggacgaugaagaucgggauuggcguuuugcucaccuggcugggauuaaauucacgaaguacuucccugagcaugacauguaucgcagucggccuagugacccucuaccugggggugaugguccaggcggauucuggaugcguuaucaacuggaaaggccgcgaacuuaagugugguucagggauuuucgugacaaaugaggugcacacuuggaccgaacaauauaaguuucaggcugacaguccgaaaagauugagcgccgcaauaggaaaggccugggaggagggcguaugcgguaucagguccgcuacgcggcuggaaaacauuauguggaaacagaucucuaacgagcucaaucauauucuguuagaaaacgacaugaaguucacagucgugguuggcgauguggucgggauccuggcccagggcaagaagaugauacgcccucaacccauggagcacaaauacucguggaaaagcuggggcaaggcaaagaucauuggggcugacgugcagaauaccacuuuuaucauugauggaccaaacaccccugaaugucccgacgaucagagagccuggaauaucugggagguugaggacuauggcuucgguauauuuacaacuaacauuuggcuuaaguugagggauucccacacccaggugugcgaccaucgucucaugucagcggccaucaaagauaguaaggcuguacacgcagacaugggguacuggauugaaucugagaaaaaugaaacauggaagcuggcccgggcuagcuucaucgaggucaagacguguauauggccaaaaucccauacccuauggucaaacggagugcuggaaagcgagaugaucauucccaagaucuauggcgguccuauuucucaacacaauuaccgaccaggcuauuucacucagacagccgggccguggcaccucggaaaacuggagcuugauuuugacuugugcgaaggcaccacuguggucguugaugagcauugcgggaacagaggacccucccugaggacaaccacggugacuggcaagaucauacacgaaugguguugccgcaguuguaccuuaccuccacuccgguucaaaggugaggacgggugcugguacggaauggagauuagacccguaaaggaaaaggaggaaaaucuggugaaaagcauggucucugcaggcuccggugagguggacucauuuagucuuggccuguuguguaucagcaucaugauugaagagguuaugaggucgcgcuggucccgaaagaugcucaugacagggacccuggcgguguuccuacugcucaucaugggacagcugacuuggaacgaucuuauucgguugugcauaauggucggcgccaaugcuucugaccguauggggaugggaacaaccuaccuggccuuaauggcaacauuuaaaaugagaccuauguucgcugugggccuccuguuuaggcgccuuacuagccgggagguucugcuacucaccaucggucugucauugguggccagugucgaacugccaaacuccuuagaggaacucggggauggacuggcaaugggcauuaugauccuuaagcuguugacggacuuccaaucucaucagcucugggccacacugcuaagccugaccuuuauuaaaacuacccuuucccuccacuaugcuuggaagacaauggcgaugguacugucaaucgugagcuuguucccccuguguuuaaguacuaccucucagaagacgacauggcucccgguucugcuuggcucccuggggugcaaaccuuuggccaugcuccugauagcagagaauaagaucuggggaagaaaaagcuggccacuaaacgaagguauuauggcugugggcgucgugucgauccugcuuucaucucuccugaagaacgauguacccuuggccgggccuuuaauugccggaggcaugcugaucgcuuguuacgugauaagugguuccagcgcagaccucucucuggagaaagccgcggaggucagcugggaagaggaagcugagcauuccggggccucacacaauauucuuguugaagugcaggaugacggaaccaugaagaucaaagaugaggagagggacgauacucugacaaucuugcuaaaggcaacccugcucgccgugaguggcgucuauccccugagcauuccagcuacucuuuuugugugguacuucuggcaaaagaaaaagcagcgaucuggcguuuuaugggacacaccuucacccccagaaguagagcgcgcagugcuggaugacgggauauaucggaucaugcagagaggacucuuggguaggagccaggucggcguggggguuuuucaagaaaacguguuccacaccauguggcaugucacgcguggagccgugcugauguaccagggcaaacgccucgagccgaguugggcgagcguaaagaaagaccugauuuccuauggugggggauggcggcuucagggcucuuggaauacuggcgaggaaguccaggugaucgcuguugagccugggaagaaccccaagaaugugcaaaccgccccaggaacauucaaaacccccgaaggugaggucggcgcaauugcccuggauuuuaagccugggacaucgggaagcccaaucgugaacagagaaggcaaaauaguugguuuguacgggaauggaguggucacuaccucaggcacguacguguccgcuaucgcccaggcaaaggcuagucaggagggcccccuaccugagauugaagacgagguauucaggaaacgaaaccugacaaucauggaucuccacccggggucuggaaagacucggcgcuauuuaccagccauugugagagaagcgaucaagaggaaacugcggacccuuauacuggcccccacacgaguugucgcaagcgagauggcugaagcccucaaggguaugccuauuagauaccaaaccacugcugugaaauccgagcauaccggcaaggagaucguggacuugaugugccacgcaacauuuacgaugcgccugcucucaccagucaggguacccaauuauaacaugaucauuauggaugaagcccauuucacugacccuucuagcaucgccgcucguggguacauaaguacccgggugggaaugggcgaggcggcagccauuuuuaugacagcuaccccgcccgguuccguugaagccuucccacagagcaaugcagugauccaggaugaggaaagagacauuccugagaggucuuggaacucaggguaugaguggaucacugauuuucccggaaaaacagucugguucgugccauccauaaagaguggcaaugacauugccaacugucugcgcaagaauggcaaacgaguuauccagcuuagcagaaagaccuuugauacggaauaccagaaaacuaagaacaacgacugggacuauguggucacaaccgauaucucggagaugggggcuaauuuccgggcggacagggugauugauccucgccguugccuaaaacccguaauccugaaggacggaccagaaagagugauuuuggccgguccgaugccuguuaccgucgcaucugcugcccagcggaggggccgcauagggcgaaaccacaauaaggagggagaucaguacaucuacaugggccagcccuuaaacaaugacgaggaucacgcacauuggacugaagccaaaaugcugcucgacaacauuaauacaccagaggguaucauccccgcucuguuugaaccugagagagaaaaguccgccgcgauugauggggaguaucggcuuaggggcgaggcacgcaaaaccuucguggaacugaugagaaggggagaccucccagugugguugagcuacaaggucgccucagagggcuuccaauauagugaucggcguuggugcuuugacggggaacgcaacaaucagguucuggaggaaaacauggauguggagauauggacaaaagagggagaacgaaagaaacuaagacccagguggcuggacgcucggacuuacucugacccucucgcccuucgcgaguucaaggaauuugcugcagguagaagguccguaagcggcgaucugaucuuagagauugggaaguugccgcagcaccugacgcagcgggcccaaaaugcucucgacaaccuggugaugcuucauaauucagaacagggaggccgagccuauagacacgcaauggaggagcugccagauaccaucgaaacacucauguugcuggcguuaauugccguccuaacugguggggugacccuguucuuucucaguggccgcggacuuggcaaaacaagcaucgggcuguuguguguuauggcuuccucugugcugcucuggauggccagcgucgagccccacuggauagcagcuuccaucauucuggaguucuuucuuaugguacuccugaucccugagcccgacaggcagcggaccccacaggauaaccaauuggccuacgugguuauuggacuguuauucaugauccuaacuguggcagccaaugagaugggucugcucgaaacgaccaagaaagaccuuggcauagggcaugucgcuguggagaaccaccaucacgcgacaaugcuggaugucgacuugcauccugccucagcauggacucuguaugcuguggccaccacaauuaucacccccaugaugcgucacacuauugaaaacacaacggccaauaucucucucaccgcaauagcuaaccaggccgcgauccugaugggacuugauaagggcuggccaauuaguaaaauggacaucgguguuccuuuacuggcucucgggugcuacagccaggugaauccguugacucugacagccgcaguacuaaugcugguggcccacuacgcuauuaucggccccggacuccaagcaaaggccaccagagaggcgcagaagaggaccgcugccggcauaaugaaaaacccaacagucgaugggauuguugcaaucgaccuugauccuguggucuaugacgccaaguuugaaaaacagcugggacagaucauguugcugauucucuguacuagccaaauccuguuaaugcgcacgaccugggcucuuugcgaguccauaacacuggccacuggcccccucaccacacuaugggaggguucuccagggaaguucuggaauaccacuauugcagugucaauggcuaacaucuuucggggaagcuaccuggccggcgcggguuuggccuucucccugaugaaaagucucggcgggggacgaagaggcacgggggcacagggagaaacacuuggcgagaaguggaagaggcagcugaaucaguugucuaaaagcgaauuuaacauuuauaagcgcucagguaucauggagguagaccgguccgaagcuaaagaggggcugaagagaggagagaccacucgucaugccgugaguaggggcaccgcaaaacuccggugguucguugaacgcaauuuagugaagccugaggguaaggucauagaucugggcugugggcgaggaggcuggagcuacuauugcgcugggcuuaaaaaggugacagaagucaaaggauacacuaagggcggucccgggcacgaggaaccgaucccaauggccaccuauggauggaaccuggugaaacuacauucuggcaaggacguuuucuuuacaccucccgagaaaugugauacgcuccugugcgacauuggcgaguccucaccaaaucccaccaucgaagaggggagaacuuugaggguacugaagaugguggaaccuuggcuccggggaaaccaauucuguauuaagauccuuaauccguacaugcccagcgucguggagacacuggagcagaugcagcgcaaacacgguggcauguuaguuagaaacccacugucgagaaauucuacccacgaaauguacugggugaguugcgggacuggaaacauugucuccgccgugaauaugacaagccgaauguugcucaaccgguuuaccauggcgcaucguaagccuacguaugagagagauguagaccugggcgcugguacccgccacguggcaguugaacccgaggucgccaaccuagauaucauagggcagaggauugaaaauaucaaacaugagcacaagucaacauggcauuacgacgaggauaacccuuauaaaacuugggcuuaccacggauccuaugaagugaagccaucuggcagcgccaguuccauggugaauggcgucguuaaacuucugaccaaacccugggacgugaucccuaugguaacacaaauugcaaugacugauaccacaccauucgggcagcagcggguguuuaaggagaaagucgacaccagaacucccaaggccaaacgcggaacggcucaaauaauggaagugacagcgagguggcucugggguuuccugagccgaaacaagaagccgcggaucuguaccagagaggaauuuacuaggaaaguucgcucuaaugccgcaauuggcgcuguguucgucgacgagaaccaguggaacucagccaaggaggcaguggaagaugagcguuuuugggacuugguacagaaagaacgggagcugcacaagcaggggaaaugcgcaaccugcguuuacaacaugaugggaaagagagaaaagaaacucggcgaguucgguaaggcuaaagggaguagggccaucugguauauguggcuuggagcgcgcuuucuggaguucgaagcauuaggcuuuaugaaugaggaucauugguucucccgagaaaacagccugucuggcguggagggggagggauugcacaagcucgguuacauucugcgggacaucucgaaaauaccuggcgggaauauguacgccgaugacacagcuggaugggauacgagaaucaccgaagacgaucuacaaaacgaggccaggauuacugacaucauggaaccagagcaugcacuucuggcuacaucaauuuucaagcucaccuaucagaauaaagucgugcgcgugcagagacccgccaagaacggcacugucauggauguuaucagccggagggaccagcgugguuccgggcaagugggaacauacggccugaauaccuuuacaaacauggaagcucaguugauacgacagauggagagugagggcauuuucuuaccuucugaacuggagacucagaaccucgccgaacgcguacuugauuggcuggagaaguaugggguggaaagacuaaaacggauggcaaucagcggagacgacugugucgugaagccaaucgaugacagguuugcgaccgcccugacggcucucaaugauauggguaaaguucgcaaggacauuccccaaugggagccguccaaaggcuggaacgauuggcaacaggugccuuucugcucacaccacuuucaucaguugauaaugaaggacgggagagagaucgucgugcccugucggaaucaagaugaacugguaggaagggcccgaguuagucagggcgcagguuggucucuucgugagaccgcuugccuggggaaguccuacgcccagauguggcaacucauguauuuccacagacgcgacuuacggcuggcagccaacgcgauuuguuccgcugugccagucgauugggugccuacaucaaggacuaccuggagcauccaugcccaccaucaguggaugacaacugaagacauguugucuguuuggaauagaguguggauugaggaaaaccccuggauggaggauaaaacccacgucuccaguuggggagacgugccauaccugggcaagcgcgaggaccaguggugcggcagccucaucgggcuuacggcacgggccacaugggcuucgaauauacagguagccaucaaccaagugaggcgacugauuggaaaugaaaacuaucuagauuacaugaccuccaugaaaagauuuaagaaugagggugaccccgaaggcgcacugugguga

SEQ ID NO: 13628 - RNA, 9879 nt, Artificial Sequence
  derived and/or modified CDS sequence (opt3) from DENV-1__FJ410196__SS-prME
agcgugaccaugcugcucaugcuuaugcccaccgcacuggcuuuccacuugacuacgcggggaggggaaccucauaugaucgucuccaagcaggaaaggggaaaaucuuuacuguuuaagaccucagccgguguuaacaugugcacgcuaauugccauggaccucggcgaacugugugaagauacuaugaccuacaaaugcccacggauaacagagaccgaaccggacgauguggacuguuggugcaaugcgacugauacaugggugaccuaugggacguguagucagacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagggauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguauuagcaucaugaucgaagaggucaugcgcucgcgauggucccggcguaugcucaugaccgggacucuggccguguucuuucuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaaaaccacauuuucccugcacuaugcauggaagacuauggcuauggugcuuucaauugucagccucuucccccuguguuugaguaccacgucucagaaaacaaccuggcugccgguauuacucggcucccuggggugcaagccucuuacuauguuucugaucgccgagaauaagauauggggacgacgcagcuggccauugaacgaagguaucauggccgugggcauuguuucgauccuccugucaucucuacugaaaaacgaugugccccuugcugggccucucauugcaggaggcaugcugaucgccuguuacgucauaagugguuccagcgcggacuugucuuuagagaaggcugccgaggugagcugggaagaggaagcagagcauuccggggccucacacaauauucugguagaagugcaggaugacggaacaaugaaaaucaaggaugaggagcgggacgauacccucacuauccugcuuaaagcuacacuguuggcagucaguggcguuuauccccuaagcauuccagccacccuguucgugugguacuucuggcaaaagaaaaagcagagaucuggcgugcucugggacacgccuucacccccagaagucgagagggcggugcuggaugacgggauauaucguaucaugcagcgcggacuuuuaggucggagccagguuggcguagggguguuucaagaaaacgucuuccauacuauguggcacgugaccagaggagcuguucugauguaccagggcaagaggcucgagccgaguugggccagcgugaaaaaggacuugauuuccuacggugggggauggcgacugcagggcucuuggaauacaggcgaggaaguccaggugaucgcaguagagccugggaaaaaccccaagaauguccaaaccgccccaggaacauuuaaaacucccgaaggugaggugggcgcuauugcccucgauuucaagccugggaccucgggaagcccaaucguuaaccgggaaggcaagauagugggucuguaugggaauggagucgugacgacaucaggcacuuacguuuccgcaaucgcucaggccaaagcgagucaggagggcccccuuccugagauugaagacgagguguuucgcaagagaaaccugaccaucauggauuugcacccggggucuggaaaaacaaggcgguaucuaccagccauuguccgagaagcaaucaagagaaaacugcgcacccucauauuagcucccacuagggugguagccagcgagauggcugaagcacugaaggguaugccuauucguuaccaaaccacagccgugaaguccgagcauacgggcaaagagaucguugaccuuaugugccacgccacuuucaccaugcggcugcucucaccagucagagugcccaauuauaacaugaucauuauggaugaagcucauuuuacagacccuuucucuaucgcggcaaggggguacauaagcacccgcgugggaaugggcgaggccgcugccauuuuuaugacugcaacaccgcccgguagugucgaagccuucccacaguccaaugcuguaauccaggaugaggaacgagacauuccugagagaagcuggaacucuggguaugaguggaucaccgauuuucccggaaagacggugugguucguuccaucaauaaaauccggcaaugacauugcgaacuguuugcggaagaauggcaaaagggugauccagcugagucgcaagacuuucgauacagaauaccaaaagaccaaaaacaacgacugggacuacgucgugaccacugauaucagcgagaugggggccaauuuucgugcagacagaguuauugauccucggaggugccucaagcccgugauccugaaagacggaccagaacgcgucauucuugcugguccgaugccugugacaguagccucggcagcccagcgaagaggccggauagggaggaaccacaauaaggagggagaucaguauaucuacaugggccagccccuaaacaaugacgaggaucaugcucacuggaccgaagccaaaaugcuguuggacaacauuaauacaccagaggguaucauccccgcguuauucgaaccugagcgcgaaaagucugcagccauugauggggaguauagacugaggggcgaggcucggaagacuuuuguggaacucaugcgucgcggagaccugccaguuuggcuuuccuacaaagucgccagcgagggcuuccaauauucagaucgaagauggugcuuugacggggaaaggaacaaucaggugcuggaggaaaacauggauguggagauauggacgaaggagggagaacggaaaaagcuccgccccagaugguuggacgcuaggaccuacagugacccucuggcacuacgggaguucaaagaauuugccgcuggucgaagaucugucuccagcgaucugauccucgagauuggcaaacuuccgcagcaccugacacagcgcgcccaaaaugcauuagacaacuugguuaugcugcauaauucagaacaagggggaagggcguaucggcacgccauggaggagcucccagauacuaucgaaacccugaugcuucuggcucucauugccguguugacaggcgguguaacccuguucuuuuuaagugggcguggccuaggaaaaacuagcaucggccugcucugugugauggcauccucuguccuucuguggauggcuagcguggagccccauuggauagccgcauccaucauuuuggaguucuuucugaugguucuccugaucccugagcccgacagacagaggacgccacaggauaaccaacuugccuacguggucauugggcuccuguucaugaucuugaccguagcugcgaaugagaugggacuguuagaaacaacuaagaaggaccuagguauaggccacguggccguugagaaccaccaucacgcagcuaugcuggauguggaccuccauccugccucagccuggacccuuuacgcagucgcuacaaccauuaucacucccaugaugcgccacacaauugaaaacacgaccgccaauaucucucugacugcgauagcuaaccaggccgcaaucuugauggggcuggauaaaggauggccaauuaguaagauggacaucggcgugccucuccuggcccuugguugcuauucgcaggucaauccguuaacacugaccgcugcagugcucauguugguugcccauuacgcgauuaucgggcccggccugcaagcuaaagccacccgggaggcacagaagcgaacagccgcuggaauaaugaaaaacccaacuguggauggcauuguagccaucgaccuagauccuguggucuaugacgcaaaguuugaaaagcagcuggggcagaucaugcuccuuauucuguguacgagccaaaucuugcugaugagaaccacaugggcucucugcgaguccauaacucuggccaccggacccuuaacaacccuuugggagggcucuccagguaaauucuggaauacuacgauugcgguuucaauggccaacaucuucagggggagcuaccuggcaggagcuggccucgccuuuucccuaaugaagagucuggguggcgggcgccggggaacaggcgcacagggggaaaccuugggagagaaauggaagagacagcugaaucagcucucuaaaagcgaguucaacacuuauaagcguucaggcauuauggagguggacagguccgaagcuaaggagggucuuaaacgcggggaaaccacaaagcacgccgucagucggggaacugccaaacugcgaugguuuguggaaagaaauuugguaaagccugagggcaaagugaucgaucuggguuguggcagagggggauggagcuacuauugcgcgggccucaagaagguuaccgaagugaaaggguacacaaagggaggccccggucacgaggaaccgauaccaauggcuacguacggguggaacuuagucaaacugcauucuggaaaggacguguucuuuaucccucccgagaaaugugauacccuucugugcgacauuggcgaguccucaccaaaucccacuaucgaagagggccggacacuacgcguccucaagaugguggaaccuuggcugagagggaaccaauucuguauuaaaaucuugaauccguauaugcccagcguuguagagacccuggagcagaugcagaggaagcacggagguaugcucgugcgaaacccacuuucgagaaauucuacucaugaaauguacugggucaguugcggcacagggaacauuguguccgcaguuaauaugaccagccguaugcuguuaaacagauuuacgauggcccaccgcaagccuaccuaugagagggauguggaccugggagcuggcacacggcacgucgccguggaacccgagguagcaaacuuggauaucauaggucagagaauugaaaauaucaaacaugagcacaagucaacuuggcauuacgacgaggauaacccuuauaaaaccugggccuaccacggguccuaugaagugaagccaucuggaagcgcuaguuccaugguuaauggcgucgugaaacuccugacaaagcccugggacgugaucccuauggucacucaaauugcgaugaccgauacaaccccauucggccagcagcgcguuuuuaaggagaaaguggacacuaggacgcccaaggccaaacgagggacagcacaaauaauggaaguaaccgcuaaguggcuauggggauuccuuagccggaacaaaaagccgagaaucuguacuagggaggaauuuacccgcaaggugcguucuaaugccgcaauuggugccgucuucguggacgagaaccaguggaacucagcuaaagaggccguugaagaugagcgguuuugggaccuggugcauagagaaagggagcuccacaagcagggcaaaugcgcgacaugcgucuacaacaugauggggaagcgcgagaagaagcugggagaguucggcaaggcaaaagguagucgagccaucugguacaugugguugggggcucgguuccuggaguuugaagcccucggauucaugaaugaggaucacugguuuuccagagaaaacagccuuucuggcguggagggcgaggggcugcauaaguuaggauauauucugagggguaucucgaaaauaccuggcgggaauauguacgcagacgauacggcuggaugggacacccgcaucacugaagaugacuugcagaacgaggccagaauuacagauaucauggaaccagagcacgcucuccuggccaagucaauuuucaaacuaaccuaucaaaauaagguaguucgggugcagaggcccgccaaaaauggcacugucauggacgugaucagccgucgagaucagcgcgguuccggacaggugggaacauacggccuuaauaccuuuacaaacauggaagcgcaacugauaagacagauggagagugagggcauuuucucuccuagcgaacucgagacuccaaaccuggccgaacgggucuuggacugguuagagaaguaugggguugaaaggcugaagcgcauggcuaucuccggagaugacugugugguaaaacccaucgacgauagauuugccaccgcacucacggcucuuaaugacauggguaaggugcggaaagauauuccgcagugggagccuucaaagggcuggaacgacuggcagcaaguccccuucugcagucaucacuuucaccagcugauaaugaaagaugggagggagaucgugguuccaugucgaaaucaggacgagcuagugggacgugccagagucucucagggcgcagguuggagccugcgcgagaccgccugccucgggaaguccuacgcgcaaauguggcaguugauguauuuccaucggagggaucugagacuugcugccaacgcaauuuguucagccgugccuguagacuggauccccacaagccgcacuaccuggucuauucacgcucaucaccaguggaugacaacugaagauaugcuguccguuuggaaucggguguggaucgaggaaaacccauggauggaggacaagacccauauaaguagcuggggagauguccccuaccucggcaaaagggaggaccaauggugcggcucguuaaucgggcugacggcccgagcaacaugggcuaccaauauucagguggccaucaaccagguuagacgguugauuggaaaugaaaacuaccuggacuauaugacuuccaugaagagguuuaaaaaugagucugauccugaaggugcgcucugguga

SEQ ID NO: 13629 - RNA, 9879 nt, Artificial Sequence
  derived and/or modified CDS sequence (opt3) from DENV-1__FJ432734__SS-prME
agcgugaccaugcugcucaugcuuaugcccacagcacuggcuuuccacuugacuacgaggggaggggaaccucauaugaucgucuccaagcaggaaaggggaaaaucuuuacuguuuaagaccucagccgguguuaacaugugcacauuaauugccauggaccucggcgagcugugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuuggguucuccggcacccuggauucaccgugauugcucuguuucuggcacaugccaucggcacaucgauuacccagaagggcaucauauucauccucuuaaugcuggucacgccaucaauggcuaugcgcugcguggggauuggaagcagagauuuuguagagggucuuaguggcgccacuuggguugacguggucuuggagcacggguccugugugacaaccauggcgaaggauaaacccacucuggacaucgaauugcucaagacagaggugaccaacccugcaguccugaggaaacuuugcauugaagccaagaucucuaauacgaccacagauagccgguguccaacucaaggagaggcuacccugguugaagaacaggacgccaacuucgugugccgccgaacauuuguagauagaggcugggguaauggguguggauuguucggcaaaggcucccucauaacuugcgcaaaguuuaagugcgugaccaaacuggaggggaagauuguccaguacgaaaacuuaaaauauucagugaucguuacagugcacaccggagaccagcaucaagucgguaaugagaguacugaacacggcacgacagcuaccauuacuccccaggccccuaccacagagauccagcugaccgacuacggggcgcucacucuugauuguagcccaaggacaggacuggacuucaacgaaaugguguugcuaacgaugaaggagaaaucuuggcugguacauaagcagugguuucucgaucugccgcuucccuggaccuccggcgccucaacuagccaagagacauggaaucggcaggaccuguugguuaccuucaaaacagcacacgcuaagaagcaggaaguggucgugcucgguagucaagagggggccaugcacacugcucugaccggcgccacggaaauccagaccucuggaacaacuaccauuuuugcaggccauuuaaaaugccgucugaagauggauaaacuaacacucaaggggauguccuaugucauguguacuggaucguucaaacuggagaaggaaguggccgagacccagcacgguacgguucuugugcagauaaaguacgagggcacagacgcuccuugcaaaaucccauucucgacccaagaugaaaaggggguaacucagaacggacgcuugauuacagcgaaucccaucgucaccgacaaagagaagccugugaacauagaagcagagccacccuuuggcgagucuuauauuguuaucggugccggggaaaaagcucugaagcucuccugguucaagaaaggcucaaguaucggaaagauguuugaggccacugcaagaggcgccaggcggauggcuauucugggggauaccgccugggacuucggaagcaucgguggcguguuuacauccgucgggaaacuugugcaucagauuuucggaacggcauacggcguacuguuuucuggugugagcuggaccaugaagauagggaucggcguuuugcucacuuggcugggauuaaauucacgaaguacaucccugagcaugaccuguauugcggucggccuagugacacucuaccugggggugaugguccaggcugauucuggaugcguuaucaacuggaaaggccgcgaacuuaagugugguucagggaucuucgugacuaaugaggugcacaccuggacggaacaauauaaguuucaggccgacaguccgaaaagauugagcgcagccauuggaaaggcuugggaggagggcguaugcgguauaagguccgccacacggcuggaaaacaucauguggaaacagauuucuaacgagcucaaucauauccuguuagaaaacgacaugaagcugaccgucgugguuggcgauguggcagggauucuuggacagggcaaaaagaugauccgcccucaacccauggaguacaaauauucguggaaaagcugggggaaggcuaaaauaaucggagccgacgcgcagaauacuaccuucauuaucgauggcccaaacacaccugaaugucccgacgaucagagagccuggaauauuugggaggucgaggacuacgguuuugggauguucacuaccaacaucugguugaagcucagggauuccuauacacaggugugcgaccaccgucugaugucagcugcaauaaaagauaguaaggccguucacgcugacaugggauacuggauugaaucugagaaaaaugaaacguggaagcuagcccgggcauccuuuaucgaggugaagaccuguauuuggccaaaaucccauacucuguggucaaacggcguacucgaaagcgagaugaucauacccaagaucuaugguggcccuauuucucaacacaauuaccgaccaggguacuucacacagaccgcgggaccguggcaucugggcaaacuugaguuggauuucgaccugugcgaagggacuacagucgugguggaugagcacugcggaaacagaggccccuccuuaaggaccacgacugucaccgguaagaucauucacgaaugguguugccgcaguuguacacucccuccacugcgguuuagaggggaggacggaugcugguauggcauggagaucaggcccguuaaagaaaaggaggaaaaucuuguaaagagcaugguaucugccgguuccggcgagguggacucauucagucugggguugcucuguauaagcauuaugaucgaagaggucaugcgcucgcgauggucccggaaaaugcugaugaccggaacucuagcuguguuuuuccugcucaucaugggccagcugacauggaacgaucuuauucguuugugcaucaugguuggggccaaugcaucugacagaaugggaaugggcaccacauaccuggcuuuaauggccacuuuuaagaugaggccuauguucgcagugggucuccuguuucgccggcuuaccagcagagagguccugcuacucacgauugggcugucauugguggccaguguugaacugccaaacuccuuagaggaacucggagauggccuggcuaugggcauaaugauccuuaaacuguugacagacuuccaaucucaucagcucugggcgacccugcuaagccugacuuuuauuaagaccacauucucccuucacuaugccuggaaaacuauggcaauggugcucucaaucgucagccuguuucccuugugucugaguaccacgucucagaagacaaccugguuaccgguacuccuggggucccuuggaugcaagccucugacuauguucuugauugcugagaauaaaaucugggguagaaagagcuggccacucaacgaaggcauaauggccguggggaucguuucgauucugcuaucaucucugcuuaaaaacgaugugccccucgccggaccucugaucgcuggcgguauguugauugcauguuacgucaucaguggguccagcgccgacuuaucucuggagaaggcggcugaggugagcugggaagaggaagccgagcauuccggagcaucacacaauauacucguagaagugcaggaugacggcacaaugaaaauuaaggaugaggagcgagacgauacccugacuauccuucugaaagccacauugcuagcugucaguggcguuuauccccugagcaucccagcaacccucuuugugugguacuucuggcaaaagaagaaacagcgcucuggggugcugugggacacgccuucacccccagaagucgagcgggccgugcuugaugacggaauuuauagaauaaugcagagggguuuacugggccguagccagguugggguaggaguguuccaagaaaacgucuuucauacuauguggcacgugacccgcggcgcgguucucauguaccaggguaagcgguuggagccgaguugggcuagcgugaaaaaggaccugaucuccuacgggggaggcuggagacucaggggcucuuggaauacaggggaggaaguccaggugauugccguagagccuggcaaaaaucccaagaauguccagaccgcaccagguacauucaagacucccgaaggcgaggugggggccaucgcucuggauuuuaaaccuggaaccucgggcagcccaauuguuaaccgagaagguaagaucguggggcuuuauggaaauggcgucgugacgacaucaggcacuuacguuuccgccauagcacaagcuaaagccagucaggaggggccccugccugagaucgaagacgagguguuccggaagcgcaacuugaccauuauggaucuacacccgggaucugguaaaacaagaagguaucugccagcgaucguccgggaagccauuaagcgaaagcucagaaccuuaauccuggcacccacucgcgugguagcuagcgagauggccgaagcucuuaaaggcaugccuauaagguaccagaccacagcagugaaguccgagcauacggggaaagagauuguugaccugaugugccacgccacuuuuaccaugcgucucuugucaccaguccgggugcccaauuauaacaugaucaucauggaugaagcccauuucacagacccuucuagcauugcugcgagaggauacaucaguaccagggugggcaugggugaggcagccgcuauauuuaugacugccacaccgcccggguccgucgaagcauucccacaaagcaaugccguaauucaggaugaggaacgcgacaucccugagcgaucuuggaacucaggauaugaguggauuaccgauuuucccggcaagacggugugguucguuccauccaucaaaaguggcaaugacauagcuaacugucugagaaagaaugggaagcgggugauucagcucagcaggaaaacuuuugauacagaauaccagaagaccaaaaacaacgacugggacuacgucgugaccacugauaucucggagaugggagcgaauuuccgcgccgaccguguuaucgauccuagacggugccugaagcccgugauucuuaaagacgguccagaaagggucauccuagcaggcccgaugccugugacaguagcuucugccgcacaacgccgagggagaauuggacggaaccacaauaaggagggcgaucaguauauauacaugggucagccccugaacaaugacgaggaucaugcccacuggaccgaagcuaagauguuguuagacaacaucaauacaccagaggggauuauccccgcccuguucgaaccugagagggaaaaauccgcggcaguggauggcgaguaucgccucagaggagaggccaggaagacuuuuguugaacugaugcggcguggcgaccuuccagucuggcugagcuacaaaguggcuucagagggguuccaguauagugaucgccgauggugcuuugacggagaaagaaacaaucaagugcucgaggaaaacauggaugucgagaucuggacgaaggagggugaaaggaaaaaguugcggccccgcuggcuggacgccagaaccuacucugacccucuagcucugagggaguucaaagaauuugcagccggccggcgauccguuagcggggaucucauucuugagauaggaaagcugccgcagcacuuaacacagagagcucagaaugccuuggacaaccuggugaugcuccauaauucagaacaaggcggucgcgcauauaggcacgcgauggaggagcugccagauacuaucgaaacccuuaugcugcucgccuugauugcuguacugacagggggcgugaccuuauucuuucuaaguggacggggccuggggaagacuagcaucggacuccuuugugucauggccuccucugugcuguuguggauggcaagcguugagccccauuggauugcugccuccaucauacuggaguucuuucucauggugcugcuuaucccugagcccgaccgucagagaacgccacaggauaaccagcucgcauacgucguaauuggucuguuguucaugauccugaccguggccgcuaaugagaugggcuuacuagaaacaacuaaaaaggaccuggggauuggacacguugcgguggagaaccaccaucacgccgcaaugcucgaugucgaccuucauccugcuucagccuggacccuguacgccguggcaacaaccaucauaacucccaugaugaggcacacaauugaaaacacgaccgcuaauaucucuuugacugccauugcgaaccaagcugccauccugaugggccucgauaaagguuggccaauaaguaagauggacaucggggucccucugcuugcauuaggcugcuauagccaggugaauccgcugacacucaccgccgcuguuuugaugcugguggcacauuacgccauuaucggacccggccuacaggcgaaagcuacccgcgaggcccaaaagcggacagcagccgggauuaugaagaacccaacuguagauggaaucguggcuauagaccuggauccugucguuuaugacgccaaauuugaaaagcagcucggccagauuaugcuucugaucuuguguacgagccagauccugcucaugcgaaccacaugggcacugugcgaguccauuacuuuagcuaccgguccccuuacaacccugugggaggggucuccaggaaaauucuggaauacuacgaucgccgugucaauggcgaacauauuuagaggcagcuaccucgccggugcaggccuagcuuucucccugaugaagagucuagggggaggcaggcgcgggacaggagcccaaggcgaaacccugggugagaaauggaagcggcagcucaaucagcuuucuaagagcgaguucaacacuuauaaaagaucagggauuauggaggucgaccguuccgaagcaaaggagggacugaaaaggggcgagaccacaaagcacgcugugagucgggguacugccaaauugcgcugguuuguagaacgaaaucuggugaagccugagggcaagguuaucgaucucggguguggaagaggcggguggagcuacuauugcgccggacuaaagaaggugaccgaagucaaaggcuacacaaagggugggcccggacacgaggaaccgauuccaauggcgacguacggcuggaaccuggugaaacuucauucuggcaaggacgucuucuuuaucccucccgagaaaugugauacccugcuaugcgacauaggggaguccucaccaaaucccacuaucgaagagggaaggacacuccgggugcugaagaugguugaaccuugguugcgcgguaaccaguucuguauuaagauccugaauccguauaugcccagcguaguggagacccucgagcaaaugcagagaaaacacggcgggaugcuugucaggaacccacugucgcgaaauucuacucaugaaauguacugggugaguugcggaacaggcaacauuguuuccgcugugaauaugaccagccggauguuacugaaccguuuuacgauggcacacagaaagccuaccuaugagcgcgaugucgacuuggguacagggacuaggcacguggccguagaacccgagguggcuaaccucgauaucauuggacagcggaucgaaaauauaaaacaugagcacaagucaaccuggcauuacgacgaggauaacccuuauaaaacaugggccuaccacggcuccuaugaaguuaagccaucuggcagcgcaaguuccauggucaaugggguggugaagcugcuaacuaaacccugggacgucauuccuaugguuacccagaucgccaugacagauaccacuccauucggacaacagagaguguuuaaggagaaaguagacacgcgcacacccaaggcuaaaagggguaccgcgcagaucauggaagugacugcccgauggcuuuggggcuuccugagccggaacaagaagccgagaauuuguaccagggaggaauuuacacgcaaaguccguucuaaugcagcuauaggggccguguucguugacgagaaccaauggaacucagcaaaggaggccguggaagaugagcgguuuugggaccucguccauagagaaagggagcugcacaaacagggaaagugcgcuacgugcguguacaacaugaugggcaaacgcgaaaagaaguugggugaguucgggaaagccaagggaagucgagcgaucugguacauguggcugggcgcacgguuucucgaguucgaagcccuuggcuucaugaaugaggaucacugguuuuccagagaaaacagccugucugggguagagggagaggguuuacauaaacugggcuauauuuugagggacaucucgaagauuccugggggaaauauguacgcugaugacaccgccggcugggauacucgcaucacagaagacgaucuccagaacgaggcaaaaauaaccgacaucauggaaccagagcacgcucugcuagccaaggcuauuuucaaacuuacuuaucagaauaagguugugagaguccaacggcccgccaagaacgguacagugauggaugugaucucaaggcgugaccagcgagggagcggacaggucggcaccuacggccugaauacauuuacuaacauggaagcacagcucauucgccaaauggaguccgaggggaucuucaguccuucugaacuggagaccccaaacuuggcggaaagagccuuagauuggcuggagaaauauggaguugaacggcucaagaggauggcuauaagcggugacgacugugugguaaaacccauugaugaccgcuuugccacggcacuuaccgcucugaaugauaugggcaaggugagaaaagacaucccgcagugggagccuuccaagggguggaacgauuggcagcagguccccuucugcucacaucacuuucaccaacuaaucaugaaggacggacgggagauugugguuccauguaggaaucaggaugaacuggugggccgagcccgugucagucagggugcaggguggucucucagagagacagccugcuugggaaaaagcuacgcgcagauguggcaacugauguauuuccaucgccgggaccuuaggcuggcugccaacgcaauauguuccgccgugccuguagauuggguucccacuucaagaaccacauggagcauccacgcucaucaccaguggaugacuaccgaagacaugcucucuguguggaaucgcgucuggauugaggaaaacccauggauggaggauaagacgcauaucuccaguugggaggacgugcccuacuuaggcaaacgggaagaccaguggugcggcagccugauuggguugacagccagggcaaccugggcuacuaauauccaaguugccauaaaccaggugcgaagacugaucggaaaugagaacuaccucgauuauaugacaucgaugaagcgguuuaaaaaugaaaccgacccugagggugcgcuuugguga

SEQ ID NO: 13630 - RNA, 9879 nt, Artificial Sequence
  derived and/or modified CDS sequence (opt3) from DENV-1__FJ432735__SS-prME
agcgugaccaugcugcuaaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggauuuaucggauaaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuaugggaauggagucgugacgacaaguggcacuuacguuucugcaauagcucaagccaaagcgagccaggagggcccacugcccgagaucgaagacgagguguucaggaagcgaaaccuuaccauuauggaucugcacccuggguccggaaagacacggcgcuauuugccggccaucgucagagaagcaauuaaaaggaagcuacggacccugauccucgcuccaacucgagugguagccucagagauggcugaagcauuaaaagguaugcccauaagauaccagaccacagccgugaagucugagcauacgggcaaagagauuguugaccugaugugccacgccacuuuuaccaugcgccuucugagcccugucagggugccaaauuauaacaugaucaucauggaugaagcucauuucacagaccccaguuccauugcggcacguggguacaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguaugaguggauuaccgauuuuccuggaaagacggugugguucguucccagcaucaagucgggcaaugacauagcgaacugucuccgcaaaaauggcaagcgagugauucaguugucuagaaaaacuuucgauacagaauaccagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccacaauaaagagggagaucaguauauauacaugggccagccucuuaacaaugacgaggaucaugcucacuggaccgaagccaagaugcuacuggacaacaucaauacacccgaggguauuaucccagcguuguucgaacccgagagagaaaaaucagcagccaucgauggggaguaucgguuaaggggcgaggcucgcaagacuuuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauuuggacgaaggagggagaacgaaagaaacugagaccaagguggcucgacgcucggaccuacagcgaccccuuggcacugcgcgaguucaaagaauuugccgcugguagaaggucagucaguggcgaucuaauacuggagaucgggaaacucccucagcaccuuacacagaaggcccagaaugcacuggacaacuuaguuauguugcauaauagcgaacaaggaggccgggcguaucgacacgccauggaggagcugccggauacuauugaaacccucaugcugcuugcucugaucgccgugcucacaggugggguaaccuuguucuuucuguccggcagaggauuaggcaaaacuucuauugggcuacugugugugauggcaagcuccguccuccuuuggauggcuucaguggagccacauuggaucgccgcaucuauaauccuggaguucuuuuugaugguucugcucauucccgagccugaccgccagaggacgccccaggauaaccagcuggccuacguggucaucggacuucucuucaugauucugaccguagcugcgaaugagauggguuugcuggaaacaacuaagaaagacuuaggcaucgggcacguggccguugagaaccaccaucacgcagcuaugcuagauguggaccugcauccagccagugccuggacccucuacgcagucgcuacaaccauaauuacuccuaugaugcggcacacaaucgaaaacacgaccgccaauauuucgcuuacugcgaucgcuaaccaagccgcaauacugaugggauuggauaagggcuggcccaucagcaagauggacauuggugugccacugcucgcccuggggugcuauucccaggucaauccucuuacauuaaccgcugcagugcugaugcucguugcccauuacgcgaucauuggcccgggauugcaggcuaaagccacccgugaggcacaaaagagaacagccgcuggcaucaugaaaaaccccacuguggaugggauaguagccauugaccuggauccaguggucuaugacgcaaaguuugaaaaacagcuaggacagaucaugcugcucauccuuuguacgucucagauucuguugaugaggaccacaugggcucugugcgagucaaucacucucgccaccggcccucugacaaccuuaugggaggguagccccgggaaguucuggaauacuacgauagcgguuuccauggccaacauuuuccgcggaaguuaccuugcaggcgcuggucuggccuuuucucucaugaaaagccuaggcgggggacggcgaggcacaggggcacaaggagaaacccugggcgagaaauggaagagacaguugaaucagcugucaaaauccgaguucaacacuuauaagaggagugguaucauggagguggaccgcagcgaagcuaaagaggggcucaagcggggagagaccacaaagcacgccgucucuagaggcacugccaaacuucguugguuuguggaaaggaaucugguaaagccagaggguaaagugauugauuugggcugugggcggggaggcugguccuacuauugcgcggggcugaagaaaguuaccgaagugaagggauacacaaaaggcgguccugggcacgaggaacccaucccgauggcuacguacggauggaaccucgucaaguuacauucaggcaaggacguguucuuuauaccaccugagaaaugugauacccugcuuugcgacaucggcgagagcucgcccaauccaacuauugaagaggggcgcacacugcgaguccuaaagaugguggaacccuggcucagaggaaaccaguucuguaucaaaauucugaauccuuauaugccgucuguuguagagaccuuggagcaaaugcagaggaagcacgguggcaugcuggugcggaacccccucagucgcaauuccacucaugaaauguacugggucagcugcgggacaggaaacaucgugucagcaguuaauaugaccuccagaaugcuucugaacagguuuacgauggcccaccgaaaaccaaccuaugagcgggauguggacuuaggcgcugguacacgucacgucgccguggaaccugagguagcaaaccuggauauuaucgggcagagaauagaaaauauuaagcaugagcacaagucuacuuggcauuacgacgaggauaaccccuauaaaaccugggccuaccacggaagcuaugaagugaagccuaguggcuccgcuagcucuaugguuaauggcgucgugaaauugcucacaaagccaugggacgugauccccauggucacucagaucgcgaugaccgauacaaccccuuucgggcaacagcgcguuuuuaaagagaagguggacacuaggacgccaaaggccaaacggggaacagcacagauuauggaaguaaccgcuaaguggcugugggguuuccuaucaagaaacaaaaagccccgcauauguacuagggaggaauuuacccgaaaagugcggaguaaugccgcaaucggcgccgucuucguggacgagaaccaauggaacuccgcuaaggaggccguugaagaugagagauuuugggaccuugugcauagggaacgcgagcugcacaagcaggggaaaugcgcgacaugcgucuacaacaugaugggaaagcgugagaagaagcucggcgaguucgguaaagcaaaggggagccgggccauuugguacauguggcugggagcuagauucuuggaguuugaagcccugggcuucaugaaugaggaucacugguuuucuagggaaaacucgcucucaggcguggagggggagggacuucauaaacuggguuauaucuuacgcgacauuagcaagaucccgggcgggaauauguacgcagaugacacggcuggaugggauacccgaauaacugaagacgaucugcagaacgaggccaagaucacagacauuauggaaccugagcacgcuuugcucgccaaauccaucuucaagcugaccuaucagaauaaaguaguucgggugcaaagaccagcaaagaacggcacugucauggaugugauuaguaggcgcgaccagagagguucuggacaggugggaacauacggccuaaauaccuuuacaaacauggaagcgcagcuuauccggcaaauggagagcgagggcauauucucccccucagaacuggagacuccuaaccucgccgggaggguccuggauugguuggaaaaacauggaguugagcguuuaaagcgaauggcuauuaguggugacgacugugugguaaagccaaucgaugaccgcuuugccaccgcacugacggcucucaaugauaugggcaaagugagaaaggacaucccccagugggaaccgucuaaaggguggaacgauuggcagcaggucccuuucugcagccaccacuuucaucaacuuauuaugaaggacggacgggagauagugguucccuguaggaaucaggaugagcuggugggccgcgccagagucucccagggugcaggguggucacuacgggaaaccgccugccugggaaaaagcuaugcgcagauguggcaacucauguacuuccacaggcgagacuugcgucuggcugccaacgcaaucuguucugccgugccaguagauuggguuccuacauccagaacuaccuggaguauucaugcucaccaucaguggaugacaacugaggacaugcuuagcguguggaaucgcgucuggaucgaagagaaccccuggauggaagauaagacccacauuucguccuggggcgacgugccauaucugggcaagcgggaggaccaguggugcgggucucucaucggauuaacggccagggcaacaugggcuaccaauauacaaguugccaucaaccaggugagacgccugauugguaaugagaacuacuuggauuacaugacuucaaugaaacgguuuaagaaugaaagcgaccccgagggcgcgcugugguga

SEQ ID NO: 13631 - RNA, 9879 nt, Artificial Sequence
  derived and/or modified CDS sequence (opt3) from DENV-1__FJ432736__SS-prME
agcgugaccaugcugcucaugcuuaugcccacagcccuggcuuuccacuugacuacgagaggaggggaaccucauaugaucgucuccaagcaggaaaggggaaaaucuuuacuguuuaagaccucagcggguguuaacaugugcacacugauugccauggaccucggagagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuauucaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaagcugaccgugguagucggcgauguggcugggauccuuggacagggcaaaaagaugauacgcccucaacccauggaguacaaauauucguggaaaagcugggggaaggccaagaucauuggagcggacgcccagaauacuaccuucaucauugauggcccaaacacaccugaaugucccgacgaucagagagcuuggaauaucugggagguugaggacuacgguuuugggauauucacuaccaacauuugguugaagcucagggauuccuauacacaggugugcgaccaccgucugaugucagcagccaucaaagauaguaaggcuguccacgccgacaugggauacuggauugaaucugagaaaaaugaaacguggaagcuagcacgggcgagcuuuaucgaggugaagaccuguauauggccaaaaucccauacucuguggucaaacggcguucucgaaagcgagaugaucauucccaagaucuaugguggcccuauuucucaacacaauuaccgaccaggguaccugacacagaccgccggaccguggcaucuuggcaaauuggagcuggauuucgacuuaugcgaagggacuacagugguagucgaugagcacugcggaaacagaggccccucccucaggaccacgacugugaccgguaagaucauacacgaaugguguugccgcaguuguacacugccuccacuucgguucagaggggaggacggaugcugguauggcauggagauuaggcccgugaaagaaaaggaggaaaaucuggucaagagcaugguuucugcugguccuggcgagguggacuccuuuucauuggggcuccuguguaucaguaucaugauugaagagguaaugcgcagccgauggucgcggaaaaugcuaaugaccggaacucuggccguguucuuucuccugaucaugggccagcuuacauggaacgauuugauucgucugugcauaauggucggggcaaaugcuuucgacagaaugggaaugggcaccacauacuuagcccucauggcaacuuuuaagaugaggccaauguucgccgugggucugcuuuuucgccggcugaccuccagagagguucuacuccugacgaucggguugucucugguggcuagcgucgaauuacccaacucacucgaggaacugggagauggccuugcgaugggcauuaugauccugaaauugcucacagacuuccaaagucaucagcugugggccacccuacugucccuuacuuuuauuaagaccacauucucucuccacuaugcauggaaaacuauggcuauggugcugagcaucguuuccuuguuuccgcuguguuuaucaaccacgagccagaagacaaccuggcucccugugcugcuugggagucugggaugcaagccauugacuauguuccucauagccgagaauaaaaucugggguaggaagucuuggccccugaacgaaggcauuauggccgucgggaucguauccauucuacugagcucgcuucucaaaaacgaugugccucuggcuggacccuugaucgcaggcgguauguuaauagccuguuacguuauuucagggucuagugcggaccugucccucgagaaggcugccgaggugagcugggaagaggaagcagagcauucuggagccagccacaauauccuggucgaagugcaggaugacggcacaaugaaaaucaaggaugaggagcgagacgauacccuuacuauucuguugaaagcuacacuacuggcaguauccggcguguauccacucucaauaccugccacccuguuugucugguacuucuggcaaaagaagaaacagcgcagugggguucuuugggacacgcccagcccaccggaaguggagcgggcgguguuagaugacggaaucuauagaauuaugcagaggggucugcucggccguucucaggucggggugggaguuuuccaagaaaacguauuucauacuauguggcacgugacccgcggcgcugucuugauguaccaggguaagcggcuggagccuuccugggccucagugaaaaaggaccucaucaguuacgggggaggcuggagacugaggggcagcuggaauacaggggaggaaguucaggugauugcagucgagcccggcaagaacccaaagaaugugcagaccgcccccgguacauucaagacuccugaaggcgagguaggggcuaucgcccuugauuuuaaaccaggaaccuccggcucucccauagucaaccgagaagguaagaucguggggcuguauggaaauggcguugugacgacaucgggcauuuacgucagcgcaaucgcucaagccaaagcgucacaggaggggccuuugccggagauugaagacgagguguuccggaagcgcaaccuaacuaucauggaucugcacccaggauccgguaaaaccagaagguaucuccccgccauaguucgggaagcaauuaagcgaaaguuaagaacacugauccuugcuccuacccgcguggucgccagugagauggcugaagcacugaaaggcaugccaaucagguaccagacuaccgccgugaagucugagcauacagggaaagagauuguagaccucaugugccacgccacguuuacuaugcguuugcugagccccgugcggguuccuaauuauaacaugaucauaauggaugaagcucauuucaccgacccguccucaauugcggcaagaggauacaucucuacaagggucggcaugggugaggccgcugccauuuuuaugaccgcaacucccccagggagcguggaagccuucccucaaaguaaugcugugauccaggaugaggaacgcgacauacccgagcgauccuggaacagcggacacgaguggauuacagauuuuccaggcaagaccgucugguucguaccuucuaucaaaucaggcaaugacaucgcgaacugucucagaaagaaugggaagcgggugauucagcuguccaggaaaacguuugauacugaauaucagaagacuaaaaacaacgacugggacuacguugugaccaccgauaucagugagaugggagccaauuuccgcgcagaccgugucauugaucccagacggugccuuaagccagugauacuaaaagacgguccggaaaggguuauccuggcuggcccuaugcccgugacugucgccagcgcagcccaacgccgagggagaauuggacggaaccauaauaaggagggcgaucaguacaucuauaugggucagccauugaacaaugacgaggaucacgcucacuggacagaagccaagauguuacuggacaacaucaauacccccgaggggauuauaccugcacucuucgaaccagagagggaaaaaucggcagccguggauggcgaguaccgccugagaggagaggcuaggaagacauuuguagaacuuaugcggcguggcgaccugcccguguggcucucuuauaaaguugccuccgagggguuccaguacagcgaucgccgauggugcuuugacggagaaagaaacaaucaagucuuggaggaaaacauggauguggagaucuggacuaaggagggugaaaggaaaaagcugcggccucgcuggcuagacgcuagaacguauucagacccgcuggcacucagggaguucaaagaauuugccgcuggccggcgaagugugucuggggaucuuauucuggagaucggaaaguuaccacagcauuugacccagagagcccagaaugcacuggacaaccucgucaugcugcacaauuccgaacaaggcggucgcgcguacaggcaugccauggaggagcuucccgauacaauugaaacucugaugcucuuggcucugaucgccguuuuaaccgggggcgugacacuauucuuucugagcggacggggccucgggaagaccucaauaggacuucuguguguaauggcaaguagcguguugcuguggauggcuuccgucgagccucacuggaucgccgcaucuauuauccucgaguucuuucugauggugcuucucauucccgagccagaccgucagagaacuccucaggauaaccagcuggccuauguugugaucgguuugcuguucaugauauuaacggucgcugcgaaugagaugggccuacuggaaaccacuaaaaaggaccucgggauuggacacguagccguggagaaccaucaccaugcagcuaugcuugauguugaccugcaccccgccagcgccuggacuuuguacgcaguggcuaccacaaucauuaccccaaugaugaggcauacuaucgaaaacacaacggccaauauaucccugaccgcgaucgcuaaccaagccgcaauucucaugggccuggauaaagguuggccuaucucaaagauggacauuggggucccgcuuuuagcccugggcugcuacucucaggugaauccccucacuuugacagcugcaguccugaugcuaguggcccacuaugcgaucauaggaccaggccugcaggcuaaagccacccgcgaggcacaaaagcggaccgccgcugggauuaugaagaacccuacaguugauggaaucguggccaucgaccucgaucccguaguguacgacgcaaaauuugaaaagcagcuuggccagauuaugcuguugauccuguguacaagucagauacuccugaugcgaacgaccugggcuuuaugcgagucgauuacacuugccacugguccacugaccacacucugggaggggagcccuggaaaauucuggaauaccacuaucgcggucuccauggccaacauuuuuagaggcucuuaucuagcaggagcuggccuggccuucucauugaugaaaagccuaggggguggcaggcgcgggacgggagcacaaggcgaaacacucggugagaaauggaagcggcagcuuaaucagcuguccaagagugaguucaacaccuacaaaagaucugggaucauggagguugaccguagcgaagcuaaggagggauugaaaaggggcgagacuaccaagcacgccgugucacgggguacagccaaacugcgcugguuugucgaacgaaaucucgugaagcccgagggcaagguaauagauuuaggguguggaagaggcgggugguccuauuacugcgcgggacugaaaaaggugacugaaguuaaaggcuauaccaagggugggccgggacaugaggaaccaaucccuauggcuacauacggcuggaaccuugugaaacugcacaguggcaaggacgucuucuuuauucccccagagaaaugugauacgcuacucugcgacaucggggagagcucucccaauccuaccauugaagagggaaggacucugcggguguugaagauggucgaaccguggcugcgcgguaaccaguucuguaucaagauucucaaucccuacaugccauccgugguugagacacuugagcaaaugcagagaaaacauggcgggaugcugguaaggaacccuuuaucacgaaauagcacccacgaaauguauugggugucgugcggaacuggcaacaucgucucugcagugaauaugacaagucggaugcuguugaaccguuuuaccauggcccacagaaagcccacguacgagcgcgauguugaccucgguaccgggacaaggcauguggcugucgaaccugagguggccaaccuggauauaauuggacagcggaucgaaaauaucaaacacgagcauaaguccacuuggcacuaugacgaggauaacccauacaaaaccugggcauaucauggcagcuacgaaguaaagcccucaggcuccgccucuagcauggugaaugggguugucaagcuacuuacaaaaccuugggacgugauuccaauggugacucagauagcuaugaccgauacaacccccuucggacaacagagagucuuuaaggagaaaguugacacucgcacgccgaaggcgaaaagggguacagcccagaucauggaagugaccgcacgauggcuguggggcuuccucagucggaacaagaagccuagaauuuguacuagggaggaauuuacccgcaaaguacguuccaaugcugccaucggggcaguguucgucgacgagaaccaauggaauagcgccaaggaggcuguggaagaugagcgguuuugggaccugguucacagagaaagggaguugcacaaacagggaaagugcgccacaugcguguauaacaugaugggcaaacgcgaaaagaagcugggugaguucgggaaagcgaagggaucucgagcaauuugguacauguggcucggcgcccgguuucuugaguucgaagcucugggcuucaugaaugaggaucauugguuuucaagagaaaacaguuuauccggggucgagggagagggucugcacaaauugggcuacauccucagggacauaagcaagaucccagggggaaauauguaugccgaugacacggcaggcugggauacccgcauuacugaagacgaucugcagaacgaggcuaaaaucacagacauuauggaacccgagcaugcccuacuugcuaaggccaucuucaaacugaccuaccagaauaaggugguaagaguucaacggccugcaaagaacgguacugugauggaugucauaucuaggcgugaccagcgagggucgggacaggugggcacauauggccucaauaccuuuacaaacauggaagcgcagcugauucgccaaauggagucagaggggaucuucagcccauccgaauuggagacucccaacuuagccgaaagagcucuggauuggcucgagaaauacggaguggaacggcuuaagaggauggccaucaguggugacgacugugucguuaaaccgauugaugaccgcuuugcaaccgcucugacggcccuaaaugauaugggcaaggugagaaaagacauaccucagugggagcccucuaagggguggaacgauuggcagcagguaccauucugcagccaccacuuucaucaacugaucaugaaggacggacgggagauuguggucccuuguaggaaucaggaugaacucgugggccgagcacguguuucccagggugccggguggucauugagagagaccgcgugccugggaaaaaguuaugcucagauguggcaacuuauguacuuccaccgccgggaccugaggcucgccgcaaacgccaucuguucugcugugcccgucgauugggugccaacaagcagaacuaccugguccauucaugcccaccaucaguggaugacaacugaagacauguuaucaguauggaaucgcguuuggaucgaggaaaaccccuggauggaggauaagacccacauaagcucuugggaggacgugccuuaucugggcaaacgggaagaccaguggugcggcuccuugaucgggcugacggcaagggcuacaugggccaccaauauucaagucgcgaucaaccaggugcgaagacucauuggaaaugagaacuaccuugauuacaugacaaguaugaagcgguuuaaaaaugaaagcgacccagagggugcucugugguga

SEQ ID NO: 13632 - RNA, 9879 nt, Artificial Sequence
  derived and/or modified CDS sequence (opt3) from DENV-1__FJ410198__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgggagagccgugcuggaugacggaauauauaggaucaugcagcguggucuuuuaggccgcagccagguugggguaggaguguuucaagagaacgucuuccauaccauguggcacgugacacggggcgcgguucugauguaccaggguaaaagacucgaaccgaguugggcuagcgugaagaaagacuugauuuccuacgggggaggcuggaggcugcagggcucuuggaauaccggggaggagguccaggugaucgccguagaaccuggaaagaaccccaaaaauguccaaacagcaccagguacuuuuaagacccccgagggcgaagugggggccauugcucucgauuucaagccuggaacgucgggcagcccaaucguuaaccgagaggguaaaauaguggggcuguauggaaauggcgucgugacaacuucaggcaccuacguuuccgccaucgcacaggcuaaggccagucaggaagggccccuuccugagauugaggacgaaguguuucggaaacgcaaccugacaaucauggauuugcacccgggaucugguaagaccagaagguaucuaccagcgauuguccgggaggccaucaaacgaaagcugagaacucucauauuagcacccacccgcgugguagcuagcgaaauggccgaggcucugaagggcaugccuauuagguaccaaacaacggcagugaaauccgaacauacugggaaggagaucguugaccuuaugugccacgccaccuucacaaugcgucugcucucaccaguccgggugcccaauuauaacaugaucauuauggaugaggcccauuuuaccgacccuucuagcaucgcugcgagaggauacauaaguacuagggugggcaugggugaagcagccgcuauuuucaugacagccaccccgcccggguccgucgaggcauuuccacagagcaaugccguaauccaggaugaggaacgcgacauuccugaacgaucuuggaacucaggauaugaguggaucacggauuuccccggcaaaacugugugguuuguuccauccauaaagaguggcaaugacauugcuaacuguuugaggaaaaaugggaagcgggugauccagcugagcaggaagacauucgauaccgaguaccagaaaaccaagaacaacgacugggacuacgucgugacuacagauaucucggaaaugggagcgaauuuccgcgccgaccguguuauugauccuagacggugccucaaacccgugauccugaaggacgguccagagagggucauucuugcaggcccgaugccugugaccguagcuucugccgcacagcgccgagggagaauaggacggaaccacaauaaagaaggcgaucaguauaucuacaugggucagccccuaaacaaugacgaggaucaugcccacuggacagaggcuaagaugcuguuggacaacauuaauacuccagaagggaucauccccgccuuauuugagccugaaagggagaaguccgcggcaauugauggcgaauaucgccugagaggagaggccaggaaaacguucguggagcucaugcggcguggcgaccugccaguuuggcuuagcuacaaggucgcuucagaaggguuucaauauagugaucgccgauggugcuucgacggagagagaaacaaucaggugcuggaagagaacauggauguggaaauauggaccaaagagggugagaggaagaaacuccggccccgcugguuggacgccagaacauacucugacccucuggcucuaagggaauuuaaggaguucgcagccggccggcgauccgucagcggggaucugauccucgaaauuggaaaacuuccgcagcaccugacucagagagcucaaaaugccuuagacaacuugguuaugcugcauaauucagagcagggcggucgcgcauauaggcacgcgauggaggaacucccagauaccaucgagacacugaugcuucuggcccucauugcuguguugaccgggggcguaacucuguuuuucuuaaguggacggggccuagggaagacgagcaucggacugcucugugugauggccuccucuguccuucuguggauggcaagcguggaaccccauuggauagcugccuccaucauuuuggaguuuuuccugaugguucuccugaucccugaacccgaccgucagagaaccccacaggauaaccaacuugcauacguggucauuggucuccuguuuaugaucuugacaguagccgcuaaugagaugggccuguuagagacuaccaagaaagaccuagggauaggacacguggcgguugaaaaccaccaucacgccacaaugcuggauguggaccuccauccugcaucagcuuggacccuuuacgccgucgccacuacaauuaucacgcccaugaugaggcacaccauugagaacacuacagcaaauaucucucugaccgcuauagccaaccaggcggcuaucuugaugggccuggauaaggguuggccaauuaguaaaauggacaucggggugccucuccuggcccuuggcugcuauucgcaggucaauccguuaacccugacagcagccgugcucauguugguugcucauuacgcaauuaucggacccggccugcaagccaaggcgacucgcgaagcucagaaacggacggccgcagggauaaugaagaacccaaccguggauggaauuguagccaucgaccuagauccuguggucuaugacgcuaaguucgagaaacagcugggccagaucaugcuccuuauucuguguacaagccaaaucuugcugaugcgaacuaccugggcccucugcgaauccauaacacuggcaaccggucccuuaacuacgcuuugggaggggucuccaggaaaguuuuggaauacaaccauugcuguuucaauggccaacaucuucagaggcagcuaccuggcgggugccggccucgcauucucccuaaugaaaagucuagggggaggcaggcgcgggacuggagcucagggcgagaccuugggugaaaaguggaaacggcagcugaaucagcucucuaagagcgaguuuaacacauauaagagaucagggauuauggaaguggaccguuccgaggccaaagaaggacuuaagaggggcgagacuaccaaacacgcagucagucgggguacagcuaagcugcgcugguucguggagcgaaauuugguaaaaccugaaggcaaggugaucgaucugggguguggaagaggcggguggagcuacuauugcgccggacucaagaaaguuacggaggugaagggcuacaccaaaggugggcccggacacgaggagccgauaccaauggccacuuacggcuggaacuuagucaagcugcauucuggcaaagacguguuuuucaucccucccgaaaagugugauacacuucugugcgacauuggggaguccucaccaaaucccaccaucgaggaaggaaggacucuacggguccucaaaaugguggagccuuggcugcgcgguaaccaauuuuguauuaagaucuugaauccguauaugcccagcguuguagaaacacuggagcagaugcagagaaagcacggcgggaugcucgugaggaacccacuuucgcgaaauucuacccaugagauguacugggucaguugcggaacgggcaacauuguguccgcgguuaauaugaccagccggaugcuguuaaaccguuucacaauggcucacagaaaaccuacuuaugaacgcgauguggaccugggugcagggaccaggcacgucgccguggagcccgaaguagcuaacuuggauaucauaggacagcggauugagaauaucaagcaugaacacaaaucaacauggcauuacgacgaggauaacccuuauaagacuugggccuaccacggcuccuaugaggugaaaccaucuggcagcgcaaguuccaugguuaauggggucgugaagcuccugaccaagcccugggacgugaucccuauggucacacaaauugccaugaccgauacuacgccauuuggacagcagagaguuuucaaagaaaagguggacacacgcacccccaaagcuaagagggguacugcgcaaauaauggagguaaccgccaaauggcuauggggcuuucuuagccgaaacaagaagccgcggaucuguacaagagaagaguucacgaggaaagugcgcucuaaugcagcuauuggggccgucuuuguggacgaaaaccaguggaacucagcaaaggaggccguugaggaugaacguuucugggaccuggugcaucgggagagagaacuccacaaacagggaaagugcgcuaccugcgucuacaacaugaugggcaaaagggagaagaagcugggugaauuugggaaagccaagggaagucgcgcgaucugguacaugugguugggcgcacgauuccuggaguucgaggcccucggcuuuaugaaugaagaucacugguucucccgggagaacagccuuucugggguggaaggagagggucugcauaaauuaggcuauauucugagagacaucucgaauauaccugggggaaacauguacgcugaugacacugccggcugggauacaaggaucaccgaggacgauuugcagaaugaagcacgcauuacugacaucauggagccagaacacgcucuccuggccaagucaauuuuuaaacuaacauaucaaaacaagguaguuagagugcagcggcccgcuaaaaaugguaccgucauggaugugaucagcaggcgugaccagcgaggguccggacaggugggcacauacggccuuaacacuuucaccaacauggaggcccaacugauacgccagauggaaagugaggggauauuuucuccuagcgagcucgaaacgccaaaucuggcagagagagucuuggauugguuagaaaaguauggaguugagcggcugaagaggauggcgaucuccggugacgacugugugguaaaacccaucgaugaccgcuucgccaccgcucucacagcccuuaacgauaugggcaaggugagaaaagacauuccgcagugggaaccuucaaagggguggaaugauuggcagcaaguccccuuuugcagucaucacuuccaccagcugauaaugaaagacggacgggagaucgugguuccauguaggaaccaggaugagcuagugggccgagcacgugucucucagggugcuggguggagccugagagaaacugccugccucggaaaguccuacgcacaaauguggcaguugauguauuuucaucgccgggaccugaggcuugccgcgaaugcuauuuguucagccgugccuguagauuggauccccaccagcagaacaacuuggucuauucacgcacaucaccaguggaugaccacggaggacaugcuguccguuuggaaccgcguguggaucgaagagaauccauggauggaagauaagacacauauaaguagcuggggcgacguccccuaccucggcaaacgggaggaccaauggugcgggucguuaaucggacugaccgccagggcuacuugggccacaaacauucagguggcaaucaaucagguucgaagauugauugguaacgagaauuaccuggauuauaugaccuccaugaagcgguucaaaaacgaaucugacccugagggcgcucucugguga

SEQ ID NO: 13633 - RNA, 9879 nt, Artificial Sequence
  derived and/or modified CDS sequence (opt3) from DENV-1__FJ410199__SS-prME
agcgugaccaugcugcucaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaauuauggcgguccuaucucccagcacaacuaccgaccaggcuacuuuacacaaaccgccgggccguggcaucugggaaagcucgagcuggauuucgaccuuugcgaaggcacuacagucgugguggaugagcacugcgggaauagaggacccaguuugaggaccacgacugucaccggcaaaauuauccacgaaugguguugccgcagcuguacacugccuccauuacgguuuaagggugaggacgggugcugguauggaauggagauuagacccguuaaggaaaaagaggaaaaccucgugaagucuaugguauccgcuggcucaggugagguggacaguuucagccugggccuucuguguaucucgauaaugauugaagaggucaugaggucccgcuggucucgaaaaauguugaugaccgggacucucgccgugcuguuucuacugaucaugggacagcucacauggagcgaucugauccggcuuugcauuaugguuggcgcaaaugcuucagaccguauggggaugggaaccacauacuuggcccugauggcaacuuucaagaugagaccuauguuugccgugggcuuacucuucaggcgccugaccagucgggagguccuucugcuaacgaucggucucucccugguggcuucuguugaauugccaaacagccuggaggaauuaggggauggacucgcgaugggcauuaugauacugaaacuucugacagacuuucagucccaucaauugugggccacccuccugucacuaacuuucaucaagaccacauuuagccugcacuaugcauggaagacuauggcuauggugcuuaguauugucucucucuucccccuguguuuguccaccacgagccagaaaacaaccuggcugccgguauuacucggcucgcuggggugcaagccucuuacuauguuucugaucgccgagaauaaaauuuggggaagaaagucauggccauugaacgaagguaucauggccgugggcauaguuucuauccuccugaguucccuacugaaaaacgaugugccccuugcugggccucucauugcaggaggcaugcugaucgccuguuacgucauuagcgguucuagcgcggacuuguccuuagagaaggcugccgaggugucaugggaagaggaagcagagcauaguggggccagccacaauauccugguagaagugcaggaugacggaacaaugaaaauaaaggaugaggagagggacgauacccucacuauucugcuuaaggcuacacuguuggcagucucuggcguuuauccccuauccaucccagccacccuguucgugugguacuucuggcagaaaaagaaacaacgaucaggcgugcucugggacacgccuagucccccagaagucgagcgcgcggugcuggaugacgggaucuaucggauuaugcagagaggacuuuuagguaggagccagguuggcguagggguguuucaggaaaacgucuuccauacuauguggcacgugacccguggagcuguucugauguaccaaggcaagcgccucgagccguccugggccucugugaaaaaggacuugauaucguacggugggggauggcggcugcagggcagcuggaauacaggcgaggaaguccaggugaucgcaguagagccugggaagaaccccaaaaauguccagaccgccccaggaacauuuaagacuucagaaggugaggugggcgcuauugcccucgauuucaaacccgggaccuccggaaguccuaucguuaacagagaaggcaagauugugggucuguaugggaauggagucgugacgacaucuggcacuuacguuagcgcaaucgcucaagccaaagcgucccaggagggcccacuucccgagauagaagacgagguguuuaggaagcgaaaccugaccaucauggauuugcacccugggucaggaaagacacggaaauaucuaccggccauuguccgcgaagcaaucaagagaaaacugaggacccucauuuuagcuccaacucgggugguagccucugagauggcugaagcacugaaggguaugcccauccgauaccagaccacagccgugaaaagcgagcauacgggcaaggagauaguugaccuuaugugccacgccacuuucaccaugagacugcucaguccuguccgcgugccaaauuauaacaugauuaucauggaugaagcucauuuuacagaccccuccagcaucgcggcaaggggguacauuucuacccgugugggaaugggcgaggccgcugccaucuucaugacugcaacaccuccggguucagucgaagccuuuccccaauccaaugcuguaauacaggaugaggaacgggacauuccagagagaaguuggaacagcggguaugaguggaucaccgauuucccuggaaagacggugugguuuguucccucgauuaaaucuggcaaugacaucgcgaacuguuugaggaagaauggcaaacgcgugauacagcugucccgaaagacuuucgauacagaauaccagaaaaccaagaacaacgacugggacuacgucgugaccacugauauuagcgagaugggggccaauuucagagcagaccggguuaucgauccaaggcgcugccucaagccugugauccugaaagacggacccgaacgugucauucuugcugguccaaugccggugacaguagccucagcagcccaaagacggggcaggaucgggcgcaaccacaauaaggagggagaucaguauauuuacaugggccagccucuaaacaaugacgaggaucaugcucacuggaccgaagccaaaaugcuguuggacaacauaaauacacccgaggguaucauuccagcguuauuugaacccgagcgagaaaagagugcagccaucgauggggaguauagacugcggggcgaggcuaggaaaacuuucguggaacucaugcgcagaggagaccugccuguuuggcuuucuuacaaggucgccuccgagggcuuucaguauagcgauaggcgguggugcuucgacggggaacguaacaaucaagugcuggaggaaaacauggauguggagaucuggacgaaagagggagaacgcaagaagcuccgaccaagaugguuggacgcuaggaccuacucagacccccuggcacuacgggaguuuaaagaguucgccgcuggucgcagaagugucagcggcgaucugauucucgagauagggaaacuuccucagcaccugacacagagggcccagaaugcauuagacaacuugguuaugcugcauaauuccgaacaaggaggccgggcguaucgacacgccauggaggagcucccggauacuaucgaaacccugaugcuucuggcucucauugccguguugacaggugggguaacccuguuuuucuuaucuggcagaggacuaggcaaaacuagcaucgggcugcucugugugauggcauccucaguccuucuguggauggcuucuguggagccacauuggauugccgcaaguaucauauuggaauuuuuccugaugguucuccugauccccgagccugaccgccagaggacgccccaggauaaccagcuugccuacguggucauuggacuccuguuuaugaucuugaccguagcugcgaaugagaugggucuguuagaaacaacuaagaaagaccuaggcauugggcacguggccguugagaaccaccaucacgcagcuaugcuggauguggaccuccauccagccucggccuggacccuuuacgcagucgcuacaaccaucauaacuccuaugaugcggcacacaauugaaaacacgaccgccaauaucagccugacugcgauugcuaaccaagccgcaaucuugaugggacuggauaagggcuggcccauauccaagauggacaucggugugccacuccuggcccuugggugcuauucucaggucaauccuuuaacacugaccgcugcagugcucauguugguugcccauuacgcgauuaucggcccgggacugcaggcuaaagccacccgugaggcacaaaagagaacagccgcuggcauuaugaaaaaccccacuguggaugggaucguagccauagaccuagauccaguggucuaugacgcaaaguucgaaaaacagcugggacagauuaugcuccuuauccuguguacgucacagaucuugcugaugaggaccacaugggcucucugcgagagcauuacucuggccaccggcccuuuaacaacccuuugggaggguucccccgggaaguuuuggaauacuacgaucgcgguuaguauggccaacauauuccgcggaucuuaccuggcaggcgcuggucucgccuucagccuaaugaagucacugggcgggggacggcgaggcacaggggcacaaggagaaaccuugggcgagaaauggaagagacagcugaaucagcucuccaaaagugaauuuaacacuuauaagaggagcgguauuauggagguggaccgcucugaagcuaaagaggggcuuaagcggggagagaccacaaagcacgccgucuccagaggcacugccaaacugcguugguucguggaaaggaauuugguaaagccagaggguaaagugaucgaucugggcugugggcggggaggcuggucauacuauugcgcggggcucaagaaaguuaccgaagugaagggauacacaaaaggcgguccugggcacgaggaacccauuccgauggcuacguacggauggaacuuagucaagcugcauagcggcaaggacguguuuuucaucccaccugagaaaugugauacccuucugugcgacauaggcgagucgucucccaauccaacuaucgaagaggggcgcacacuacgaguccucaagaugguggaacccuggcugagaggaaaccaguuuuguauuaaaaucuugaauccuuauaugccgaguguuguagagacccuggagcaaaugcagaggaagcacgguggcaugcucgugcggaacccccuuucccgcaauagcacucaugaaauguacugggucucaugcgggacaggaaacauuguguccgcaguuaauaugaccucuagaaugcuguuaaacagguucacgauggcccaccgaaaaccaaccuaugagcgggauguggaccugggcgcugguacacgucacgucgccguggaaccugagguagcaaacuuggauaucauugggcagagaaucgaaaauauaaagcaugagcacaagagcacuuggcauuacgacgaggauaaccccuauaaaaccugggccuaccacggaaguuaugaagugaagccuuccggcagcgcuucuucaaugguuaauggcgucgugaaacuccugacaaagccaugggacgugauucccauggucacucagaucgcgaugaccgauacaaccccuuuugggcaacagcgcguuuucaaagagaagguggacacuaggacgccaaaggccaaacggggaacagcacagaucauggaaguaaccgcuaaguggcuaugggguuuucuuaguagaaacaaaaagccccgcauuuguacuagggaggaguucacccgaaaagugcgguccaaugccgcaauaggcgccgucuuuguggacgagaaccaauggaauagcgcuaaggaggccguugaagaugagagauucugggaccuggugcauagggaacgcgagcuccacaagcaggggaaaugcgcgacaugcgucuacaacaugaugggaaagcgugagaagaagcugggcgaguuugguaaagcaaaggggucucgggccaucugguacaugugguugggagcuagauuccuggaguucgaagcccucggcuuuaugaaugaggaucacugguucucgagggaaaacucacuuagcggcguggagggggagggacugcauaaauuagguuauauucugcgcgacaucuccaagauuccgggcgggaauauguacgcagaugacacggcuggaugggauacccgaaucacugaagacgauuugcagaacgaggccaagauaacagacaucauggaaccugagcacgcucuccuggccaaaaguauuuuuaagcuaaccuaucagaauaaaguaguucgggugcaaagaccagcaaagaacggcacugucauggaugugaucucuaggcgcgaccagagagguagcggacaggugggaacauacggccuuaauaccuucacaaacauggaagcgcagcugauucggcaaauggaguccgagggcaucuuuucacccagugaacucgagacuccuaaccuggccgggagggucuuggauugguuagaaaaacauggaguugagcgucugaagcgaauggcuauaucuggugacgacugugugguaaagccaauugaugaccgcuucgccaccgcacucacggcucuuaaugauaugggcaaagugagaaaggacaucccccagugggaaccgagcaaaggguggaacgauuggcagcaggucccuuuuugcucccaccacuuccaucaacugaucaugaaggacggacgggagauugugguucccuguaggaaucaggaugagcuagugggccgcgccagagucucacagggugcaggguggagccugcgggaaaccgccugccucggaaaaucuuaugcgcagauguggcaauugauguacuuucacaggcgagaccugcgucuugcugccaacgcaauauguuccgccgugccaguagauuggguuccuacaaguagaacuaccuggagcauccaugcucaccaucaguggaugacaacugaggacaugcugucgguguggaaucgcgucuggauugaagagaaccccuggauggaagauaagacccacaucuccucuuggggcgacgugccauaucucggcaagcgggaggaccaguggugcgggucauuaauuggacugacggccagggcaacaugggcuaccaauauccaaguugccauaaaccaggugagacgcuugaucgguaaugagaacuaccuggauuacaugacuagcaugaaacgguucaagaaugaaagugaccccgagggcgcgcucugguga

SEQ ID NO: 13634 - RNA, 9879 nt, Artificial Sequence
  derived and/or modified CDS sequence (opt3) from DENV-1__FJ432739__SS-prME
agcgugaccaugcugcuaaugcuuaugcccaccgcacuggcuuuccacuugacuacgcgaggcggggaaccucauaugaucgucuccaagcaggaaaggggaaaaucuuuacuguuuaagaccucagccgguguuaacaugugcacccugauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaagcauggcuagugcauaagcagugguuccuggaucucccgcugcccuggaccuccggcgcuucaacuagccaagagacauggaaucggaaagaccuucugguaaccuuuaagacagcccacgcuaagaaacaggaaguuguggucuuggguagucaggagggggccaugcacacugcacucaccggcgccacggaaauccaaaccucuggaacaacuaccaucuucgcuggccaucugaagugccguuuaaaaauggauaagcugacacuaaaagggauguccuaugugauguguacugggagcuucaagcucgagaaggaagucgcggagacccagcacgguacggugcugguucagauuaaauacgagggcacagacgcaccuugcaagauaccauuuucgacccaggaugaaaaaggggugacucaaaacggacgccuuaucacagccaaucccauuguaaccgacaaggagaaaccugucaacaucgaagcugagccacccuucggcgagucuuauauagugauuggugccggggaaaaggcauugaagcuguccugguuuaaaaagggcucaaguaucggaaaaauguucgaggccacugcuagaggcgccaggcggauggcaauccucggggauaccgcgugggacuuuggaagcauugguggcguuuucacauccguggggaagcugguccaucagaucuuuggaacggcuuacggcgugcuuuucucugguguaagcuggaccaugaaaauugggauaggcgugcuguugacuuggcucggacuaaauucacgaaguacauccuuaagcaugaccuguaucgccguuggccuggucacacuauaccucggggugauggugcaggcagauucuggaugcgucauuaacuggaagggccgcgaacugaagugugguucagggaucuuuguuacuaaugaggugcacaccuggacggaacaguauaaauuccaagccgacaguccgaagagacuuagcgcugccaucggaaaagcaugggaggagggcgugugcgguauuagguccgcuacacgguuggaaaacauaauguggaagcagaucucuaacgagcugaaucauauucuccuggaaaacgacaugaaauuuaccguagucgugggcgauguugccgggaucuuagcgcagggaaagaaaaugauucgcccucagcccauggaguacaaguauucguggaaaagcuggggcaaagccaagaucauaggggcugacgugcaaaaugcaacuuucaucauugauggaccaaacaccccugaaugucccgacgaucagagagccuggaauaucugggaggucgaggacuacggcuuugguauuuucacaacuaacaucuggcugaaacuuagggauuccuauacccaggugugcgaccaccguuugaugucagcugccauaaaggauaguaaagcaguucacgcggacaugggguacuggauugaaucugagaagaaugaaacauggaagcucgcccgggcuagcuucaucgaggugaaaacguguauuuggccaaagucccauacccuguggucaaacggaguacuagaaagcgagaugaucauacccaaaaucuauggcgguccuauuucucagcacaauuaccgaccaggcuacuuuacucaaacagccgggccguggcaucugggaaagcucgagcuggauuucgaccuuugcgaaggcaccacugucgugguggaugagcacugcgggaacagaggacccuccuugaggacaaccacggucacuggcaaaaucauucacgaaugguguugccgcaguuguacccugccuccauuacgguuuaagggugaggacgggugcugguauggaauggagaucagacccguuaaggaaaaagaggaaaaucucgugaaguccaugguaucugcaggcuccggugagguggacucauucagucugggccuucuguguauaagcauuaugaucgaagaggucaugaggucgcgcuggucccgaaaaauguugaugacagggauccucgcuguguuuuuccugcuaauuaugggacagcugaccuggaacgaucucauccggcugugcauuaugguuggcgccaaugcaucugaccguauggggaugggaacuacauaccuugccuugauggcuaccuuuaagaugagaccuauguucgcggugggccuguuauuuaggcgccucacaagccgggagguccugcuucugacuauaggucuaucacucguggccaguguugaacugccaaacuccuuggaggaacugggggauggauuagcaaugggcaucaugauucucaaacugcuuaccgacuuccagucucaucaacugugggcuacguugcucagccugacauuuaucaagaccacuuucucccuacacuaugccuggaagaccauggccauggugcugucaauugucagccuuuuuccccucugucugaguacaacuucucagaaaaccacgugguugccgguacuguuaggcucccucgggugcaagccucugacaauguuccuuaucgcugagaauaaaauauggggaagaaagagcuggccacugaacgaagguaucauggcagugggcauuguuucgaucuugcucucaucucugcucaagaacgaugugccccuggccgggccucuuauugcgggaggcaugcucaucgcuuguuacgucauaagugguuccagcgccgaccugucuuuggagaaggcagccgaggugagcugggaagaggaagcugagcauuccggggcaucacacaauauuuuaguagaagugcaggaugacggaaccaugaaaaucaaggaugaggagagggacgauacucugacaauccuccugaaggccacccuucuggcggucaguggcguuuaucccuugagcauuccagcuacucuauucgugugguacuuuuggcagaaaaagaaacaacgaucuggcgugcugugggacacaccuucacccccagaagucgagcgcgccgugcucgaugacgggauauaucggaucaugcagagaggacugcuugguaggagccagguuggcguagggguguuccaggaaaacgucuuucauaccauguggcacgugacgcguggagcaguuuuaauguaccaaggcaagcgccuggagccgaguugggccagcgugaaaaaggaccucauuuccuacggugggggauggcgguugcagggcucuuggaauacuggcgaggaaguccaggugaucgcuguagagccugggaagaaccccaaaaauguccagaccgccccaggaacauucaagaccucggaaggugaggugggcgcaauugcucuggauuuuaaacccgggacaagcggaucaccuaucguuaacagagaaggcaagauagugggucucuaugggaauggagucgugacuaccuccggcacguacguuagugccaucgcgcaagccaaagcaucucaggagggcccacugcccgagauugaagacgagguguucaggaagcgaaaccuuacaaucauggaucugcacccugggagcggaaagacucggcgcuauuugccggcuauugucagagaagccaucaaaaggaagcuacggacccugauacucgcuccaacacgagugguagcauccgagauggccgaagccuuaaaagguaugcccauuagauaccagaccacugcugugaagucagagcauaccggcaaagagaucguugaccugaugugccacgcgacauuuacgaugcgccuucugucuccugucagggugccaaauuauaacaugaucauuauggaugaagcacauuucacugaccccagcaguaucgccgcucguggguacauauccacccgggugggaaugggcgaggccgcagccauuuuuaugacagcuaccccuccggguagcgucgaagcguucccccaaucuaaugccguaauccaggaugaggaaagagacauuccagagaggucauggaacuccggguaugaguggaucacugauuuuccuggaaagacagugugguucguucccaguauaaagagcggcaaugacauugcaaacugucuccgcaaaaauggcaagcgagugauccaguugucgagaaaaaccuucgauacggaauaccagaagacuaaaaacaacgacugggacuacgucgugacaaccgauaucucugagaugggggcuaauuuucgggccgacaggguuauugauccacgccguugccugaagccugugauccucaaggacggacccgaaagagucauucuggcagguccaaugccggugaccguagccuccgcugcccaacggaggggccgcauagggcgaaaccacaauaaagagggagaucaguauaucuacaugggccagccucuuaacaaugacgaggaucaugcgcacuggacugaagcaaagaugcuacuggacaacauuaauacacccgaggguaucaucccagccuuguucgaacccgagagagagaaaagcgcugccauugauggggaguaucgguuaaggggcgaggcucgcaagaccuuuguggaacugaugagaaggggagaccucccuguuuggcugucauacaaagucgcaagugagggcuuccaguauucugaucggcguuggugcuuugacggggaacgcaacaaucaagugcuugaggaaaacauggauguggagauauggacaaaggagggagaaagaaagaagcugagaccaagguggcucgacgcccggacuuacuccgaccccuuggcucugcgcgaguucaaggaauuugccgcagguagaaggagcgucucaggcgaucuaauccuggagauugggaaacucccucagcaccuuacgcagcgggcgcagaaugcccuggacaacuuaguuauguugcauaauagugaacaaggaggccgagcuuauagacacgccauggaggagcugccggauaccaucgaaacacucaugcugcuugcacugauugcugugcucacuggugggguaaccuuguucuuucugagcggccgcggauuaggcaagacauccaucgggcuacugugugugauggccucuagcguccuccuuuggauggcauccguggagccacauuggauagccgcuucaaucauucuggaguucuuuuugaugguucugcucauccccgagccugacaggcagcggacaccccaggauaaccagcuggcguacguggucauuggacuucucuucaugauccugacuguagccgcaaaugagauggguuugcuggaaacgaccaaaaaggacuuaggcauagggcacguggcuguugagaaccaccaucacgccgccaugcuagauguggaccugcauccagcaucugcuuggacacucuacgccgucgcgacuaccauuaucacaccuaugaugcgucacaccauugaaaacacuacagcuaauaucagucuuacggccauagcaaaccaagccgcuauccugaugggauuggauaaaggcuggcccauuucgaagauggacaucggugugccacugcucgcacuggggugcuauagccaggucaauccucuuaccuuaacugccgcggugcugaugcucguugcucauuacgccauuaucggcccgggauugcaggcaaaggccacaagagaggcucagaaaaggaccgccgcaggcauaaugaagaaccccaccguggaugggauuguagcuaucgaccuggauccaguggucuaugacacaaaauuugaaaagcagcuaggacagaucaugcugcucauucuuuguacuucccagauccuguugaugcgcacgaccugggcccugugcgagucuauaacacucgcgacuggcccucugaccacauuaugggaggguucacccgggaaauucuggaauaccacuauugccguuagcauggcaaacaucuuccggggauccuaccuugcuggcgccggucuggcauuuagucucaugaagucucuaggcgggggacgaagaggcacgggggcucaaggagaaacacugggcgagaaguggaaaaggcaguugaaucagcugagcaagucagaguucaacaccuauaaacgcuccgguauuauggagguggaccggagugaagccaaggaggggcucaaaagaggagagacuaccaagcacgccgucagccguggcacagcgaaacuuaggugguuuguggaacggaaucugguaaaaccagaggguaaggugaucgauuugggcugugggcgcggaggcuggucuuacuauugcgcugggcugaaaaagguuacugaagugaaaggauacaccaagggcgguccugggcacgaggaacccauaccgauggcaacauacggauggaaccucgucaaauuacauuccggcaaggacguguucuuuaucccaccugagaagugugauacgcugcuuugcgacauuggcgagucaagccccaauccaaccaucgaagaggggcgaacucugagaguccuaaaaaugguggaacccuggcucaggggaaaccaguucuguauuaagauccugaauccuuauaugccgucgguuguagagacauuggagcaaaugcagcggaaacacgguggcaugcuggugcgcaacccccucucuagaaauaguacccaugaaauguacugggucuccugcgggacuggaaacauugugagcgccguuaauaugacaucaaggaugcuucugaaccgauuuaccauggcucaccggaagccaacguaugagcgugauguggacuuaggcgccgguaccagacacgucgcaguggaaccugagguagccaaccuggauaucauagggcagcgcauugaaaauaucaaacaugagcacaaguccacauggcauuacgacgaggauaaccccuauaagacuugggcuuaccacggaucuuaugaagugaaaccuagcggcagugcguccagcaugguuaauggcgucgugaaguugcucaccaaaccaugggacgugauccccauggucacacagauugccaugacugauaccacaccuuucgggcaacagaggguuuuuaaggagaaaguggacacccggacuccaaaggcaaagagaggaacggcucagauaauggaaguaacagccaaauggcugugggguuuccuaucucgcaacaagaaacccaggaucuguacccgagaggaauuuacucggaaggugagaucaaaugcagccauuggcgcugucuucguggacgagaaccaauggaauagugccaaagaggcgguugaagaugagagguuuugggaccuugugcaucgcgaacgugagcugcacaagcaggggaagugcgcaaccugcgucuacaacaugaugggaaaacgggaaaagaaacucggcgaguucgguaaggccaaaggguccagagcuaucugguacauguggcugggagccagguucuuggaguuugaagcacugggcuucaugaaugaggaucacugguuuagccgcgaaaacucucucucgggcguggagggggagggacuucauaagcuggguuauauuuuacgagacaucucaaaaauaccgggcgggaauauguacgcugaugacacagccggaugggauacgcggaucaccgaagacgaucugcagaacgaggcuaagauuacugacaucauggaaccugagcacgccuugcucgcaaagagcauuuucaaacugacauaucagaauaagguaguuagagugcaaaggccagcgaaaaacggcaccgucauggaugugaucucccgcagagaccagcgggguaguggacaggugggaacuuacggccuaaauacauuuaccaacauggaagcccagcuuauaaggcaaauggagucugagggcauuuucagccccuccgaacuggagacaccuaaccucgcugggcguguccuggauugguuggaaaagcauggaguugagcgauuaaaacgcauggccaucucaggugacgacugugugguaaagccaaucgaugacagauuugcaacugcucugaccgcccucaaugauaugggcaaggugcggaaagacauuccccagugggaaccgaguaagggguggaacgauuggcagcaggucccuuucugcucucaccacuuucaucaacuuauaaugaaagacggaagggagaucgugguucccugucgcaaucaggaugagcuggugggcagagcacgggucagccagggugccggguggucccuaagggaaacggcgugccugggaaagucauaugcucagauguggcaacucauguacuuccaccgacgugacuugagacuggccgcaaacgccauuuguagcgcugugccaguagauuggguuccuaccucucgcacaacuugguccauccaugcccaccaucaguggaugaccacagaggacaugcuuaguguguggaaucgggucuggauugaagagaaccccuggauggaagauaaaacucacaucagcucguggggcgacgugccauaucugggcaagagggaggaccaguggugcgggucccucauaggauuaaccgcaagagcuacgugggccacaaauauccaaguugcgauuaaccaggugcgccggcugaucgguaaugagaacuacuuggauuacaugaccucuaugaagagguuuaaaaaugaaauugaccccgagggcgcucugugguga

SEQ ID NO: 13635 - RNA, 9879 nt, Artificial Sequence
  derived and/or modified CDS sequence (opt3) from DENV-1__FJ410201__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacauuaauugccauggaccucggcgagcugugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuuggacagggcaaaaagaugauccgcccucaacccauggaguacaaauauucguggaaaagcugggggaaggccaaaauaaucggagcggacgcccagaauacuaccuucauuaucgauggcccaaacacaccugaaugucccgacgaucagagagcuuggaauauuugggagguggaggacuacgguuuugggaucuucacuaccaacauaugguugaagcucagggauuccuauacacaggucugcgaccaccgucugaugucagcagccauuaaagauaguaaggcugugcacgccgacaugggauacuggaucgaaucugagaaaaaugaaacguggaagcuagcacgggcgagcuuuauugagguuaagaccuguaucuggccaaaaucccauacucuguggucaaacggcgugcucgaaagcgagaugauaauccccaagauuuaugguggcccuaucucucaacacaauuaccgaccaggguacuucacacagaccgccggaccguggcaucugggcaaacuugaguuggauuucgaccugugcgaagggacuacaguagucguggaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgucaaagaaaaggaggaaaaucuuguuaagagcauggugucugcugguuccggcgagguagacucauucagucugggguugcucuguauuagcaucaugaucgaagaggugaugcgcucgcgauggucccggaaaaugcugaugaccggaacucuagccgucuuuuuccugcucauuaugggccagcugacauggaacgaucuuauccguuugugcauuauggugggggcaaaugcuucugacagaaugggaaugggcaccacauaccuggccuuaauggcaacuuuuaagaugaggccuauguucgccguuggucuccuguuucgccggcuuaccagcagagaggugcugcuacucacgauagggcugucauuggucgcuaguguggaacugccaaacuccuuagaggaacucggagauggccuggcgaugggcaucaugauucuuaaacuguugacagacuuccaaucucaucagcucugggccacccugcuaagccugacuuuuaucaagaccacauucucccuucacuaugcauggaaaacuauggcuaugguucucucaauugugagccuguuucccuugugucugaguaccacgucucagaagacaaccugguuaccgguccuccuggggucccuuggaugcaagccucugacuauguucuugaucgccgagaauaaaauaugggguaggaaguccuggccacucaacgaaggcaucauggccguagggauugugucgauccugcuaucaucucugcuuaaaaacgauguuccccucgcuggaccucugauugcaggcgguauguugaucgccuguuacgugauaaguggguccagcgcggacuuaucucuggagaaggcugccgaggucagcugggaagaggaagcagagcauuccggagccucacacaauauucucguggaaguacaggaugacggcacaaugaaaaucaaggaugaggagcgagacgauacccugacuauccuucugaaagcuacauugcuagcagugaguggcgucuauccccugagcauuccagccacccucuuuguuugguacuucuggcaaaagaagaaacagcgcucuggggugcugugggacacgccuucacccccagaaguggagcgggcgguccuugaugacggaauauauagaaucaugcagagggguuuacugggccguagccagguggggguuggaguauuccaagaaaacguguuucauacuauguggcacgucacccgcggcgcugugcucauguaccaggguaagcgguuggagccgaguugggccagcguuaaaaaggaccugauuuccuacgggggaggcuggagacucaggggcucuuggaauacaggggaggaagugcaggucaucgcaguggagccuggcaaaaaucccaagaauguacagaccgccccagguacauucaagacucccgaaggcgaggucggggcuauugcccuggauuuuaaaccuggaaccucgggcagcccaaucgugaaccgagaagguaagauaguugggcuuuauggaaauggcguggucacgacaucaggcacuuacguguccgcaaucgcucaagccaaagcgagucaggaggggccccugccugagauugaagacgagguuuuccggaagcgcaacuugaccaucauggaucuacacccgggaucugguaaaacaagaagguaucugccagccauugugcgggaagcaaucaagcgaaagcucagaaccuuaauacuggcucccacucgcgucguggccagcgagauggcugaagcacuuaaaggcaugccuauuagguaccagaccacagccguaaaguccgagcauacggggaaagagaucguggaccugaugugccacgccacuuuuaccaugcgucucuugucaccaguucggguccccaauuauaacaugaucauuauggaugaagcucauuucacagacccuucuagcaucgcggcaagaggauacauaaguaccagggugggcaugggugaggccgcugccauuuuuaugacugcaacaccgcccggguccguggaagccuucccacaaagcaaugcugucauccaggaugaggaacgcgacauuccugagcgaucuuggaacucaggauaugaguggaucaccgauuuucccggcaagacgguaugguucgugccauccauaaaaaguggcaaugacauugcgaacugucugagaaagaaugggaagcggguuauccagcucagcaggaaaacuuuugauacagaauaccagaagaccaaaaacaacgacugggacuacguggucaccacugauaucucggagaugggagccaauuuccgcgcagaccgugugauugauccuagacggugccugaagcccguuauccuuaaagacgguccagaaagggugauucuagcuggcccgaugccugucacaguggccucugcagcccaacgccgagggagaauaggacggaaccacaauaaggagggcgaucaguauaucuacaugggucagccccugaacaaugacgaggaucaugcucacuggaccgaagccaagauguuguuagacaacauuaauacaccagaggggaucauccccgcgcuguucgaaccugagagggaaaaauccgcagccguagauggcgaguaucgccucagaggagaggcuaggaagacuuuuguggaacugaugcggcguggcgaccuuccaguuuggcugagcuacaaagucgccucagagggguuccaguauagugaucgccgauggugcuuugacggagaaagaaacaaucaagugcucgaggaaaacauggauguggagauuuggacgaaggagggugaaaggaaaaaguugcggccccgcuggcuggacgcuagaaccuacucugacccucuagcacugagggaguucaaagaauuugccgcuggccggcgauccgucagcggggaucucauacuugagaucggaaagcugccgcagcacuuaacacagagagcccagaaugcauuggacaaccugguuaugcuccauaauucagaacaaggcggucgcgcguauaggcacgccauggaggagcugccagauacuauugaaacccuuaugcugcucgcuuugaucgccgugcugacagggggcguaaccuuauucuuucuaaguggacggggccuggggaagacuagcauuggacuccuuugugugauggcauccucuguccuguuguggauggcuagcguggagccccauuggaucgccgcauccauaauccuggaguucuuucucaugguucugcuuauuccugagcccgaccgucagagaacgccacaggauaaccagcucgccuacguggucaucggucuguuguucaugauucugaccguagcugcgaaugagaugggcuuacuagaaacaacuaaaaaggaccuggggaucggacacguggccguugagaaccaccaucacgcagcuaugcucgauguggaccuucauccugccucagccuggacccuguacgcagucgcuacaaccauaauuacucccaugaugaggcacacaaucgaaaacacgaccgccaauauuucuuugacugcgaucgcuaaccaagccgcaauacugaugggccucgauaaagguuggccaaucaguaagauggacauuggggugccucugcuugccuuaggcugcuauucgcaggucaauccgcugacacucaccgcugcaguguugaugcugguugcccauuacgcgaucauuggacccggccuacaggcuaaagccacccgcgaggcacaaaagcggacagccgcugggaucaugaagaacccaacuguggauggaauaguagccauugaccuggauccuguggucuaugacgcaaaauuugaaaagcagcucggccagaucaugcuucugaucuuguguacgagccagauucugcucaugcgaaccacaugggcucugugcgaguccaucacuuuagccaccgguccccuuacaacccugugggaggggucuccaggaaaauucuggaauacuacgauagcgguuucaauggccaacauuuuuagaggcagcuaccucgcaggagcuggccuagccuucucccugaugaagagucuagggggaggcaggcgcgggacaggagcacaaggcgaaacccugggugagaaauggaagcggcagcucaaucagcuuucuaagagcgaguucaacacuuauaaaagaucagggaucauggagguggaccguuccgaagcuaaggagggacugaaaaggggcgagaccacaaagcacgccgucagucgggguacugccaaauugcgcugguuuguggaacgaaaucugguaaagccugagggcaaggugauugaucucggguguggaagaggcggguggagcuacuauugcgcgggacuaaagaagguuaccgaagugaaaggcuacacaaagggugggcccggacacgaggaaccgaucccaauggcuacguacggcuggaaccuggucaaacuucauucuggcaaggacguguucuuuauaccucccgagaaaugugauacccugcuaugcgacaucggggaguccucaccaaaucccacuauugaagagggaaggacacuccggguccugaagaugguggaaccuugguugcgcgguaaccaguucuguaucaagauucugaauccguauaugcccagcguuguagagacccucgagcaaaugcagagaaaacacggcgggaugcuugugaggaacccacugucgcgaaauucuacucaugaaauguacugggucaguugcggaacaggcaacaucguguccgcaguuaauaugaccagccggauguuacugaaccguuuuacgauggcccacagaaagccuaccuaugagcgcgauguggacuuggguacagggacuaggcacgucgcuguggaacccgagguagccaaccucgauauuaucggacagcggauagaaaauauuaaacaugagcacaagucaaccuggcauuacgacgaggauaacccuuauaaaacaugggcauaccacggcuccuaugaagugaagccaucuggcagcgccaguuccaugguuaauggggucgugaagcugcuaacuaaacccugggacgugaucccuauggucacccagaucgcuaugacagauaccacuccauucggacaacagagaguuuuuaaggagaaaguggacacgcgcacacccaaggcgaaaagggguaccgcccagauuauggaaguaacugcacgauggcuuuggggcuuccugagccggaacaagaagccgagaauauguaccagggaggaauuuacacgcaaagugcguucuaaugcugccaucggggcagucuucguggacgagaaccaauggaacucagccaaggaggcuguugaagaugagcgguuuugggaccucgugcauagagaaagggagcugcacaaacagggaaagugcgccacgugcgucuacaacaugaugggcaaacgcgaaaagaaguugggugaguucgggaaagcgaagggaagucgagcaauuugguacauguggcugggcgcccgguuucucgaguucgaagcucuuggcuucaugaaugaggaucacugguuuuccagagaaaacagccugucugggguggagggagaggguuuacauaaacugggcuauaucuugagggacauuucgaagaucccugggggaaauauguacgccgaugacaccgcaggcugggauacucgcauaacagaagacgaucuccagaacgaggcuaaaaucaccgacauuauggaaccagagcacgcccugcuagcuaaggccaucuucaaacuuacuuaucagaauaagguaguuagagugcaacggcccgcaaagaacgguacagucauggaugugauuucaaggcgugaccagcgagggagcggacaggugggcaccuacggccugaauacauuuacuaacauggaagcgcagcucauccgccaaauggaguccgaggggauauucaguccuucugaacuggagaccccaaacuuggccgaaagagcuuuagauuggcuggagaaauauggagucgaacggcucaagaggauggccauuagcggugacgacuguguugugaaacccaucgaugaccgcuuugcaacggcucuuaccgcccugaaugauaugggcaagguaagaaaagacaucccgcagugggagccuuccaagggguggaacgauuggcaacaggugcccuucugcucacaucacuuucaccaacuaauuaugaaggacggacgggagauagucgugccauguaggaaucaggaugaacugguuggccgagcacgugugagucagggugccggguggucucucagagagacagcgugcuugggaaaaagcuacgcucagauguggcaacugauguauuuccaucgccgggaccuuaggcuggccgcaaacgccaucuguuccgcugucccuguggauuggguacccacuucaagaaccacauggagcauucacgcccaucaccaguggaugacuaccgaagacaugcucucuguuuggaaucgcguguggaucgaggaaaacccauggauggaggauaagacgcauauuuccaguugggaggacguccccuacuuaggcaaacgggaagaccaguggugcggcagccugaucggguugacagcaagggcuaccugggccacuaauauacaaguggcgaucaaccagguucgaagacugauuggaaaugagaacuaccucaauuauaugacaucgaugaagcgguuuaaaaacgaauccgauccugagggugcucuuugguga

SEQ ID NO: 13636 - RNA, 9879 nt, Artificial Sequence
  derived and/or modified CDS sequence (opt3) from DENV-1__FJ410203__SS-prME
agcgugaccaugcugcucaugcuuaugcccacugcacuggcuuuccacuugacuacgagaggaggggaaccucauaugaucgucuccaagcaggaaaggggaaaaucuuuacuguuuaagaccucagccgguguuaacaugugcacauuaauugccauggaccucggagagcugugugaagauacuaugaccuacaaaugcccacggauuacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuauucaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaagcugaccgugguagucggcgauguggcugggauccuuggacagggcaaaaagaugauacgcccucaacccauggaguacaaauauucguggaaaagcugggggaaggccaaaaucauuggagcggacgcccagaauacuaccuucaucauugauggcccaaacacaccugaaugucccgacgaucagagagcuuggaauaucugggagguugaggacuacgguuuugggauauucacuaccaacauuugguugaagcucagggauuccuauacacaggugugcgaccaccgucugaugucagcagccaucaaagauaguaaggcuguccacgccgacaugggauacuggauugaaucugagaaaaaugaaacguggaagcuagcacgggcgagcuuuaucgaggugaagaccuguauauggccaaaaucccauacucuguggucaaacggcguucucgaaagcgagaugaucauucccaagaucuaugguggcccuauuucucaacacaauuaccgaccaggguacuucacacagaccgccggaccguggcaucugggcaaacuugaguuggauuucgaccugugcgaagggacuacagugguagucgaugagcacugcggaaacagaggccccuccuuaaggaccacgacugugaccgguaagaucauacacgaaugguguugccgcaguuguacacucccuccacugcgguuuagaggggaggacggaugcugguauggcauggagauuaggcccgugaaagaaaaggaggaaaaucuugucaagagcaugguuucugcugguuccggcgagguggacucauucagucugggguugcucuguaucagcaucaugauugaagagguaaugcgcucgcgauggucccggaaaaugcugaugaccggaacucuagccguguuuuuccugcucaucaugggccagcugacauggaacgaucuuauucguuugugcauaauggucggggcaaaugcuuuugacagaaugggaaugggcaccacauaccuggccuuaauggcaacuuucaagaugaggccuauguuugccgugggucuccuguuccgccggcuuaccucuagagagguucugcuacucacgaucgggcugagcuugguggcuucagucgaacugccaaacaguuuagaggaacucggagauggccuggcgaugggcauuaugauccuuaaacuguugacagacuuucaaucccaucagcucugggccacccugcuaucucugacuuucauuaagaccacauuuagccuucacuaugcauggaaaacuauggcuauggugcucuccaucguuucacuguuccccuugugucugagcaccacgagucagaagacaaccugguuaccggugcuccuggggucucuuggaugcaagccucugacuauguuuuugauagccgagaauaaaaucugggguaggaaguccuggccacucaacgaaggcauuauggccgucgggaucguaagcauucugcuaucgucacugcuuaaaaacgaugugccccucgcuggaccucugaucgcaggcgguauguugauagccuguuacguuauuucugggaguuccgcggacuuaagccuggagaaggcugccgaggugucuugggaagaggaagcagagcauagcggagccucccacaauauccucgucgaagugcaggaugacggcacaaugaaaaucaaggaugaggagcgagacgauacccugacuauucuucugaaagcuacauugcuagcaguaucaggcguguauccccugaguauaccagccacccucuucgucugguacuucuggcaaaagaagaaacagcgcagcgggguucugugggacacgccuucucccccagaaguggagcgggcggugcuugaugacggaaucuauagaauuaugcagagggguuuacugggccguucccaggucggggugggaguuuuucaagaaaacguauuccauacuauguggcacgugacccgcggcgcuguccucauguaccaggguaagcgguuggagccgucaugggccagugugaaaaaggaccugaucagcuacgggggaggcuggagacucaggggcuccuggaauacaggggaggaaguucaggugauugcagucgagccuggcaaaaaucccaagaaugugcagaccgccccagguacauuuaagacucccgaaggcgagguaggggcuaucgcccuggauuucaaaccuggaaccucuggcucgccaauagucaaccgagaagguaagaucguggggcuuuauggaaauggcguugugacgacaagcggcacuuacgucucagcaauugcucaagccaaagcgucccaggaggggccccugccugagaucgaagacgagguguuucggaagcgcaacuugaccauuauggaucuacacccgggaagugguaaaacaagaagguaucugccagccaucguucgggaagcaauaaagcgaaagcucagaaccuuaauucuggcucccacucgcguggucgccucugagauggcugaagcacuuaaaggcaugccuaucagguaccagaccacagccguaaagagcgagcauacggggaaagagaucguagaccugaugugccacgccacuuucaccaugcgucucuuguccccagugcggguucccaauuauaacaugauuaucauggaugaagcucauuuuacagacccuucaucuauagcggcaagaggauacauuagcaccagggucggcaugggugaggccgcugccaucuucaugacugcaacaccgcccgggaguguggaagccuuuccacaauccaaugcugugauucaggaugaggaacgcgacaucccugagcgaagcuggaacucuggacacgaguggauaaccgauuuccccggcaagacggucugguuuguaccaucaauuaaauccggcaaugacaucgcgaacugucugagaaagaaugggaagcgggugauccagcucaguaggaaaacuuucgauacagaauaucagaagaccaaaaacaacgacugggacuacguugugaccacugauauuagcgagaugggagccaauuuccgcgcagaccgugucaucgauccuagacggugccugaagcccgugauucuuaaagacgguccagaaaggguuauacuagcuggcccgaugccugugacagucgccucggcagcccaacgccgagggagaaucggacggaaccauaauaaggagggcgaucaguacauuuauaugggucagccccugaacaaugacgaggaucacgcucacuggaccgaagccaagauguuguuagacaacaucaauacaccagaggggaucauucccgcgcuguuugaaccugagagggaaaaaucugcagccguggauggcgaguaccgccucagaggagaggcuaggaagacuuucguagaacugaugcggcguggcgaccuuccaguguggcuguccuauaaaguugccagcgagggguuucaguacucagaucgccgauggugcuucgacggagaaagaaacaaucaaguccucgaggaaaacauggauguggagauauggacgaaggagggugaaaggaaaaaguugcggccccgcuggcuggacgcuagaaccuauagugacccucuagcacugagggaguuuaaagaguucgccgcuggccggcgaucuguguccggggaucucauccuugagauuggaaagcugccgcagcauuuaacacagagagcccagaaugcauuggacaaccuggucaugcuccacaauagcgaacaaggcggucgcgcguacaggcaugccauggaggagcugccagauacuaucgaaacccuuaugcugcucgcuuugauugccguucugacagggggcgugaccuuauuuuuccuaucaggacggggccuggggaagacaaguaucggacuccuuuguguaauggcaagcuccgugcuguuguggauggcuucugucgagccccacuggauagccgcaagcaucauucuggaauuuuuccucauggugcugcuuaucccugagcccgaccgucagagaacgccacaggauaaccagcucgccuauguugugauuggucuguuguuuaugauccugaccgucgcugcgaaugagaugggcuuacuagaaacaacuaaaaaggaccuggggauaggacacguagccguggagaaccaucaccaugcagcuaugcucgauguugaccuucacccugccuccgccuggacccuguacgcaguggcuacaaccauuaucacucccaugaugaggcauacaauugaaaacacgaccgccaauaucucauugacugcgauagcuaaccaagccgcaauccugaugggccucgauaaagguuggccaauuucuaagauggacaucggggucccucugcuugccuuaggcugcuacagucaggugaauccgcugacacucaccgcugcagucuugaugcugguggcccacuaugcgauuaucggacccggccuacaggcuaaagccacccgcgaggcacaaaagcggacagccgcugggauaaugaagaacccaacuguugauggaauuguggccaucgaccuggauccuguaguguacgacgcaaaauucgaaaagcagcucggccagaucaugcuucugauuuuguguacgucgcagauccugcucaugcgaaccacaugggcucugugcgagagcauaacuuuagccaccgguccccuuacaacccugugggagggguccccaggaaaauuuuggaauacuacgauugcggucucuauggccaacaucuucagaggcucauaucucgcaggagcuggccuagccuucagccugaugaagucccuaggggguggcaggcgcgggacaggagcacaaggcgaaacccugggugagaaauggaagcggcagcucaaucagcuuaguaagucugaauuuaacacuuacaaaagaagcgggauuauggagguugaccguucagaagcuaaggagggacugaaaaggggcgagaccacaaagcacgccgugucccgggguacugccaaauugcgcugguucgucgaacgaaaucuggugaagccugagggcaagguaaucgaucucggguguggaagaggcggguggaguuauuacugcgcgggacuaaagaaggugaccgaaguuaaaggcuauacaaagggugggcccggacaugaggaaccgauaccaauggcuacguacggcuggaaccuggugaaacuucacagcggcaaggacgucuuuuucaucccucccgagaaaugugauacccugcuaugcgacauuggggagucuuccccaaaucccacuaucgaagagggaaggacacuccgggugcugaagauggucgaaccuugguugcgcgguaaccaguuuuguauuaagauccugaauccguacaugcccucagugguugagacccucgagcaaaugcagagaaaacauggcgggaugcuuguaaggaacccacugagccgaaauucgacucacgaaauguauugggugucuugcggaacaggcaacauugucagugcagugaauaugaccucccggauguuacugaaccguuucacgauggcccacagaaagccuaccuacgagcgcgauguugacuuggguacagggacuaggcauguggcugucgaacccgagguggccaaccucgauaucauaggacagcggauugaaaauaucaaacacgagcauaagagcaccuggcacuaugacgaggauaacccuuacaaaacaugggcauaucauggcucauacgaaguaaagccauccggcucugccagcaguauggugaaugggguugucaagcugcuaacuaaacccugggacgugaucccuauggugacccagauugcuaugacagauaccacuccauuuggacaacagagagucuucaaggagaaaguugacacgcgcacacccaaggcgaaaagggguaccgcccagauaauggaagugacugcacgauggcuuuggggcuuucugucccggaacaagaagccgagaaucuguaccagggaggaguucacacgcaaaguacguagcaaugcugccauuggggcaguguuugucgacgagaaccaauggaacucugccaaggaggcuguggaagaugagcgguucugggaccucguucacagagaaagggagcugcacaaacagggaaagugcgccacgugcguguauaacaugaugggcaaacgcgaaaagaaguugggugaguuugggaaagcgaagggaucacgagcaaucugguacauguggcugggcgcccgguuccucgaguucgaagcucuuggcuuuaugaaugaggaucauugguucaguagagaaaacucccugagcggggucgagggagaggguuuacacaaacugggcuacauuuugagggacaucucuaagauaccugggggaaauauguaugccgaugacaccgcaggcugggauacucgcaucacagaagacgaucuccagaacgaggcuaaaauuaccgacaucauggaaccagagcaugcccugcuagcuaaggccauuuuuaaacuuacuuaccagaauaaggugguaagaguucaacggcccgcaaagaacgguacagugauggaugucaucucgaggcgugaccagcgagggucaggacaggugggcaccuauggccugaauacauucacuaacauggaagcgcagcucauacgccaaauggagagcgaggggauauuuuccccuagugaacuggagaccccaaacuuggccgaaagagcuuuagauuggcuggagaaauacggaguggaacggcucaagaggauggccaucucuggugacgacugugucguuaaacccaucgaugaccgcuucgcaacggcucuuaccgcccugaaugauaugggcaaggugagaaaagacauuccgcagugggagccuagcaagggguggaacgauuggcagcagguacccuuuugcucccaccacuuccaucaacuaauaaugaaggacggacgggagaucguggucccauguaggaaucaggaugaacuggugggccgagcacguguuucacagggugccggguggagucucagagagacagcgugcuugggaaaaucuuaugcucagauguggcaacugauguacuuucaccgccgggaccuuaggcuggccgcaaacgccauuuguagcgcugugccugucgauugggugcccacuuccagaaccacauggucaauccaugcccaccaucaguggaugacuaccgaagacaugcucagcguauggaaucgcguuuggauugaggaaaacccauggauggaggauaagacgcacaucucuuccugggaggacgugcccuauuuaggcaaacgggaagaccaguggugcggcagucugauaggguugacagcaagggcuaccugggccacuaauauccaagucgcgauuaaccaggugcgaagacugaucggaaaugagaacuaccucgauuacaugacaagcaugaagcgguucaaaaaugaaucggacccugagggugcucuuugguga

SEQ ID NO: 13637 - RNA, 9879 nt, Artificial Sequence
  derived and/or modified CDS sequence (opt3) from DENV-1__FJ410204__SS-prME
agcgugaccaugcugcucaugcuuaugcccacugcacuggcuuuccacuugacuacgaggggaggggaaccucauaugaucgucuccaagcaggaaaggggaaagucuuuacuguuuaagaccucagccgguguuaacaugugcacacuaauugccauggaccucggagaacugugugaagauacuaugaccuacaaaugcccacggauuacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuauucaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguuuauaccuggacggaacaauacaaguuucaggcagacaguccgaaaagauugagcgccgcuauaggaaaggccugggaggagggcgugugcgguaucagguccgcaacacggcuggaaaacauuauguggaaacagaucucuaacgagcucaaucacauucuguuagaaaacgacaugaagcugaccgugguagucggcgauguggcugggauccuuggacagggcaaaaagaugauacgcccucaacccauggaguauaaauacucguggaaaagcugggggaaggccaagaucauuggagcggacgcccagaauacuaccuucaucauugauggcccaaacacaccugaaugucccgacgaucagagagcuuggaauaucugggagguugaggacuaugguuuugggauauucacuaccaacauuugguugaagcucagggauuccuacacacaggugugcgaccaucgucugaugucagcagccaucaaagauaguaaggcuguccacgccgacaugggauauuggauugaaucugagaaaaaugaaacguggaagcuagcacgggcgagcuuuaucgaggugaagaccuguauauggccaaaaucccacacucuguggucaaacggcguucucgaaagcgagaugaucauucccaagaucuacgguggcccuauuucucaacauaauuaccgaccaggguauuucacacagaccgccggaccguggcaccugggcaaacuugaguuggauuucgaccugugcgaagggacuacagugguagucgaugagcauugcggaaacagaggccccuccuuaaggaccacgacugugaccgguaagaucauacacgaaugguguugccgcaguuguacacucccuccacugcgguuuagaggggaggacggaugcugguacggcauggagauuaggcccgugaaagaaaaggaggaaaaucuugucaagagcaugguuucugcugguuccggcgagguggacucauucagucugggguugcucuguaucagcaucaugauugaagagguaaugcgcucgcgauggucccggaaaaugcugaugaccggaacucuagccguguuuuuccugcucaucaugggccagcugacauggaacgaucuuauucguuugugcauaauggucggggcaaaugcuuuugacagaaugggaaugggcaccacauaucuggccuuaauggcaacuuucaagaugaggccuauguuugccgugggucuccuguuccgccggcuuaccucuagagagguucugcuacucacgaucgggcugagcuugguggcuucagucgaacugccaaacaguuuagaggaacucggagauggccuggcgaugggcauuaugauccuuaaacuguugacagacuuucaaucccaccagcucugggccacccugcuaucucugacuuucauuaagaccacauuuagccuucauuacgcauggaaaacuauggcuauggugcucuccaucguuucacuguuccccuugugucugagcaccacgagucagaagacaaccugguuaccggugcuccuggggucucuuggaugcaagccucugacuauguuuuugauagccgagaauaaaaucugggguaggaaguccuggccacucaacgaaggcauuauggccgucgggaucguaagcauucugcuaucgucacugcuuaaaaacgaugugccccucgcuggaccucugaucgcaggcgguauguugauagccuguuauguuauuucugggaguuccgcggacuuaagccuggagaaggcugccgaggugucuugggaagaggaagcagagcacagcggagccucccauaauauccucgucgaagugcaggaugacggcacaaugaaaaucaaggaugaggagcgagacgauacccugacuauucuucugaaagcuacauugcuagcaguaucaggcguguacccccugaguauaccagccacccucuucgucugguauuucuggcaaaagaagaaacagcgcagcgggguucugugggacacgccuucucccccagaaguggagcgggcggugcuugaugacggaaucuacagaauuaugcagagggguuuacugggccguucccaggucggggugggaguuuuucaagaaaacguauuccacacuauguggcaugugacccgcggcgcuguccucauguaccaggguaagcgguuggagccgucaugggccagugugaaaaaggaccugaucagcuaugggggaggcuggagacucaggggcuccuggaauacaggggaggaaguucaggugauugcagucgagccuggcaagaaucccaagaaugugcagaccgccccagguacauuuaagacucccgaaggcgagguaggggcuaucgcccuggauuucaaaccuggaaccucuggcucgccaauagucaaccgagaagguaagaucguggggcuuuacggaaauggcguugugacgacaagcggcacuuaugucucagcaauugcucaagccaaagcgucccaggaggggccccugccugagaucgaagacgagguguuucggaagcgcaacuugaccauuauggaucuacacccgggaagugguaaaacaagaagguaccugccagccaucguucgggaagcaauaaagcgaaagcucagaaccuuaauucuggcucccacucgcguggucgccucugagauggcugaagcacuuaaaggcaugccuaucagguaucagaccacagccguaaagagcgagcacacggggaaagagaucguagaccugaugugccaugccacuuucaccaugcgucucuuguccccagugcggguucccaauuacaacaugauuaucauggaugaagcucacuuuacagacccuucaucuauagcggcaagaggauauauuagcaccagggucggcaugggugaggccgcugccaucuucaugacugcaacaccgcccgggaguguggaagccuuuccacaauccaaugcugugauucaggaugaggaacgcgacaucccugagcgaagcuggaacucuggacaugaguggauaaccgauuuccccggcaagacggucugguuuguaccaucaauuaaauccggcaaugacaucgcgaacugucugagaaagaaugggaagcgggugauccagcucaguaggaaaacuuucgauacagaauaccagaagaccaaaaacaacgacugggacuacguugugaccacugauauuagcgagaugggagccaauuuccgcgcagaccgugucaucgauccuagacggugccugaagcccgugauucuuaaagacgguccagaaaggguuauacuagcuggcccgaugccugugacagucgccucggcagcccaacgccgagggagaaucggacggaaccacaauaaggagggcgaucaguauauuuacaugggucagccccugaacaaugacgaggaucaugcucacuggaccgaagccaagauguuguuagacaacaucaauacaccagaggggaucauucccgcgcuguuugaaccugagagggaaaaaucugcagccguggauggcgaguaucgccucagaggagaggcuaggaagacuuucguagaacugaugcggcguggcgaccuuccaguguggcuguccuacaaaguugccagcgagggguuucaguauucagaucgccgauggugcuucgacggagaaagaaacaaucaaguccucgaggaaaacauggauguggagauauggacgaaggagggugaaaccaaaaaguugaggcaccgguggcccgacgcucgccaguacagugacccucugggccuaagagaguuuaaagaguucgcagccgggaggcggucuguguccggagaucugauccucgagauuggcaaacuuccgcagcaucugacacagcgagcucaaaaugccuuagacaacuuggucaugcugcacaauagcgaacagggugggagagcauaucgccaugcgauggaggagcucccagauacuaucgaaacccugaugcuucuggcccucauugcuguuuugacaggcggagugacccuguuuuucuuaucaggcagggggcuaggaaagacaaguaucggucugcucuguguaauggccagcuccgugcuucuguggauggcaucugucgagccccacuggauagcugccagcaucauuuuggaauuuuuccugauggugcuccugaucccugagcccgaccggcagcguacgccacaggauaaccaacuugcauacguugugauuggccuccuguuuaugaucuugaccgucgccgcuaaugagauggggcuguuagaaacaacuaaaaaggaccuaggaauaggccacguagcgguggagaaccaucaccaugccgcaaugcuggauguugaccuccacccugcuuccgccuggacccuuuacgccguggcaacaaccauuaucacucccaugaugagacauacaauugaaaacacgaccgcuaauaucucacugacugccauagcgaaccaggcugccaucuugaugggucuggauaaaggguggccaauuucuaagauggacaucggcgucccucuccuggcacuuggaugcuauagucaggugaauccguuaacacugaccgccgcuguccucauguugguggcacacuacgccauuaucggccccgggcugcaagcgaaagcuaccagggaggcccagaagcgcacagcagccggaauaaugaagaacccaacuguugauggcauuguggcuaucgaccuagauccuguaguguaugacgccaaauucgaaaagcagcugggucagaucaugcuccuuauucuguguacgucgcaaaucuugcugaugcggaccacaugggcacucugcgagagcauaacucuggcuaccgggcccuuaacaacccuuugggagggauccccaggcaaauuuuggaauacuacgauugccgucucuauggcgaacaucuuccgagguucauaccuggccggcgcagggcucgcuuucagccuaaugaagucccugggaggcgggagaaggggaacaggcgcccagggugaaaccuugggggagaaauggaagcgccagcugaaucagcucaguaagucugaauuuaacacuuauaaacggagcggaauuauggagguugacagaucagaagcaaaggagggccuuaaacguggugagaccacaaagcacgcuguguccaggggcacugccaaacugcggugguucgucgaacgcaauuuggugaagccugaggggaagguaaucgaucugggauguggccgagggggauggaguuacuauugcgccggccucaaaaaggugaccgaaguuaaagguuacacaaaagggggacccggccaugaggaaccgauaccaauggcgacguacggcuggaacuuagugaaacugcacagcgggaaggacgucuuuuucaucccucccgagaaaugugauacccuucugugcgacauuggagagucuuccccaaaucccacuaucgaagaggguagaacacuaagggugcucaagauggucgaaccuuggcugcggggcaaccaauuuuguauuaagaucuugaauccguauaugcccucagugguugagacccuggagcagaugcagcgcaaacaugggggaaugcucguaagaaacccacuuagcagaaauucgacucacgaaauguacugggugucuugcggcacagguaacauugucagugcugugaauaugaccucccgaaugcuguuaaaccgguucacgauggcacaccguaagccuaccuaugagagagauguugaccuggggacaggaacucgccauguggccgucgaacccgagguggcuaacuuggauaucauaggccagaggauugaaaauaucaaacacgagcauaagagcaccuggcacuacgacgaggauaacccuuauaaaacaugggccuaccauggcucauaugaaguaaagccauccgggucugcaagcaguauggugaauggaguugucaagcuccugacuaaacccugggacgugaucccuauggugacccaaauugccaugacagauaccacuccauuuggucagcagcgggucuucaaggagaaaguugacacgagaacacccaaggcuaaacgcggcaccgcgcaaauaauggaagugacugccagguggcuauggggguuucuuucccgaaacaagaagccgcggaucuguaccagagaggaguucacaaggaaaguacgcagcaaugcagcuauuggagccguguuugucgacgagaaccaguggaacucugcaaaggaggccguggaagaugagcguuucugggaccugguucaccgggaaagagagcuccacaaacagggcaagugcgcuacgugcguguacaacaugauggguaaaagggaaaagaagcugggggaguuuggaaaagccaagggcucacgcgcgaucugguacaugugguugggcgcacgauuccuggaguucgaagcccucggguuuaugaaugaggaucauugguucagucgggaaaacucccuuagcggagucgagggugagggccugcacaaauuaggguauauucugagagacaucucuaagauaccuggaggcaauauguacgcugaugacaccgccgguugggauacuaggaucacagaagacgauuugcagaacgaggcaaaaauuaccgacaucauggaaccagagcaugcucuccuggccaaggcuauuuuuaaacuaacuuaucaaaauaaggugguacgcguucagagacccgccaagaacgggacagugauggaugucaucucgcggagggaccagcguggaucaggccaggugggcaccuacgggcuuaauacauucacuaacauggaagcacaacugauacgacagauggagagcgagggaauauuuuccccuagugaacucgagaccccaaaccuggcggaacgcgccuuggauugguuagagaaauaugguguggaaagacugaagcggauggcuaucucuggcgacgacugugucguuaaacccaucgaugacagguucgccacggcacucaccgcucuuaaugauauggggaaggugcgcaaagacauuccgcagugggagccuagcaagggauggaacgauuggcagcaaguacccuuuugcucccaccacuuccaucagcugauaaugaaggacggcagagagaucguggucccaugucggaaucaggaugagcuaguggguagggcccgaguuucacagggggcaggauggagucugcgugagacagccugccucggcaaaucuuacgcgcaaauguggcaguugauguauuuucacagacgcgaccugcggcuugcugccaacgcaauuuguagcgccgugccugucgauugggugcccacuuccaggaccacauggucaauccaugcucaccaucaguggaugacuaccgaagacaugcugagcguauggaauagaguuuggauugaggaaaacccauggauggaggauaagacgcacaucucuuccugggaggacgugcccuaccucggcaaacgcgaagaccaauggugcgggaguuuaauaggacugacagcccgggcaaccugggcuacuaauauccaggucgccauuaaccaggugaggcgauugaucgguaaugagaacuaccuggauuauaugacaagcaugaagagauucaaaaaugaaucggacccugagggcgcgcucugguga

SEQ ID NO: 13638 - RNA, 9879 nt, Artificial Sequence
  derived and/or modified CDS sequence (opt3) from DENV-1__FJ432742__SS-prME
agcgugaccaugcugcucaugcuuaugcccaccgcccuggcuuuccacuugacuacgaggggaggggaaccucauaugaucguaaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggcauccuucaucgagguaaagaccuguauuuggccaaaaucccacacucuauggucaaacggaguccuggaaagcgagaugaucauacccaagaucuacggcgguccuauuucucaacauaauuaucgaccaggcuacuucacacagaccgcggggccguggcaccucggaaaacuggagcuugauuuugacuugugcgaaggcacuacagugguggucgaugagcacugcgggaacagaggacccucccugaggaccacgacuguuaccggcaagaucauucaugaaugguguugccgcaguuguacauuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaugaccgggacucuggcuguuuuccuacugcucaucaugggacagcugacauggaacgaucuuauucgguugugcaucauggugggcgccaaugcaucugaccguauggggaugggaaccacauaucuggcuuuaauggccacuuuuaaaaugagaccuauguucgcagucggccuccuguuuaggcgccuuaccagccgggaggugcugcuacucacgauuggucugucauugguugccaguguggaacugccaaacuccuuagaggaacucggggauggacuggcuaugggcauaaugauccuuaagcuguugacagacuuccaaucucaccagcucugggcgacccugcuaagccugacuuuuauuaaaaccacacuuucccuccauuacgccuggaagacuauggcaaugguccugucaaucgucagcuuguucccccuguguuuaaguaccacgucucagaagacaaccuggcucccggugcugcuuggcucccuggggugcaaaccuuugacuauguuucucauuacagagaauaagaucuggggaagaaaaagcuggccacugaacgaagguauaauggcuguuggcguggucucgauccuacugucaucucuucucaagaacgaugugccccuggccgggccuuugauugccggaggcauguuaaucgcuuguuauguaauuagugguuccagcgcagaccugucucucgagaaagccgcggaggugagcugggaagaggaagcugagcacuccggggccucacauaauauccuggucgaaguucaggaugacggaaccaugaagauaaaagaugaggagagggacgauacucuuacaauucuguugaaggcaacccuacuggccgugaguggcguguacccccucagcaucccagcuacgcuguucgucugguauuuuuggcaaaagaaaaagcagcgaucuggcgugcuuugggacacuccuucacccccagaaguugagcgcgcaguauuagaugacgggaucuaccggauuaugcagagaggacugcucgguaggagccaggugggcgucgggguguuccaagaaaacguuuuccacaccauguggcacgugacacguggagccgucuugauguaucagggcaaacgccuggagccgaguugggcgagcgugaagaaagaccucauauccuacggugggggauggcggcugcagggcucuuggaauaccggcgaggaaguacaggucaucgcuguggagccugggaagaaccccaagaauguucaaacagccccaggaacuuuuaaaacccccgaaggugaggugggcgcaauugcccuugauuucaagccugggacgucgggaagcccaaucgucaacagagaaggcaaaauugugggucuguacgggaauggaguugugacaacuucaggcaccuaugucuccgcuaucgcccaggcaaaggcuagucaggagggccccuugccugagauagaagacgagguguuuaggaaacgaaaccuaacaaucauggaucugcauccggggucuggaaagacccggcgcuaccucccagccauuguaagagaagcgaucaagaggaaauuacggacucugauucuugcccccacccgagugguugcaagcgagauggcugaagcccugaaggguaugccuaucagauaucaaacaacggcugucaaauccgagcacacuggcaaggagauaguggaccucaugugccaugcaaccuucacaaugcgcuugcugucaccagugaggguccccaauuacaacaugauuaucauggaugaagcccacuuuaccgacccuucuagcaucgccgcucguggguauauuaguacucggguaggaaugggcgaggcggcagccaucuucaugacagcuaccccgcccgguuccguggaagccuuuccacagagcaaugcaguuauacaggaugaggaaagagacauuccugagaggucuuggaacucaggguacgaguggaucacggauuuccccggaaaaacugugugguuugucccauccauuaagaguggcaaugacaucgccaacugucuccgcaagaauggcaaacgagugauacagcugagcagaaagacauucgauaccgaauaucagaaaaccaagaacaacgacugggacuacguugugacuacagauauuucggagaugggggcuaauuuucgggcggacagggucaucgauccucgccguugccuuaaacccgugauccuaaaggacggaccagaaagaguaauucuggccgguccgaugccugugaccguugcaucugcugcccagcggaggggccgcaucgggcgaaaccauaauaaggagggagaucaguacauuuauaugggccagcccuugaacaaugacgaggaucacgcacacuggacagaagccaaaauguuacuggacaacauaaauacuccagaggguaucauucccgcucucuucgaaccugagagagaaaaguccgccgcgaucgauggggaguaccggcugaggggcgaggcacgcaaaacguucgucgaacuuaugagaaggggagaccugccaguguggcucagcuauaagguggccucagagggcuuucaauacagugaucggcguuggugcuucgacggggaacgcaacaaucaggucuuggaggaaaacauggauguugagaucuggaccaaagagggagaacgaaagaaacugagacccagguggcuagacgcucggacauauucugacccucuggcccuccgcgaguuuaaggaguucgcugcagguagaagguccgugagcggcgaucuuauucuggagauagggaaguuaccgcagcauuugacucagcgggcccaaaaugcucuggacaaccucguaaugcugcacaauucagaacagggaggccgagccuacagacaugcaauggaggagcuuccagauaccaucgaaacacugaugcucuuggcgcugauugccguguuaaccgguggggucacucuauuuuuccugaguggccgcggacucggcaaaacgagcaucgggcuucugugugugauggcuuccucuguuuugcuguggauggccagcguggagccccacuggauugcagcuuccaucauacucgaauuuuuccugaugguccuucucaucccugagcccgacaggcagcggaccccacaggauaaccaacuggccuauguagugauuggauugcuguuuaugaucuuaacaguugcagccaaugagaugggucuacuggaaacuaccaagaaagaccucggcauugggcacguggcugucgagaaccaucaccaugcgacaaugcuugauguggaccugcacccugccucagcauggaccuuguacgcugucgccacuacaaucauaacgcccaugaugcgucauaccauugaaaacacuacagccaauaucucucugaccgcaauugcuaaccaggccgcgauccucaugggacuggauaagggcuggccaauaaguaaaauggacaucggugugccucuuuuagcucuggggugcuacucgcagguuaauccgcucaccuugacagccgcagugcugaugcuaguagcccacuaugcuauuaucggccccggacugcaagcaaaggccacuagagaggcgcagaagaggacggcugccggcauuaugaaaaacccaaccguggaugggaucgucgcaauagaccucgauccuguuguguacgacgccaaguucgaaaaacagcuuggacagauuaugcuguugauccuguguacaagccaaauccuccugaugcgcacuaccugggcuuuaugcgaguccauuacacuugccaccggcccccugacuacgcucugggaggguucuccagggaaguuuuggaauacaaccaucgcagucucaauggcuaacauauuccggggaagcuaucuagccggcgcgggucuggccuuuuccuugaugaaaagucugggcgggggacgaagaggcacuggggcacagggagaaacccucggcgagaaguggaagaggcagcuuaaucagcugucuaaaagcgaguucaacauuuacaagcgcucagguaucauggagguggaccgguccgaagcuaaagagggguugaagagaggagagacaacucgucacgccguaaguaggggcaccgcaaaacugcggugguucguggaacgcaaucucguuaagccugaggguaaggugauugauuuaggcugugggcgaggaggcuggagcuauuacugcgcugggcugaaaaaggucacagaagugaaaggauauacgaagggcggucccgggcaugaggaaccgaucccaauggccaccuacggauggaaccuugucaaacugcacucuggcaaggacguguuuuucacuccucccgagaaaugugauacacuacucugcgacauaggcgaguccucaccaaaucccaccaucgaagaggggagaacucugaggguuuugaagaugguagaaccuuggcugcggggaaaccaauuuuguauuaagauccucaauccguacaugcccagcguggucgagacacuugagcagaugcagcgcaaacaugguggcaugcuggugagaaacccauuaucgagaaauucuacccacgaaauguauuggguuaguugcgggacgggaaacauuguguccgccgucaauaugaccagccgaaugcuguugaaccgguucacaauggcgcaccguaagccuacuuacgagagagauguggaccucggcgcugguacccgccauguagcaguggaacccgagguugccaaccuggauaucauugggcagaggaucgaaaauauaaaacacgagcauaagucaacauggcacuaugacgaggauaacccuuacaaaacuugggcuuaucauggauccuacgaagucaagccaucuggcagcgccaguuccauggugaauggcguggucaagcuacuuaccaaacccugggacguuauuccuauggugacacaaaucgcaaugaccgauacuacgccauuugggcagcagcggguauucaaggagaaaguggacacaagaacccccaaggccaaacgcggaacugcucaaaucauggaagucaccgcgagguggcugugggguuuucucagccgaaacaagaagccgcggauuuguacaagagaggaguucacgaggaaagugcgcucuaaugccgcaauaggcgcuguuuuuguggacgagaaccaguggaacucagccaaggaggcagucgaagaugagcguuucugggaccuggugcagaaagaacgggaguugcacaagcaggggaaaugcgcaaccugcguauauaacaugaugggaaagagagaaaagaaacugggcgaguuugguaaggcuaaagggaguagggccaucugguacauguggcucggagcgcgcuuccuugaguuugaagcacugggcuucaugaaugaggaucacugguucucccgagaaaacagcuuaucuggcguugagggggagggacugcauaaguuggguuacauucuccgggacaucucgaaaauuccuggcgggaauauguaugccgaugacacugcuggaugggauacaagaaucaccgaagacgaucugcaaaacgaggccaagauaacugacaucauggaaccagagcacgcacuacuugcuacaucaauuuuuaaacugaccuaccagaauaagguggucagggugcagcgccccgccaagaacggcacagugauggaugucaucagcagacgggaccagagggguuccgggcaaguuggaacuuauggccucaauaccuucacgaacauggaagcucagcugauucgucagauggagagugagggcaucuuuuugccuucugaauuagagaccccaaaccuggccgaacgagugcucgauuggcuugagaaauacgggguagaacgccugaagagaauggcaauaagcggagacgacuguguggucaaacccauugaugaccgguucgcgacagcccuaacugcucugaaugauauggguaaggugaggaaagacaucccgcagugggagccuuccaagggcuggaacgauuggcaacagguucccuuuugcucacaucacuuccaccagcucaucaugaaggacgggcgcgagauuguggucccauguagaaaucaggaugaauuggugggacgggccaggguaagucaaggcgcagguuggucucugcgagagaccgcuugccuugggaaaagcuaugcccagauguggcagcugauguacuuucaucguagagaccuccgcuuagcagccaacgcgauauguuccgcuguuccuguggauuggguccccacaucacggacuaccuggagcauccacgcccaucaccaauggaugacgacagaagacaugcugucuguguggaauaggguuuggauugaggaaaacccauggauggaggauaagacccauguguccaguuggggagacguccccuauuugggcaaaagagaggaccaguggugcggcagccugaucgggcucacugcacgcgccacaugggcuucgaauauucagguggccaucaaccagguacggaggcuuauaggaaaugaaaacuaccuggauuacaugaccuccaugaagcgauucaaaaaugagggugacccugaaggcgcacuaugguga

SEQ ID NO: 13639 - RNA, 9879 nt, Artificial Sequence
  derived and/or modified CDS sequence (opt3) from DENV-1__FJ410205__SS-prME
uccgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacgcugauugccauggaccucggcgagcugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaacuugccgagacgcagcacggaacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccgcagggaaacugguucaucagauuuucggaaccgcguacggcguguuguuuucuggugucagcuggacuaugaagauagggaucggcgugcuccugacaugguuaggacuaaauucacgaaguaccucccuaagcaugacauguauugcuguaggccucgugacucuguaccuugggguuaugguccaggccgauucuggaugcgugaucaacuggaaaggccgcgaauugaagugugguucagggaucuucgugaccaaugagguccacacguggacagaacaauauaaguuucaggcagacaguccgaaaagacugagcgccgcuauuggaaaggccugggaggagggcguuugcgguauaagguccgcaacccggcucgaaaacaucauguggaaacagauuucuaacgagcugaaucauaucuuacuggaaaacgacaugaaguucacuguggugguaggcgaugucgcugggauucuugcccagggcaagaagaugauccgcccucaacccauggaguacaaauauucguggaaaagcuggggcaaggcgaagauaaucggggccgacgugcagaauaccacauuuauuaucgauggaccaaacacuccugaaugucccgacgaucagagagcuuggaauauuugggagguugaggacuacggcuucgguaucuuuaccacaaacauaugguugaagcucagggauuccuauacacaggugugcgaccaccgucugaugucagcagccauuaaagauaguaaggcuguccacgccgacaugggguacuggaucgaaucugagaaaaaugaaaccuggaagcuagcacgggcgagcuucauugaggugaagacuuguaucuggccaaaaucccauacacuguggucaaacggaguucucgaaagcgagaugauaauccccaagauuuauggcgguccuaucucucaacacaauuaccgaccaggcuacuucacccagacugccgggccguggcaucugggaaaacuugaguuggauuuugaccugugcgaaggcacaaccgugguagucgaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgugaaagaaaaggaggaaaaucuugucaagagcaugguuucugcuggcuccggugagguggacucauuuagucugggcuugcucuguauuagcaucaugaucgaagagguaaugcgcucgcgauggucccggaaaaugcugaugacugggacacuagccguguucuuucugcucauuaugggacagcugaccuggaacgaucuuauccguuugugcauuauggucggcgcaaaugcuucugacagaauggggaugggaacaacuuaccuggccuuaauggcaaccuucaagaugaggccuauguuugccgugggccuccuguuccgccggcuuacgagcagagagguucugcuacucacaauaggucugucauugguggcuagugucgaacugccaaacuccuuagaggaacucggggauggacuggcgaugggcaucaugauucuuaaacuguugaccgacuuucaaucucaucagcucugggccacucugcuaagccugaccuucaucaagacaacuuuuucccuucacuaugcauggaaaaccauggcuauggugcucucaauuguuagccuguuccccuugugucugaguacgacaucucagaagaccacuugguuaccggugcuccugggcucccuugggugcaagccucugacaauguuuuugaucgccgagaauaaaauauggggaaggcgaagcuggccacucaacgaagguaucauggccgucggcauuguaucgauccugcuaucaucucugcuuaagaacgaugugccccucgcugggccucugauugcaggaggcauguugaucgccuguuacguuauaagugguuccagcgcggacuuaucucuggagaaagcugccgaggugagcugggaagaggaagcagagcauuccggggccucacacaauauucucgucgaagugcaggaugacggaaccaugaagaucaaagaugaggagcgcgacgauacucugacaauccuucugaaggcuaccuugcuagcaguaaguggcguguauccccugagcauuccagccacacucuucgucugguacuucuggcagaagaagaagcagcggucuggcguucugugggacacuccuucacccccagaaguggagagagcggugcuugaugacgggauauauaggaucaugcagcguggauuacugggucgcagccaggucggcguggggguuuuucaagaaaacguauuccauaccauguggcacgugacacggggagcuguccucauguaccagggcaaaagauuggagccgaguugggccagcgugaagaaagaccugauuuccuacggugggggauggaggcuccagggcucuuggaauaccggcgaggaaguucaggugaucgcagucgagccugggaagaaccccaaaaaugugcaaacagccccaggaacuuuuaagacccccgaaggugagguaggcgcuauugcccuggauuucaagccugggacgucgggaagcccaaucgucaaccgagaaggcaaaauagugggucuuuaugggaauggaguugugacaacuucaggcaccuacgucuccgcaaucgcucaggccaaggcgagucaggagggcccccugccugagauugaagacgagguguuucggaaacgcaacuugacaaucauggaucuacacccggggucuggaaagaccagaagguaucugccagccauuguucgggaagcaaucaaacgaaagcucagaacuuuaauacuggcucccacccgcguggucgccagcgagauggcugaagcacuuaaggguaugccuauuagguaccaaacaacggccgugaaauccgagcauacuggcaaggagaucguagaccugaugugccacgccaccuucacaaugcgucucuugucaccagugcggguucccaauuauaacaugaucauuauggaugaagcucauuuuaccgacccuucuagcaucgcggcaagaggguacauaaguacuagggucggaaugggcgaggccgcugccauuuucaugacagcaaccccgcccgguuccguggaagccuuuccacagagcaaugcugugauccaggaugaggaacgcgacauuccugagcgaucuuggaacucaggguaugaguggaucacggauuuccccggaaaaacugucugguuuguaccauccauaaagaguggcaaugacauugcgaacugucugaggaaaaauggcaagcgggugauccagcucagcaggaagacauucgauaccgaauaccagaaaaccaagaacaacgacugggacuacguugugacuacagauaucucggagaugggggccaauuuccgcgcagaccgugucauugauccuagacggugccugaaacccgugauccuuaaggacggaccagaaaggguuauucuagcugguccgaugccugugaccgucgccucugcagcccagcgccgaggcagaauagggcggaaccacaauaaagagggagaucaguauaucuacaugggccagccccugaacaaugacgaggaucaugcucacuggacagaagccaagauguuguuagacaacauuaauacuccagaggguaucauccccgcgcuguuugaaccugagagggaaaaguccgcagccauugauggggaguaucgccucagaggcgaggcuaggaaaacguucguggaacugaugcggcguggagaccuuccaguauggcugagcuacaagguggccucagagggcuuucaauauagugaucgccgauggugcuucgacggggaaagaaacaaucagguucucgaggaaaacauggaugucgagauauggaccaaagagggagaaaggaagaaauugcggccccgcuggcuggacgcuagaacauacucugacccucuagcacugagggaguuuaaggaguucgccgcuggucggcgauccgugagcggcgaucucauccuugagauugggaaacugccgcagcacuuaacucagagagcccaaaaugcauuggacaaccuggugaugcuccauaauucagaacagggaggccgcgcguauaggcacgccauggaggagcugccagauaccaucgaaacacuuaugcugcucgcuuugauugccguccugaccggugggguuacuuuauuuuuccuaaguggccggggacugggcaagacgagcaucgggcuccuuugugugauggcauccucuguacuguuguggauggcuagcguggagccccauuggauagccgcauccaucauucuggaauuuuuccucaugguccugcuuaucccugagcccgaccgucagagaaccccacaggauaaccaacucgccuacgugguuauuggacuguuguuuaugauccugacaguggcugcgaaugagauggguuuacuagaaacuaccaagaaagaccugggcauagggcacgucgccguagagaaccaccaucacgcagcuaugcucgauguggaccuucauccugccucagccuggacacuguacgcaguugcuaccacuauuaucacacccaugaugaggcacacgauugaaaacaccacugccaauaucucuuugacagcgauagcuaaccaggccgcaauccugaugggacucgauaagggcuggccaauuaguaaaauggacaucggugugccucugcuugccuuagggugcuauucgcaggucaauccgcugacccucaccgcugcaguguugaugcuggucgcccauuacgcgauuaucggccccggacuacaagcuaaggccacacgcgaggcacagaaacggacugccgcuggcauaaugaagaacccaacgguggaugggauuguugccaucgaccuggauccugugguauaugacgcaaaguucgaaaaacagcucggacagaucaugcuucugauuuuguguaccagccaaauccugcucaugcgaacaacuugggcucugugcgaguccauaaccuuagccacaggcccccuuaccacucugugggaggguucuccagggaaguuuuggaauacgacaauugcggugucaauggccaacaucuucagaggaagcuaccucgcaggcgcuggucuagccuucucccugaugaaaaguuugggcgggggaaggcgcggcaccggggcacagggagaaacucugggcgagaaguggaaacggcagcucaaucagcuuucuaagagcgaauuuaacaccuauaagagaucagguauuauggaggucgaccguuccgaagcuaaagaggggcugaagaggggagagacaacuaaacacgccguuagucggggcaccgccaaguugcgcugguucguggaacgaaaucuggucaaaccugaggguaaggugaucgaucucggcugugggagaggaggcuggagcuacuauugcgcgggguuaaagaaaguaacagaagugaagggauacacgaaaggcggucccgggcacgaggaaccgauaccaauggcuaccuacggauggaaccugguuaaacuucauucuggcaaagacguguuuuucaucccucccgagaagugugauacucugcuaugcgacauuggcgaguccucaccaaaucccacaaucgaagaggggaggacccuccggguccugaaaaugguggaaccuugguugcgcggaaaccaauuuuguauuaagauccugaauccguauaugcccagcgucguggagacucucgagcagaugcagagaaagcacgguggcaugcuuguuaggaacccacugucgcgaaauucuacacaugaaauguacuggguaaguugcgggaccggaaacauuguguccgcagucaauaugacgagccggauguuacugaaccguuucaccauggcccacagaaaaccuacauaugagcgcgauguggacuugggcgcugguacuaggcacguugccguggaacccgaggucgcaaaccucgauaucauagggcagcggauugaaaauaucaagcaugagcacaaaucaaccuggcauuacgacgaggauaacccuuauaagacaugggccuaccacggauccuaugaagugaaaccaucuggcagcgcuaguuccaugguaaauggcgugguuaagcugcuaacuaagcccugggacgucaucccuauggugacccaaauugcgaugacagauaccacuccauuugggcagcagagaguguucaaagagaaggucgacacgcgcacacccaaagccaagaggggaaccgcacaaauaauggaaguuacugcuaaauggcuuugggguuuucugagccgaaacaagaagccgcggaucuguaccagagaggaguucacaaggaaagugcgcucuaaugccgcaauuggcgccguauuuguggacgagaaccaguggaacucagcuaaggaggccgucgaagaugagcguuucugggaccucgugcaucgggaaagagagcugcacaaacaggggaagugcgcgacgugcguuuacaacaugaugggaaaaagggaaaagaaguugggcgaguuugguaaagcaaaggggagucgcgccaucugguacauguggcugggagcucgauuccucgaguucgaagcccuuggcuuuaugaaugaggaucacugguucucccgggaaaacagccugucuggcguggagggggagggauuacauaaacuggguuauauuuugagagacaucucgaagauaccuggcgggaauauguacgcagaugacaccgcuggaugggauacuaggaucacagaagacgaucuccagaacgaggcccgcauuaccgacaucauggaaccagagcacgcucugcuagccaaaucaauuuuuaaacuuacuuaucaaaauaaagucgugagaguacagcggcccgcaaagaacggcacaguuauggaugugaucagcaggcgugaccagcgagguuccgggcaggucggaaccuacggccugaauacauucacuaacauggaagcgcaacucauacgccagauggagagugagggcauauuuucuccuagcgaacuggagaccccaaacuuggccgaaagaguguuagauuggcuggagaaguaugggguggaacggcucaaaaggauggcuaucuccggagacgacugugucguuaagcccaucgaugaccgcuucgccacggcacuuaccgcucugaaugauauggguaaagugagaaaggacauuccgcagugggagccuucaaaaggcuggaacgauuggcagcaaguacccuuuugcagucaucacuuccaccagcuaauaaugaaggacgggcgggagaucguggucccauguaggaaucaggaugaacuggugggacgagcccguguuucucagggcgcagguuggagccucagagagacagccugcuuggggaaguccuacgcgcaaauguggcagcugauguauuuucaucgccgggaccuuaggcuggcugccaacgcaauuuguucagccgugccugucgauuggauccccacuagcagaaccacauggucuauucacgcucaucaccaguggaugacuaccgaagacaugcucuccguguggaaucgcguauggaucgaggaaaacccauggauggaggauaaaacgcauauaaguagcuggggagacguucccuacuuaggcaagcgggaggaccaauggugcggcucgcugaucggguugacagccagggcaaccugggcuacuaauauucagguggccaucaaccagguccgaagacugauuggaaaugaaaacuaccucgauuauaugacauccaugaaacgguucaagaaugagucugacccugaaggugcgcuuugguga

SEQ ID NO: 13640 - RNA, 9879 nt, Artificial Sequence
  derived and/or modified CDS sequence (opt3) from DENV-1__FJ410207__SS-prME
agcgugaccaugcugcucaugcuuaugcccacagcacuggcuuuccacuugacuacgaggggcggggaaccucauaugaucgucuccaagcaggaaagggggaagucuuuacuguuuaagaccucagccgguguuaauaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaugguuauugcacucuuccuggcccaugcuaucggcaccucgauuacacagaagggcaucauauuuauccugcucauguuagugaccccaucaauggccaugcgcugcgucgggauuggaagcagagauuucguggagggucugaguggcgcgacguggguagacguugugcuugagcacggguccugugucacuacaauggcaaaggauaaacccaccuuggacaucgaacugcuaaagacugaggugacaaacccugccgugcucaggaaacugugcauugaagcuaagaucucuaauaccacgaccgauagccgguguccaacacaaggagaggccacucuugucgaagaacaggacgcaaacuuuguuugccgccgaaccuucguggauagaggcugggguaauggguguggacuguuuggcaaaggcuccuugauaacaugcgcuaaguucaagugcguaacuaaacucgaggggaagaccgugcaguacgaaaaccugaaauauucagucauugugacaguucacaccggagaccagcaucaaguggguaaugagaguacugaacacggcacgacagccaccaucacuccccaggcgccuagcaccgagauucaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuaucuucgccggccaucugaagugccguuuaaaaauggauaagcugacccuaaaagggaugagcuaugugauguguacaggaucguucaagcucgagaaggaagucgcugagacucagcacgguaccgugcugguucagauuaaauacgagggcacggacgcgccuugcaagauaccauuuucuacacaggaugaaaaaggggugacccaaaacggacgccuuaucacugcaaaucccauuguaacagacaaggagaaauuggucaacaucgaagccgagccuccauucggcgaguccuauauagugauuggugcuggggaaaaggcccugaagcucucaugguuuaaaaagggcaguagcaucggaaaaauguucgaggcaaccgccagaggcgcuaggcggauggccauccugggggauacugcaugggacuuuggauccauugguggcguuuucaccucuguggggaaacuuguccaucagaucuuuggaacagcguacggcgugcuguucagcgguguaucauggacgaugaaaauugggauaggcguguugcucaccuggcugggauuaaauagucgauccacuagccugucuaugacauguaucgcuguuggccuagucacccucuaccugggggugauggugcaggccgauucaggaugcgucauuaacuggaagggccgcgaacuuaagugugguagugggaucuuuguuacaaaugaggugcacacuuggaccgaacaguauaaauuccaagcagacagccccaagagauuguccgccgcuaucggaaaagccugggaggagggcgugugcgguauuaggucugcaacgcggcuggaaaacauaauguggaagcagaucucgaacgagcucaaucauauucuguuagaaaacgacaugaaauuuacaguagucgugggcgauguugcugggauccuggcccagggaaagaaaaugauucgcccgcagccuauggaguacaaguauagcuggaaguccuggggcaaagcgaagaucauaggggccgacgugcaaaauaccacuuucaucauugauggacccaacaccccagaauguccugacgaucagagagcuuggaauaucugggaggucgaggacuacggcuuugguauuuucacaacuaacaucuggcuuaaauugagggauucauauacccaggugugcgaccaccgucucaugagugcagccauaaaggauucuaaagcuguucacgccgacaugggguacuggauugaaagcgagaagaaugaaacauggaagcuggcacgggcguccuucaucgaggugaaaacguguauuuggcccaagucacauacccuauggagcaacggaguacuggaaucugagaugaucauaccaaaaaucuauggcggucccauuucccagcacaauuaccgaccuggcuacuuuacucaaacagccgggccauggcaucucggaaagcuggagcuugauuucgacuugugcgaaggcaccacugucgugguggaugagcacugcgggaacagaggaccgagucugaggacaaccacggucacuggcaaaaucauucacgaaugguguugccgcagcuguaccuuacccccucuccgguuuaagggugaggacgggugcugguauggaauggagaucagaccaguuaaggaaaaagaggaaaaucuggugaagucuaugguauccgcuggcucaggugagguggacaguuucagccuuggccuguuguguauaucgauuaugaucgaagaggucaugaggucccgcuggucucgaaaaaugcucaugacagggacccuggccguguuuuuccuacugaucaugggacagcucacuuggaacgaucugauucggcuuugcaucaugguuggcgcaaaugcuagcgaccguauggggaugggaacaaccuacuuggcccugauggcaacauuuaagaugagacccauguucgccgugggcuuacucuuuaggcgccugacuucacgggagguccuucugcuaaccauuggucucagucugguggcuuccguugaauugccuaacucucuggaggaauuaggggauggacucgcgaugggcauaaugauccugaaacuucugacggacuuccagagccaucaauugugggccacacuccugucccuaaccuuuauuaagacuaccuucucacugcacuaugcauggaagacaauggcuauggugcuuagcaucgucagucucuuuccacuguguuugucuacuaccucccagaaaacgacauggcugcccguauuacucggcagccuggggugcaagccgcuuaccauguuccugauugccgagaauagaaucuggggaaggaaaucguggccuuugaacgaagguauaauggccgugggcaucguuucaauucuccugucuagucuacugaagaacgaugugccacuugcugggccccucaucgcaggaggcaugcugauugccuguuacgucaucuccgguagcucugcggacuugagcuuagagaaagcugccgagguguccugggaagaggaagcagagcauucaggggccagucacaauauacugguagaagugcaggaugacggaacuaugaagauuaaagaugaggagcgagacgauacacucaccauccugcuuaaggcuacucuguuggcagucagcggcguuuauccucuaucuauccccgccacacuguucgugugguacuuuuggcagaagaaaaagcaacgcuccggcgugcucugggacaccccaucaccucccgaagucgagcgggcggugcuggaugacgggauuuauagaauaaugcagaggggacuuuuaggucguagucagguuggcguagggguguuccaggaaaacgucuuucauacgauguggcacgugacucgcggagcuguucugauguaccaaggcaaacggcucgagccaagcugggccuccgugaagaaagacuugaucucuuacggugggggauggagacugcagggcucguggaauaccggcgaggaaguccaggugauugcaguagagccggggaagaacccuaagaauguccagacagcccccggaaccuucaaaacaagcgaaggugaggugggcgcuaucgcccucgauuuuaagccagggacuucaggaucccccauuguuaacagggaaggcaaaaucgugggucuguaugggaauggagucgugaccacgaguggcacauacguuucugcaauagcucaagccaaggcgagccaggagggcccucuuccagagaucgaagacgagguguuccgaaaacggaaccugacuauuauggauuugcaccccggguccggaaagacccgcagauaucuaccugccaucgucagggaagcaauuaagcggaaacugcgaacacucaucuuagcuccgaccagagugguagccucagagauggcugaagcacugaaggguaugccaauacgcuaccagacuaccgccgugaaaucugagcauacaggcaaggagauuguugaccuuaugugccacgccacguuuacuaugaggcugcucagccccguccgugugccuaauuauaacaugaucaucauggaugaagcucauuucaccgacccaaguuccauugcggcacggggguacaucagcacaagagugggaaugggcgaggccgcugccauauuuaugaccgcaacucccccugguucugucgaagccuucccgcaaucaaaugcuguaauucaggaugaggaaagggacauccccgagcgcuccuggaacaguggguaugaguggauuacagauuuuccaggaaaaaccgugugguucguuccuagcaucaagucgggcaaugacauagcgaacuguuugcgaaagaauggcaaaagagugauucagcugucucggaagacguucgauacugaauaccagaaaacaaagaacaacgacugggacuacgucgugaccaccgauaucuccgagaugggggccaauuuuagggcagaccgcguuaucgauccccguagaugccucaaaccagugauucugaaggacggaccugaacgggucauccuugcuggucccaugccagugacuguagccagcgcagcccaaaggcgcggccgaauugggagaaaccacaauaaggagggagaucaguauauauacaugggccagccgcuaaacaaugacgaggaucaugcucacuggacagaagccaaaaugcuguuggacaacaucaauaccccugaggguauuauccccgcguuauucgaaccagagcgggaaaagucagcagccaucgauggggaguauaggcugcgcggcgaggcuagaaaaacauuuguggaacucaugaggcggggagaccugcccguuuggcuuaguuacaaggucgccucugagggcuuccaguauuccgaucgucgcuggugcuuugacggggaacgaaacaaucaagugcuggaggaaaacauggauguggagauuuggacuaaagagggagaaagaaagaaacucaggccucggugguuggacgcucgcacguacagcgacccacuggcacuaagagaguucaaggaauuugccgcugguaggcggucagucaguggcgaucugauacucgagaucgggaaacuuccccagcaccugacccagcgagcccagaaugcauuagacaacuugguuaugcugcauaauagcgaacaaggaggcagagcguaucgccacgccauggaggagcucccugauacaauugaaacucugaugcuucuggcucucaucgccguguugaccggugggguaacacuguucuuuuuauccggcaggggacuaggcaaaaccucuauugggcugcucugugugauggcaagcuccguccuucuguggauggcuucaguggagccgcauuggaucgccgcaucuauaaucuuggaguucuuucugaugguucuccugauuccagagcccgaccggcagcguacuccucaggauaaccagcuugccuacguggucaucggacuccuguucaugauuuugacgguagcugcgaaugagaugggucuguuagaaaccacaaagaaagaccuaggcaucgggcacguggccguugagaaccaccaucacgcagcuaugcuggauguggaccuccaucccgccagugccuggacucuuuacgcagucgcuaccacaauaauuaccccaaugaugagacacacuaucgaaaacacaacggccaauauuucgcugaccgcgaucgcuaaccaagccgcaauauugaugggacuggauaagggcuggccuaucagcaaaauggacauuggugugccccuccuggcccuugggugcuauucccaggucaauccauuaacucugacagcugcagugcucauguugguugcccauuacgcgaucauuggcccuggacugcaggcuaaggccaccagggaggcacaaaagcgcaccgccgcuggcaucaugaaaaacccgacaguggaugggauaguagccauugaccuagaucccguggucuaugacgcaaaguuugaaaaacagcugggacagaucaugcuccuuauccuguguacuucucagauuuugcugaugcggacgaccugggcucucugcgagucaaucacacuggccacuggcccauuaaccacacuuugggaggguagcccugggaaguucuggaauaccacuauagcgguuuccauggccaacauuuuccgaggaaguuaccuggcaggcgcuggucucgccuuuucucuaaugaaaagccugggcgggggaagaaggggcacgggggcacaaggagaaacauugggcgagaaguggaagcgccagcugaaucagcucucaaaauccgaguucaacaccuauaagcggagugguaucauggagguggacagaagcgaagcuaaagaggggcuuaagcguggagagacuaccaaacacgccgucucuaggggcacagccaagcugcggugguuuguggaacgcaauuugguaaagcccgaggguaaagugauugaucugggcugugggcgaggaggcugguccuacuauugcgcggggcucaagaaaguuacugaagugaagggauacaccaaaggcgguccagggcacgaggaaccuauccccauggcuacauacggauggaacuuagucaagcugcauucaggcaaagacguguucuuuacgccgccagagaagugugauacccuucugugcgacauaggcgagagcucgccuaaucccacuaucgaagaggggagaacacuaaggguccucaagaugguggaaccauggcugcggggaaaccaguucuguauuaaaaucuugaaucccuauaugccuucuguuguagagacccuggagcaaaugcagcgcaagcacgguggcaugcucgugagaaacccgcuuaguagaaauuccacucaugaaauguacugggucagcugcgggacaggaaacauugugucagcaguuaauaugaccucccgaaugcuguuaaaccgguuuacgauggcccaccguaaacccaccuaugagagagauguggaccugggcgcugguacacgccacgucgccguggaaccagagguagcaaacuuggauaucauugggcagaggaucgaaaauauaaagcaugagcacaaaucuacuuggcauuacgacgaggauaacccuuauaagaccugggccuaccacggaagcuaugaagugaagcccaguggcuccgcuagcucuaugguuaauggcgucgugaaacuccugacaaagccuugggacgugauuccaauggucacucagaucgcgaugaccgauacaacccccuucgggcaacagcggguuuuuaaagagaagguggacacuagaacgccuaaagccaagcgcggaacagcacagaucauggaaguaaccgcuaaguggcuaugggguuuccuuucaaggaacaaaaagccacgaauuuguacucgggaggaauuuaccagaaaagugaggaguaaugccgcaauaggcgccgucuucguggacgagaaccaauggaacuccgcuaaggaggccguugaagaugagcgcuuuugggaccuggugcaucgugaacgggagcuccacaaacaggggaagugcgcgacaugcgucuacaacaugaugggaaagagagagaagaagcugggcgaguucgguaaagcaaaggggagcagggccaucugguacaugugguugggagcucgcuuccuggaguuugaagcccucggcuucaugaaugaggaucacugguuuucucgagaaaacucgcuuucaggcguggagggggagggacugcauaaauuagguuauauucugcgggacaucagcaagauucccggcgggaauauguacgcagaugacacggcuggaugggauaccagaaucacugaagacgauuugcagaacgaggccaaaauaacagacaucauggaaccggagcacgcucuccuggccaaguccauuuucaagcuaaccuaucagaauaaaguaguuagggugcaacgcccugcaaagaacggcacugucauggaugugaucaguagacgggaccagagggguucuggacaggugggaacauacggccuuaauaccuuuacaaacauggaagcgcagcugauucgucaaauggagagcgagggcaucuucuccccaucagaacucgagacucccaaccuggccgggcgagucuuggauugguuagaaaaacauggaguugagcgccugaagagaauggcuauaaguggugacgacugugugguaaaaccuauugaugaccgguuugccaccgcacucacggcucuuaaugauaugggcaaggugaggaaggacaucccacagugggaacccucuaaaggguggaacgauuggcagcaggucccguucugcagccaccacuuucaucaacugaucaugaaggacggacgcgagauugugguuccuuguagaaaucaggaugagcuagugggccgggccagggucucccagggugcaggguggucacugcgagaaaccgccugccucggaaaaagcuaugcgcagauguggcaauugauguacuuccaccguagagaccugcgccuugcugccaacgcaauauguucugccgugcccguagauuggguuccaacaucccggacuaccuggaguauccaugcucaccaucaguggaugacaacugaggacaugcugagcguguggaauagggucuggauugaagagaacccuuggauggaagauaagacccacaucucguccuggggcgacgugcccuaucucggcaaaagagaggaccaguggugcgggucuuuaauuggacugacggcccgcgcaacaugggcuaccaauauccaaguugccauaaaccaggugcggagguugaucgguaaugagaacuaccuggauuacaugacuucaaugaagcgauuuaagaaugaaagcgacccagagggcgcgcucugguga

SEQ ID NO: 13641 - RNA, 9879 nt, Artificial Sequence
  derived and/or modified CDS sequence (opt3) from DENV-1__FJ432744__SS-prME
agcgugaccaugcugcuaaugcuuaugcccaccgcacuggcuuuccacuugacuacgagaggcggggaaccucauaugaucgucuccaagcaggaaaggggaaaaucuuuacuguuuaagaccucagccgguguuaacaugugcacccugauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaagcauggcuagugcauaagcagugguuccuggaucucccgcugcccuggaccuccggcgcuucaacuagccaagagacauggaaucggaaagaccuucugguaaccuuuaagacagcccacgcuaagaaacaggaaguuguggucuuggguagucaggagggggccaugcacacugcacucaccggcgccacggaaauccaaaccucuggaacaacuaccaucuucgcuggccaucugaagugccguuuaaaaauggauaagcugacacuaaaagggauguccuaugugauguguacugggagcuucaagcucgagaaggaagucgcggagacccagcacgguacggugcugguucagauuaaauacgagggcacagacgcaccuugcaagauaccauuuucgacccaggaugaaaaaggggugacucaaaacggacgccuuaucacagccaaucccauuguaaccgacaaggagaaaccugucaacaucgaagcugagccacccuucggcgagucuuauauagugauuggugccggggaaaaggcauugaagcuguccugguuuaaaaagggcucaaguaucggaaaaauguucgaggccacugcuagaggcgccaggcggauggcaauccucggggauaccgcgugggacuuuggaagcauugguggcguuuucacauccguggggaagcugguccaucagaucuuuggaacggcuuacggcgugcuuuucucugguguaagcuggaccaugaaaauugggauaggcgugcuguugacuuggcucggacuaaauucacgaaguacauccuuaagcaugaccuguaucgccguuggccuggucacacuauaccucggggugauggugcaggcagauucuggaugcgucauuaacuggaagggccgcgaacugaagugugguucagggaucuuuguuacuaaugaggugcacaccuggacggaacaguauaaauuccaagccgacaguccgaagagacuuagcgcugccaucggaaaagcaugggaggagggcgugugcgguauuagguccgcuacacgguuggaaaacauaauguggaagcagaucucuaacgagcugaaucauauucuccuggaaaacgacaugaaauuuaccguagucgugggcgauguugccgggaucuuagcgcagggaaagaaaaugauucgcccucagcccauggaguacaaguauucguggaaaagcuggggcaaagccaagaucauaggggcugacgugcaaaaugcaacuuucaucauugauggaccaaacaccccugaaugucccgacgaucagagagccuggaauaucugggaggucgaggacuacggcuuugguauuuucacaacuaacaucuggcugaaacuuagggauuccuauacccaggugugcgaccaccguuugaugucagcugccauaaaggauaguaaagcaguucacgcggacaugggguacuggauugaaucugagaagaaugaaacauggaagcucgcccgggcuagcuucaucgaggugaaaacguguauuuggccaaagucccauacccuguggucaaacggaguacuagaaagcgagaugaucauacccaaaaucuauggcgguccuauuucucagcacaauuaccgaccaggcuacuuuacucaaacagccgggccguggcaucugggaaagcucgagcuggauuucgaccuuugcgaaggcaccacugucgugguggaugagcacugcgggaacagaggacccuccuugaggacaaccacggucacuggcaaaaucauucacgaaugguguugccgcaguuguacccugccuccauuacgguuuaagggugaggacgggugcugguauggaauggagaucagacccguuaaggaaaaagaggaaaaucucgugaaguccaugguaucugcaggcuccggugagguggacucauucagucugggccuucuguguauaagcauuaugaucgaagaggucaugaggucgcgcuggucccgaaaaauguugaugacagggauccucgcuguguuuuuccugcuaauuaugggacagcugaccuggaacgaucucauccggcugugcauuaugguuggcgccaaugcaucugaccguauggggaugggaacuacauaccuugccuugauggcuaccuuuaagaugagaccuauguucgcggugggccuguuauuuaggcgccucacaagccgggagguccugcuucugacuauaggucuaucacucguggccaguguugaacugccaaacuccuuggaggaacugggggauggauuagcaaugggcaucaugauucucaaacugcuuaccgacuuccagucucaucaacugugggcuacguugcucagccugacauuuaucaagaccacuuucucccuacacuaugccuggaagaccauggccauggugcugucaauugucagccuuuuuccccucugucugaguacaacuucucagaaaaccacgugguugccgguacuguuaggcucccucgggugcaagccucugacaauguuccuuaucgcugagaauaaaauauggggaagaaagagcuggccacugaacgaagguaucauggcagugggcauuguuucgaucuugcucucaucucugcucaagaacgaugugccccuggccgggccucuuauugcgggaggcaugcucaucgcuuguuacgucauaagugguuccagcgccgaccugucuuuggagaaggcagccgaggugagcugggaagaggaagcugagcauuccggggcaucacacaauauuuuaguagaagugcaggaugacggaaccaugaaaaucaaggaugaggagagggacgauacucugacaauccuccugaaggccacccuucuggcggucaguggcguuuaucccuugagcauuccagcuacucuauucgugugguacuuuuggcagaaaaagaaacgacgcucuggcgugcugugggacacaccuucacccccagaagucgagcgggccgugcucgaugacgggauauauagaaucaugcaaaggggacugcuuggucguagccagguuggcguagggguguuccaggaaaacgucuuucauaccauguggcacgugacgcgcggagcaguuuuaauguaccagggcaagcggcuggagccgaguugggccagcgugaaaaaggaccucauuuccuacggugggggauggagauugcaaggcucuuggaauacuggcgaggaaguccaggugaucgcuguagagccugggaagaaccccaaaaauguccagaccgccccaggaacauucaagaccucggaaggugaggugggcgcaauugcucuggauuuuaaacccgggacaagcggaucaccuaucguuaacagggaaggcaagauagugggucucuaugggaauggagucgugacuaccuccggcacguacguuagugccaucgcgcaggccaaagcaucucaagagggcccacugcccgagauugaagacgagguguuccgaaagcggaaccuuacaaucauggaucugcacccugggagcggaaagacucgcagauauuugccggcuauugucagggaagccaucaaacggaagcuacgaacccugauacucgcuccaacaagagugguagcauccgagauggccgaagccuuaaaagguaugcccauucgcuaccagaccacugcugugaagucagagcauaccggcaaagagaucguugaccugaugugccacgcgacauuuacgaugaggcuucugucuccuguccgugugccaaauuauaacaugaucauuauggaugaagcacauuucacugaccccagcaguaucgccgcucggggguacauauccaccagagugggaaugggcgaggccgcagccauuuuuaugacagcuaccccuccggguagcgucgaagcguucccccagucuaaugccguaauccaagaugaggaaagggacauuccagagcgcucauggaacuccggguaugaguggaucacugauuuuccuggaaagacagugugguucguucccaguauaaagagcggcaaugacauugcaaacugucucagaaagaauggcaagagagugauccaguugucgcggaaaaccuucgauacggaauaccagaagacuaaaaacaacgacugggacuacgucgugacaaccgauaucucugagaugggggcuaauuuuagggccgaccgcguuauugauccacguagaugccugaagccugugauccucaaggacggacccgaacgggucauucuggcagguccaaugccggugaccguagccuccgcugcccagaggcgcggccgaauagggagaaaccacaauaaagagggagaucaauauaucuacaugggccagccucuuaacaaugacgaggaucaugcgcacuggacugaagcaaagaugcuacuggacaacauuaauacacccgaggguaucaucccagccuuguucgaacccgagcgggagaaaagcgcugccauugauggggaguauagguuacgcggcgaggcuagaaagaccuuuguggaacugaugaggcggggagaccucccuguuuggcugucauacaaagucgcaagugagggcuuccaguauucugaucgucgcuggugcuuugacggggaacgaaacaaucaggugcuugaggaaaacauggauguggagauauggacaaaggagggagaaaggaaaaagcugcgaccacgguggcucgacgcccgcacuuacuccgaccccuuggcucugagagaguucaaggaauuugccgcagguaggcggagcgucucaggcgaucuaauccuggagauugggaaacucccucaacaccuuacgcagcgagcgcagaaugcccuggacaacuuaguuauguugcauaauagugaacagggaggcagagcuuaucgccacgccauggaggagcugccggauaccaucgaaacacucaugcugcuugcacugauugcugugcucacuggugggguaaccuuguucuuucugagcggcaggggauuaggcaagacauccaucgggcuacugugugugauggccucuagcguccuccuuuggauggcauccguggagccacauuggauagccgcuucaaucauucuggaguucuuuuugaugguucugcucauccccgagccugaccggcaacguacaccccaggauaaccagcuggcguacguggucauuggacuucucuucaugauccugacuguagccgcaaaugagauggguuugcuggaaacgaccaaaaaggacuuaggcauagggcacguggcuguugagaaccaccaucacgccgccaugcuagauguggaccugcauccagcaucugcuuggacacucuacgccgucgcgacuaccauuaucacaccuaugaugagacacaccauugaaaacacuacagcuaauaucagucuuacggccauagcaaaccaggccgcuauccugaugggauuggauaaaggcuggcccauuucgaagauggacaucggugugccacugcucgcacuggggugcuauagccaagucaauccucuuaccuuaacugccgcggugcugaugcucguugcucauuacgccauuaucggcccgggauugcaggcaaaggccacaagggaggcucagaaacgcaccgccgcaggcauaaugaagaaccccaccguggaugggauuguagcuaucgaccuggauccaguggucuaugacacaaaauuugaaaagcaacuaggacagaucaugcugcucauucuuuguacuucccagauccuguugaugcggacgaccugggcccugugcgagucuauaacacucgcgacuggcccucugaccacauuaugggaggguucacccgggaaauucuggaauaccacuauugccguuagcauggcaaacaucuuccgaggauccuaccuugcuggcgccggucuggcauuuagucucaugaagucucuaggcgggggaagaaggggcacgggggcucagggagaaacacugggcgagaaguggaaacgccaauugaaucagcugagcaagucagaguucaacaccuauaaacgguccgguauuauggagguggacagaagugaagccaaggaggggcucaaacguggagagacuaccaagcacgccgucagcaggggcacagcgaaacuucggugguuuguggaacgcaaucugguaaaaccagaggguaaggugaucgauuugggcugugggcgaggaggcuggucuuacuauugcgcugggcugaaaaagguuacugaagugaaaggauacaccaagggcgguccugggcacgaggaacccauaccgauggcaacauacggauggaaccucgucaaauuacauuccggcaaggacguguucuuuaucccaccugagaagugugauacgcugcuuugcgacauuggcgagucaagccccaauccaaccaucgaagaggggagaacucugaggguccuaaaaaugguggaacccuggcuccggggaaaccaguucuguauuaagauccugaauccuuauaugccgucgguuguagagacauuggagcagaugcaacgcaaacacgguggcaugcuggugagaaacccccucucuaggaauaguacccaugaaauguacugggucuccugcgggacuggaaacauugugagcgccguuaauaugacaucacgaaugcuucugaaccgguuuaccauggcucaccguaagccaacguaugagagagauguggacuuaggcgccgguacccgccacgucgcaguggaaccugagguagccaaccuggauaucauagggcagaggauugaaaauaucaaacaugagcacaaguccacauggcauuacgacgaggauaaccccuauaagacuugggcuuaccacggaucuuaugaagugaaaccuagcggcagugcguccagcaugguuaauggcgucgugaaguugcucaccaaaccaugggacgugauccccauggucacacagauugccaugacugauaccacaccuuucgggcagcaacggguuuuuaaggagaaaguggacaccagaacuccaaaggcaaagcgcggaacggcucagauaauggaaguaacagccaaauggcugugggguuuccuaucuaggaacaagaaaccccgaaucuguacccgggaggaauuuacuagaaaggugaggucaaaugcagccauuggcgcugucuucguggacgagaaccaguggaauagugccaaagaggcgguugaagaugagcgcuuuugggaccuugugcaucgugaacgggagcugcacaagcaagggaagugcgcaaccugcgucuacaacaugaugggaaaaagagaaaagaaacucggcgaguucgguaaggccaaaggguccagggcuaucugguacauguggcugggagcccgcuucuuggaguuugaagcacugggcuucaugaaugaggaucacugguuuagccgagaaaacucucucucgggcguggagggggagggacuucauaagcuggguuauauuuuacgggacaucucaaaaauaccgggcgggaauauguacgcugaugacacagccggaugggauacgagaaucaccgaagacgaucugcagaacgaggcuaagauuacugacaucauggaaccugagcacgccuugcucgcaaagagcauuuucaaacugacauaucagaauaagguaguuagggugcagcgcccagcgaaaaacggcaccgucauggaugugaucuccagacgggaccaaagggguaguggacaggugggaacuuacggccuaaauacauuuaccaacauggaagcccagcuuauacgucagauggagucugagggcauuuucagccccuccgaacuggagacaccuaaccucgcugggcgaguccuggauugguuggaaaagcauggaguugagcgcuuaaaaagaauggccaucucaggugacgacugugugguaaagccaaucgaugaccgguuugcaacugcucugaccgcccucaaugauaugggcaaggugaggaaagacauuccccaaugggaaccgaguaagggguggaacgauuggcagcaggucccuuucugcucucaccacuuucaucagcuuauaaugaaagacggacgcgagaucgugguucccuguagaaaucaagaugagcuggugggccgggcaagggucagccagggugccggguggucccuacgagaaacggcgugccugggaaagucauaugcucagauguggcagcucauguacuuccaccguagagacuugcgccuggccgcaaacgccauuuguagcgcugugccaguagauuggguuccuaccucucggacaacuugguccauccaugcccaccaucaauggaugaccacagaggacaugcuuaguguguggaauagggucuggauugaagagaaccccuggauggaagauaaaacucacaucagcucguggggcgacgugccauaucugggcaagagagaggaccaguggugcgggucccucauaggauuaaccgcacgcgcuacgugggccacaaauauccagguugcgauuaaccaagugcggaggcugaucgguaaugagaacuacuuggauuacaugaccucuaugaagcgauuuaaaaaugaaauugaccccgagggcgcucugugguga

SEQ ID NO: 13642 - RNA, 9879 nt, Artificial Sequence
  derived and/or modified CDS sequence (opt3) from DENV-1__FJ547060__SS-prME
agcgugaccaugcugcucaugcuuaugcccaccgcccuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaaaaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggcauccuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggcuccggugagguggacucauuuagucuuggccuguuguguauuagcaucaugaucgaagaggucaugaggucgcgcuggucccgaaagaugcucaugaccgggacucuggcuguguuccuacugcucauuaugggacagcugacauggaacgaucuuauccgguugugcauuaugguuggcgccaaugcaucugaccguauggggaugggaaccacauaucuggcuuuaauggccacuuuuaaaaugagaccuauguucgcagugggccuccuguuuaggcgccuuaccagccgggagguccugcuacucacgauaggucugucauugguggccaguguugaacugccaaacuccuuagaggaacucggggauggacuggcuaugggcaucaugauucuuaagcuguugacagacuuccaaucucaccagcucugggcgacccugcuaagccugacuuuuaucaaaaccacacuuucccuccauuacgccuggaagacuauggcaauggugcugucaauugucagcuuguucccccuguguuuaaguaccacgucucagaagacaaccuggcucccgguacugcuuggcucccuggggugcaaaccuuugacuauguuucucaucgcugagaauaagauauggggaagaaaaagcuggccacugaacgaagguaucauggccgugggcguugugucgauucuacugucaucucuucucaagaacgaugucccccuggccgggccuuugaucgcuggaggcauguuaauugcauguuaugugaucagugguuccagcgccgaccugucucucgagaaagcggcugagguaagcugggaagaggaagccgagcacuccggggcaucacauaauauacugguggaaguccaggaugacggaacaaugaagauuaaagaugaggagagggacgauacccuuacuauccuguugaaggccacacuacuggcuguuaguggcguguacccccucagcaucccagcaacccuguucgugugguauuuuuggcaaaagaaaaagcagcgaucuggcguccuuugggacacgccuucacccccagaaguggagcgcgccguuuuagaugacgggauuuaccggauaaugcagagaggacugcucgguaggagccagguaggcgugggggucuuccaagaaaacguguuccacacuauguggcacguuacccguggagcgguguugauguaucagggcaaacgccuggagccgaguugggcuagcgucaagaaagaccucaucuccuacggugggggauggcggcugcagggcucuuggaauacaggcgaggaagugcagguaauugccgucgagccugggaagaaccccaagaaugugcaaaccgcaccaggaacauuuaaaacucccgaaggugagguuggcgccaucgcucuugauuucaagccugggaccucgggaagcccaauugugaacagagaaggcaaaaucgucggucuguacgggaauggagugguuacgacaucaggcacuuauguguccgccauagcacagaccaaggcuagucaggagggccccuugccugagaucgaagacgaggucuuuaggaaacgaaaccuaacaauuauggaucugcauccggggucuggaaagacccggcgcuaccucccagccaucgugagagaagcgauuaagaggaaauuacggacucugauccuugcccccacccgaguaguggcaagcgagauggcugaagcccugaaggguaugccuauaagauaucaaacaacggcuguuaaauccgagcacacuggcaaggagauugucgaccucaugugccaugcaaccuucacaaugcgcuugcugucaccagugagggugcccaauuacaacaugaucaucauggaugaagcccacuuuaccgacccuucuagcauugccgcucguggguauaucaguacucgggucggaaugggcgaggcggcagccauauucaugacagcuaccccgcccgguuccguagaagccuuuccacagagcaaugcagugauucaggaugaggaaagagacaucccugagaggucuuggaacucaggguacgaguggauuacggauuuccccggaaaaacuguuugguuugugccauccaucaagaguggcaaugacauagccaacugucuccgcaagaauggcaaacgagucauucagcugagcagaaagacauucgauaccgaauaucagaaaaccaagaacaacgacugggacuacgugguuacuacagauaucucggagaugggggcuaauuuucgggcggacagggugaucgauccucgccguugccuuaaacccgucauucuaaaggacggaccagaaagagugauccuggccgguccgaugccuguaaccguggcaucugcugcccagcggaggggccgcauugggcgaaaccauaauaaggagggagaucaguacauauauaugggccagcccuugaacaaugacgaggaucacgcacacuggacagaagccaaaauguuacuggacaacaucaauacuccagaggguauuauccccgcucucuucgaaccugagagagaaaaguccgccgcgaucgauggggaguaccggcugaggggcgaggcacgcaaaacguucguugaacuuaugagaaggggagaccugccagucuggcucagcuauaagguggccucagagggcuuucaauacagugaucggcguuggugcuucgacggggaacgcaacaaucagguguuggaggaaaacauggaugucgagauuuggaccaaagagggagaacgaaagaaacugagacccagguggcuagacgcucggacauauucugacccucuggcccuccgcgaguuuaaggaguucgcugcagguagaagguccguuagcggcgaucuuauacuggagaucgggaaguuaccgcagcauuugacucagcgggcccaaaaugcucuggacaaccucgugaugcugcacaauucagaacagggaggccgagccuacagacaugcaauggaggagcuuccagauaccauugaaacacugaugcucuuggcgcugaucgccguauuaaccgguggggugacucuauuuuuccugaguggccgcggacucggcaaaacgagcauugggcuucugugugucauggcuuccucuguguugcuguggauggccagcguugagccccacuggaucgcagcuuccauaauccucgaauuuuuccugauggugcuucucauuccugagcccgacaggcagcggaccccacaggauaaccaacuggccuaugucguaaucggauugcuguuuaugauuuuaacaguggcagccaaugagaugggucuacuggaaacuaccaagaaagaccucggcaucgggcacguugcuguggagaaccaucaccaugcgacaaugcuugaugucgaccugcacccugccucagcauggaccuuguacgcuguggccacuacaauaauuacgcccaugaugcgucauaccaucgaaaacacuacagccaauauuucucugaccgcaaucgcuaaccaggccgcgauacucaugggacuggauaagggcuggccaaucaguaaaauggacauuggugucccucuuuuagcucuggggugcuacagccaggugaauccgcucaccuugacagccgcaguucugaugcuaguggcccacuaugcuaucauuggccccggacugcaagcaaaggccacuagagaggcgcagaagaggacggcugccggcaucaugaaaaacccaaccguagaugggauaguggcaauugaccucgauccugucguuuacgacgccaaguucgaaaaacagcuuggacagaucaugcuguugauccuguguacaagccaaauucuccugaugcgcacuaccugggcuuuaugcgaguccaucacacuugccaccggcccccugacuacgcucugggaggguucuccagggaaguuuuggaauacaaccauagcagugucaauggcuaacauuuuccggggaagcuaucuagccggcgcgggucuggccuuuuccuugaugaaaagucugggcgggggacgaagaggcacuggggcacagggagaaacccucggcgagaaguggaagaggcagcuuaaucagcugucuaaaagcgaguucaacaucuacaagcgcucagguauuauggaggucgaccgguccgaagcuaaagagggguugaagagaggagagacaacucgucacgccgugaguaggggcaccgcaaaacugcggugguucguagaacgcaaucucgugaagccugaggguaagguuaucgauuuaggcugugggcgaggaggcuggagcuauuacugcgcugggcugaaaaaggugacagaagucaaaggauauacgaagggcggucccgggcaugaggaaccgauaccaauggccaccuacggauggaaccuugugaaacugcacucuggcaaggacgucuuuuucacuccucccgagaaaugugauacacuacucugcgacaucggcgaguccucaccaaaucccaccauugaagaggggagaacucugaggguguugaagaugguugaaccuuggcugcggggaaaccaauuuuguaucaagauucucaauccguacaugcccagcguaguggagacacuugagcagaugcagcgcaaacaugguggcaugcuggucagaaacccauuaucgagaaauucuacccacgaaauguauugggugaguugcgggacgggaaacaucguuuccgccgugaauaugaccagccgaaugcuguugaaccgguucacaauggcgcaccguaagccuacuuacgagagagaugucgaccucggcgcugguacccgccauguggcaguagaacccgagguggccaaccuggauauuaucgggcagaggauagaaaauauuaaacacgagcauaagucaacauggcacuaugacgaggauaacccuuacaaaacuugggcuuaucauggauccuacgaaguuaagccaucuggcagcgccaguuccauggucaauggcguggugaagcuacuuaccaaacccugggacgucaucccuaugguuacacaaaucgcaaugaccgauacuacgccauuugggcagcagcggguguucaaggagaaaguagacacaagaacccccaaggccaaacgcggaacugcucaaauuauggaagugaccgcgagguggcugugggguuuucucagccgaaacaagaagccgcggauauguacaagagaggaguucacgaggaaaguccgcucuaaugccgcaaucggcgcuguguuuguugacgagaaccaguggaacucagccaaggaggcaguggaagaugagcguuucugggaccugguccagaaagaacgggaguugcacaagcaggggaaaugcgcaaccugcguguauaacaugaugggaaagagagaaaagaaacugggcgaguuugguaaggcuaaagggaguagggccauuugguacauguggcucggagcgcgcuuccuugaguuugaagcacugggcuucaugaaugaggaucacugguucucccgagaaaacagcuuaucuggcguagagggggagggacugcauaaguuggguuacauccuccgggacauuucgaaaaucccuggcgggaauauguaugccgaugacacugcuggaugggauacaagaauaaccgaagacgaucugcaaaacgaggccaagaucacugacauuauggaaccagagcacgcacuacuugcuacaucaaucuuuaaacugaccuaccagaauaagguugugaggguccagcgccccgccaagaacggcacagugauggaugugauuagcagacgggaccagagggguuccgggcaagucggaacuuauggccucaauaccuucacgaacauggaagcucagcugguucgucagauggagagugagggcaucuuuucuccuugugaauuggagauaccaaacuuagccgaacgagugcuggauuggcucgagaaauacgggguagaacgccuuaagagaauggcaauuagcggagacgacugcguggucaaacccaucgaugaccgguucgcgaccgcccugacagcucuaaaugauauggguaaggugaggaaagacguuccgcagugggagccuuccaagggcuggaacgauuggcaacaggugcccuuuuguucacaucacuuccaccagcugaucaugaaggacgggcgcgagauugucgugccaugcagaaaucaggaugaacucguaggacgggccaggguuagucaaggcgcagguuggucuuugcgagagacugcuugucuggggaaaagcuaugcccagauguggcagcuuauguacuuucaucguagagaccugcgccucgcagccaacgcgauaugcuccgcugugccugucgauugggugcccaccucacggacaacuuggagcauccacgcccaucaccaauggaugaccacggaagacauguuaucuguuuggaauaggguguggauugaggaaaacccauggauggaggauaagacacaugucuccaguuggggagacgugcccuaucugggcaaaagagaggaccagugguguggcagcuugaucgggcugaccgcacgcgccacuugggcuucgaauauucagguagccaucaaccaggugcggaggcucauaggaaaugaaaacuaccuugauuacaugacauccaugaagcgauucaaaaaugagggugacccugaaggcgcacugugguga

SEQ ID NO: 13643 - RNA, 9879 nt, Artificial Sequence
  derived and/or modified CDS sequence (opt3) from DENV-1__FJ432745__SS-prME
agcgugaccaugcugcucaugcuuaugcccacagcccuggcuuuccacuugacuacgagaggaggggagccucauauggucguuuccaagcaagaaagaggaaaaucuuuacuguuuaagaccucagcgggugugaauaugugcacacugaucgccauggaccucggcgagcugugugaagauacuaugaccuacaaaugcccacggauuacagaggcggaaccggacgauguagacuguuggugcaaugcuaccgauacuugggugacauaugggaccuguagucaaacgggagagcaccgccgagacaagcguagcgucgcccuugcaccccaugugggccuggguuuggagacuagaaccgaaacauggauguccucugagggggccuggaaacagauacagaggguugaaacuugggcucuccggcacccuggauucaccgugaucgcacuguuucuggcccaugcuauuggcacaucgaucacccagaagggcauuaucuucauacucuuaaugcuggucacgccaucaauggccaugcgcugcguggggaucggaagcagagauuuuguagagggucuuaguggcgcgacuuggguugacguggucuuggagcacggguccugugugacaaccauggcaaaggauaaacccacucuggacauugaacugcucaagacagaggugaccaacccugccauccugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauaggguugggcgugcuccugacuugguuaggacuaaauucacgaaguacaucccuaagcaugaccuguaucgcuguuggccucgucacacuguaccuuggggugauggugcaggccgauucuggaugcgucauuaacuggaaaggccgcgaauugaagugugguucagggaucuucguuacuaaugaggugcacaccuggacggaacaauauaaguuucaggcagacaguccgaaaagacugagcgccgcuaucggaaaggccugggaggagggcgugugcgguauuagguccgcaacacggcucgaaaacguaauguggaaacagauaucuaacgagcugaaucauaucuuacuggaaaacgacaugaaguucaccgucgugguuggcgauguggcugggauucuugcccagggcaaaaagaugauccgcccucaacccauggaguacaaauauucguggaaaagcuggggcaaggcgaagauuaucggggccgacguccagaauacuaccuuuauaaucgauggaccaaacacaccugaaugucccgacgaucagagagcuuggaauauuugggagguggaggacuacggcuucgguaucuuuacuaccaacauuugguugaagcucagggauuccuauacacagguuugcgaccaccgucugaugucagcagccaucaaagauaguaaggcugugcacgccgacaugggguacuggauagaaucugagaaaaaugaaacguggaagcuagcacgggcgagcuucauugagguaaagaccuguaucuggccaaaaucccauacucuguggucaaacggaguccucgaaagcgagaugauuauccccaagauauauggcgguccuaucucucaacacaauuaccgaccaggcuacuucacacagaccgccgggccguggcaucugggaaaacuugaguuggauuuugaccugugcgaaggcacuacagugguggucgaugagcacugcgggaacagaggacccuccuuaaggaccacgacuguuaccggcaagauuauccacgaaugguguugccgcaguuguacacucccuccacugcgguucagaggugaggacgggugcugguauggaauggagauuaggcccgugaaagaaaaggaggaaaaucuuguaaagagcauggugucugcuggcuccggugaggucgacucauuuagucugggcuugcucuguaucagcauaaugauugaagaggugaugcgcucgcgauggucccggaaaaugcugaugaccgggacucuagccguuuuccugcuccugaucaugggacagcuuacauggaacgauuugauccgucugugcauuauggugggcgcaaaugcuucugacagaauggggaugggaaccacauacuuagcccucauggcaacuuuuaagaugaggccuauguucgccgucggccugcuuuuucgccggcugaccagcagagaggugcuacuccugacgaucgguuugucacugguugcuaguguggaauuaccaaacucccucgaggaacugggggauggacuugcgaugggcauuaugauacugaaauugcucacagacuuccaaucucaucagcugugggccacccuacugagccuuacuuuuaucaagaccacauucucccuccacuaugcauggaaaacuauggcuaugguccugucaauuguauccuuguuuccccuguguuuaaguaccacgucucagaagacaaccuggcucccggugcugcuuggcucccuggggugcaagccuuugacuauguuccucaucgccgagaauaaaauuuggggaaggcgaagcuggccacugaacgaagguaucauggccguuggcauagugucgauccuacugucaucucuucucaagaacgaugucccccuggcugggccuuugauugcaggaggcauguuaaucgccuguuacgugauuagugguuccagcgcggaccugucucucgagaaagcugccgagguaagcugggaagaggaagcagagcauuccggggccucacacaauauccugguggaaguccaggaugacggaacaaugaagauaaaagaugaggagcgcgacgauacccuuacuauucuguugaaggcuacacuacuggcaguuaguggcguguauccccucagcaucccagccacccuguuugugugguacuucuggcagaaaaagaagcagcggucuggcguccuuugggacacgccuucacccccagaaguggagagagcgguuuuagaugacgggaucuauaggauuaugcagcguggacugcucggucgcagccagguaggcgugggggucuuccaagaaaacguguuucauacuauguggcacguuacccggggagcuguguugauguaccagggcaaaagacuggagccgaguugggccagcgucaagaaagaccucauauccuacggugggggauggaggcugcagggcucuuggaauacaggcgaggaagugcagguaaucgcagucgagccugggaagaaccccaaaaaugugcaaaccgccccaggaacauucaagacucccgaaggugagguuggcgcuauugcccuugauuuuaagccugggaccucgggaagcccaaucgugaaccgagaaggcaaaauugucggucuguaugggaauggagugguuacgacaucaggcacuuacguguccgcaaucgcucaggccaaggcgagucaggagggccccuugccugagauagaagacgaggucuuccggaaacgcaaccuaaccaucauggaucugcacccggggucuggaaagacaagaagguaucucccagccauugugcgggaagcaaucaaacgaaaguuaagaacccugauucuugcucccacucgcguaguggccagcgagauggcugaagcacugaaggguaugccuaucagguaccaaaccacagccguuaaauccgagcauacgggcaaggagauagucgaccucaugugccacgccacuuuuaccaugcguuugcugucaccagugcgggugcccaauuauaacaugauuaucauggaugaagcucauuucacagacccuucuagcaucgcggcaagaggguacauuaguaccagggucggaaugggcgaggccgcugccaucuuuaugacugcaacaccgcccgguuccguagaagccuucccacagagcaaugcugugauacaggaugaggaacgcgacauuccugagcgaucuuggaacucaggguaugaguggaucaccgauuuucccggaaaaacgguuugguucgugccauccauuaagaguggcaaugacaucgcgaacugucucaggaaaaauggcaagcgggucauacagcugagcaggaagacuuuugauacagaauaccagaaaaccaagaacaacgacugggacuacgugguuaccacugauauuucggagaugggggccaauuuccgcgcagaccgugugaucgauccuagacggugccuuaaacccgucauccuaaaggacggaccagaaagggugauucuggcugguccgaugccuguaacaguggccucugcagcccagcgccgaggcagaaucgggcggaaccacaauaaagagggagaucaguauauuuacaugggccagcccuugaacaaugacgaggaucaugcucacuggaccgaagccaagauguuacuggacaacauaaauacaccagaggguaucauucccgcacucuucgaaccugagagggaaaaguccgcagccaucgauggggaguaucgccugagaggcgaggcuaggaaaacuuuuguugaacuuaugcggcguggagaccugccagucuggcucagcuacaagguggccucagagggcuuccaauauagugaucgccgauggugcuuugacggggaaagaaacaaucagguguuggaggaaaacauggaugucgagaucuggacgaaagagggagaaaggaagaaacugcggccccgcuggcuagacgcuagaaccuacucugacccucuggcacucagggaguucaaggaauuugccgcuggucggcgauccguuagcggcgaucuuauucuggagauagggaaauuaccgcagcacuugacacagagagcccaaaaugcacuggacaaccucgugaugcugcauaauucagaacagggaggccgcgcguauaggcacgccauggaggagcuuccagauacuaucgaaacccugaugcucuuggcucugauugccguauuaacagguggggugacccuauucuuucugaguggccggggacucggcaagacuagcaucgggcuucugugugucauggcauccucuguguugcuguggauggcuagcguugagccccauuggauugccgcauccaucauacucgaguucuuucugauggugcuucucaucccugagcccgaccgucagagaacgccacaggauaaccaacuggccuacgucguaauuggauugcuguucaugaucuuaaccguggcugcgaaugagaugggucuacuggaaacaacuaagaaagaccucggcauugggcacgccgcaguuggaaaccaccaucacgcugccaugcuugauguggaccugcauccugccucagcauggaccuuguacgcugucgccacaaccaucauaacucccaugaugaggcacacaauugagaacacgaccgcgaauaucucucugacugcuauugccaaccaggcagccauccucaugggccuggauaaggguuggccaauaaguaaaauggacaucggggugccucuuuuagcucugggcugcuauucgcaggucaauccgcucacauugaccgcagccgugcugaugcuaguugcgcauuacgcuauuaucggacccggccugcaagccaaggcaacccgcgaagcccagaaacggacagcugccgggauuaugaagaacccaacuguggauggaaucguagcaauagaccucgauccuguggucuaugacgcuaaguuugagaaacagcuuggccagauuaugcuguugauccuguguacgagccaaauccuccugaugcgaaccacaugggccuuaugcgaauccauuacucuugcgaccgguccccugacaacccucugggaggggucuccaggaaaguucuggaauacuacgaucgccguuucaauggcaaacauauuuagaggcagcuaccuagcuggugccggccuggcauucuccuugaugaaaagucuagggggaggcaggcgcgggacaggagcucagggcgagacccucggugaaaaguggaaacggcagcuuaaucagcugucuaagagcgaguucaacacuuauaagagaucagggauuauggaaguggaccguuccgaggccaaagaaggauugaagaggggcgagaccacaaaacacgccgucagucgggguacugcgaagcugcgcugguuuguggagcgaaaucucguaaaaccugaaggcaaggugaucgauuuaggguguggaagaggcggguggagcuacuauugcgcuggacugaagaaaguuaccgaggugaagggcuacacaaaaggugggcccggacacgaagaaccgauuccaauggcaacguacggcuggaaccuugucaagcugcauucuggcaaagacguguucuuuaucccucccgaaaagugugauacccuacucugcgacauaggggaguccucaccaaaucccacuaucgaggaaggaaggacacugcgggucuugaaaaugguggagccuuggcugcgcgguaaccaauucuguauuaagauccucaauccguauaugcccagcguuguagaaacccuugagcagaugcagagaaagcacggcgggaugcuggugaggaacccauuaucgcgaaauucuacucaugagauguacugggucaguugcggaacaggcaacauuguguccgccguuaauaugaccagccggaugcuguugaaccguuuuacgauggcucacagaaaaccuaccuaugaacgcgauguggaccucggugccgggacaaggcacgucgcaguggagcccgaaguagccaaccuggauaucauuggacagcggaucgagaauauaaagcaugaacacaaaucaacuuggcauuacgacgaggauaacccuuauaagaccugggcuuaccacggcuccuaugaggugaaaccaucuggcagcgcgaguuccaugguuaauggggucgugaagcuacuuacaaagcccugggacgugauuccuauggucacucaaaucgccaugaccgauacaaccccauucggacagcagagaguuuuuaaagaaaagguggacacucgcacgcccaaagcaaagagggguacagcucaaaucauggagguaaccgccaaauggcuguggggcuuccucagccgaaacaagaagccgcggauuuguacuagagaagaguuuaccaggaaagugcgcucuaaugcagccauaggggcugucuucguggacgaaaaccaguggaacucagccaaggaggcgguugaggaugaacguuuuugggaccuggugcaucgggagagagaauugcacaaacagggaaagugcgcaacaugcgucuacaacaugaugggcaaaagggagaagaagcugggugaguucgggaaagccaagggaagucgcgcuaucugguacauguggcucggcgcccgauuucuugaguucgaggcacugggcuucaugaaugaagaucacugguuuucccgggagaacagcuuaucugggguggaaggagagggucugcauaaauugggcuauauucucagagacaucucgaagauuccugggggaaauauguacgcugaugacacggccggcugggauaccaggaucacugaggacgaucugcagaacgaagcucgcauaacagacaucauggagccagaacacgcccuacuugcaaaaucaauuuucaagcugaccuaucaaaauaaaguaguuagagugcagcggcccgcgaagaacgguacugucauggaugugaucagcaggcgugaccagcgaggguccggacaggugggcacauacggccucaauaccuuuacaaacauggaggcccaacugauucgccagauggaaagugaggggaucuucucuccuagcgaguuggaaacuccaaacuuagcugagagaguccuggauuggcucgaaaaguauggaguugagcggcuuaaaaggauggccauauccggugacgacugugugguaaagcccauugaugaccgcuuugcaaccgcucugacggcccuaaaugauaugggcaaagugagaaaggacaucccgcagugggaaccuucaaaaggguggaacgauuggcagcaaguccccuucugcagucaucacuuucaccagcugaucaugaaggacggacgggagauugugguuccauguaggaaucaggaugagcucgugggccgagcacgugucucucagggugccggguggagcuugagagaaaccgcgugccugggaaaguccuacgcucaaauguggcagcuuauguauuuccaucgccgggaccugaggcucgccgcaaacgccauauguucagcugugccuguagauuggauccccacaagcagaacuaccuggucuauucacgcccaucaccaguggaugacaacugaggacauguuauccguuuggaaucgcguguggaucgaagagaacccauggauggaagauaaaacccauauuaguagcuggggcgacguccccuaccugggcaagcgggaggaccaauggugcgggucguugaucggacugacggcaagggcuacaugggccaccaauauacagguggcgaucaaccagguucgaagacucauugguaaugagaacuaccuugauuauaugacuuccaugaaacgguuuaagaaugaaucugacccugagggcgcucugugguga

SEQ ID NO: 13644 - RNA, 9879 nt, Artificial Sequence
  derived and/or modified CDS sequence (opt3) from DENV-1__FJ432746__SS-prME
uccgugaccaugcugcucaugcuuaugcccacagcacuggcuuuccacuugacuacgagaggaggggagccucauaugaucgucuccaagcaggaaaggggaaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaggaacaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaauuacauccuccuggaaaacgacaugaaguuaacaguagucgugggcgauguugcugggauucuggcccagggcaagaagaugauccgcccucaacccauggaguauaaauacagcuggaaguccuggggcaaggcgaaaauaaucggggccgacgugcagaauaccacuuuuauuaucgauggaccaaacaccccugaaugucccgacgaucagagagcuuggaauauuugggaggucgaggacuauggcuucgguaucuuuacaacuaacauauggcuuaaguugagggauucauacacccaggugugcgaccaucgucucaugagugcagccauuaaagauacaaaggcuguucacgccgacaugggguauuggaucgaaucugagaaaaaugaaacguggaagcuggcacgggcgagcuucauugaggugaagaccuguaucuggccaaaaucccacacucuauggucaaacggaguacuggaaagcgagaugauaauccccaagauuuacggcgguccuaucucucaacauaauuaccgaccaggcuauuucacacagaccgccgggccguggcaccucggaaaacuggagcuugauuuugacuugugcgaaggcacuacagucgugguggaugagcauugcgggaacagaggacccucccugaggaccacgacugucaccggcaagauuauccacgaaugguguugccgcaguuguacauuaccuccacuccgguucaaaggugaggacgggugcugguacggaauggagauaagacccguuaaggaaaaggaggaaaaucuggugaaaagcaugguaucugcuggcuccggugagguggacucauuuagucuuggccuguuguguauuagcaucaugaucgaagaggucaugaggucgcgcuggucccgaaagaugcucaugaccgggacucuggccguguucuuucuacugauuaugggacagcucacauggaacgaucugauccggcuuugcauuaugguuggcgcaaaugcuucugaccguauggggaugggaaccacauauuuggcccugauggcaacuuucaaaaugagaccuauguuugccgugggcuuacucuucaggcgccugaccagccgggagguccuucugcuaacgauaggucucucacugguggcuaguguugaauugccaaacucccuggaggaauuaggggauggacucgcgaugggcaucaugauucugaaacuucugacagacuuucaaucucaccaguugugggccacccuccugagccuaacuuucgugagaaccacauuuucccugcauuacgcauggaaaacuauggcuaugguccuuucaaucguaagccucuucccccuguguuugaguaccacgucucagaagacaaccuggcugccgguguuacucggcucccuggggugcaagccucuuacuauguuucugauugccgagaauaaaaucuggggaagaaagagcuggccauugaacgaagguauaauggccguuggcaucgugucgauucuccugucaucucuacugaaaaacgaugucccccuugcugggccucucaucgcaggaggcaugcugauugccuguuaugugaucagugguuccagcgcggacuugucuuuagagaaggcugccguagugagcugggaggaagaggcagaacacuccggggccucacauaauauacuggucgagguucaggaugacggaacaaugaaaauuaaggaugaggaacgagacgauacccucacuauccugcuuaaagcuacacuguuggcagugaguggcguguacccccuaagcaucccagccacccuguucgucugguauuucuggcaaaagaagaaacagcgcucuggcgugcucugggacacgccuucacccccagagguugaacgggcgguacuggaugacgggauuuacagaauaaugcagaggggacuuuuaggucguagccaggugggcgucgggguguuucaagagaacguuuuccacacuauguggcaugugacccgcggagcuguccugauguaccagggcaagcggcucgaaccgaguugggccagcgugaaaaaggacuugaucuccuauggugggggauggagacugcagggcucuuggaauacaggcgaggagguacaggucauugcaguggaaccugggaaaaaccccaagaauguucaaaccgccccaggaacauuuaagacuucggagggugaagugggcgcuaucgcccucgauuucaaacccgggaccagcggaucaccuauugucaacagggagggcaagaucgugggucuguacgggaauggaguugugacgacauccggcacuuaugucagugcaauagcucaggccaaagcgucucaggaaggcccacuucccgagaucgaggacgaaguguuucgaaagcggaaccugaccauuauggauuugcacccugggagcggaaaaacacgcagauaccuaccggccaucguaagggaggcaauuaagcggaagcugcgaacccucaucuuagcuccaacuagagugguugccuccgaaauggcugaggcacugaaagguaugcccauacgcuaucaaaccacagccgucaagucagaacacacgggcaaagagauuguggaccuuaugugccaugccacuuucaccaugaggcugcucucuccugugcgugucccaaauuacaacaugaucaucauggaugaggcucacuuuacagaccccagcaguauugcggcacggggguauaucuccaccagaguaggaaugggcgaagccgcugccauauucaugacugcaacaccuccggguagcguggaggccuuuccccagucuaaugcuguuauucaggaugaagagagggacaucccagaacgcucauggaacuccggguacgaguggauuaccgauuucccuggaaagacggugugguuuguccccaguaucaaaagcggcaaugacauagcgaacuguuugcgaaagaauggcaagagagugauucagcugucgcggaaaacuuucgauacagaguaccaaaagaccaaaaacaacgacugggacuauguugugaccacugauaucucugaaaugggggccaauuucagggcagaccgcgucaucgauccacguagaugccucaagccugugauucugaaagacggacccgagcggguaauccuugcugguccaaugccggugacaguugccuccgcagcccagaggcgcggccgaauugggagaaaccauaauaaggaaggagaucaguacauauauaugggccagccucuaaacaaugacgaggaucacgcucauuggaccgaggccaagaugcuguuggacaacaucaauacacccgaagguauuaucccagcguuauuugagcccgaacgggagaaaagcgcagccaucgauggggaauacaggcugcgcggcgaggcuagaaagacuuucgucgagcucaugaggcggggagaccugccuguguggcuuucauauaaaguggccagugaaggcuuucaauacucugaucgucgcuggugcuucgacggggagcgaaacaaucagguccuggaagagaacauggauguugaaauuuggacgaaggagggagagaggaagaagcucaggccacggugguuggacgcucgcaccuauuccgacccccuggcacuaagagaauuuaaagaguucgccgcugguaggcggagcgugucaggcgaucugauacucgaaaucgggaaacuuccucagcaccugacacagcgagcccaaaaugcauuagacaacuugguaaugcugcacaauagugagcagggaggcagagcguaccgccaugccauggaggaacucccggauacuauugagacccugaugcuucuggcucucaucgccguguugacagguggggucacccuguuuuucuuaagcggcaggggacuaggcaagacuuccauugggcugcucugugugauggcaucuagcguucuucuguggauggcuuccguggaaccacacuggaucgccgcaucaauaaucuuggaguuuuuccugaugguccuccugauucccgaaccugaccggcagcguacgccccaggauaaccaacuugccuacguagugaucggacuccuguuuaugauuuugaccguugcugcgaaugagaugggucuguuagagacaacuaaaaaggaccuaggcaucgggcauguggccgucgaaaaccaccaccaugcagcuaugcuggauguggaccuccacccagccucugccuggacccuuuaugcagucgcuacaaccauaauuacuccuaugaugagacauacaaucgagaacacgaccgccaauauuagucugacugcgaucgcuaaccaggccgcaauauugaugggacuggauaaaggcuggcccaucucgaagauggacauuggugugccacuccuggcccuugggugcuacagccagguuaauccuuuaacacugaccgcugcagugcucauguugguagcccacuaugcgaucauuggcccgggacugcaagcuaaagccaccagggaagcacagaagcgcacagccgcuggcaucaugaagaaccccacuguggaugggauagucgccauugaccuagauccaguuguguacgacgcaaaauucgagaagcagcugggacagaucaugcuccuuauccuguguacgucccaaauuuugcugaugcggaccacaugggcucucugcgaaucuaucacucuggccaccggcccuuuaacaacccuuugggaggguucacccgggaaauuuuggaauacuacgauagcggucagcauggccaacauuuuccgaggauccuaucuggcaggcgcuggucucgccuucagucuaaugaagucucugggcgggggaagaaggggcacaggggcacagggagagaccuugggcgaaaaauggaagcgccagcugaaucagcucagcaagucagaguuuaacacuuacaaacgguccgguaucauggaaguggacagaagugaggcuaaggaagggcuuaaacguggagagaccacaaagcaugccguaagcaggggcacugccaaacugcggugguucguggagcgcaauuugguuaagccagaagguaaggugauugaucugggcugugggcgaggaggcuggucuuauuacugcgcggggcucaaaaaggucaccgaggugaaaggauacacaaagggcgguccugggcacgaggaacccaucccgauggcuacguauggauggaacuuagucaaacugcacuccggcaaggacguguuuuucauaccaccugaaaaaugugauacccuucugugcgacaucggcgagucaagccccaauccaacuauugaggaagggagaacacuaaggguucucaagaugguagagcccuggcugcggggaaaccaauuuuguaucaagauuuugaauccuuacaugccgucgguggucgaaacccuggagcagaugcagcgcaaacaugguggcaugcucgugagaaacccccuuucuaggaauaguacucacgagauguauuggguuuccugcgggacaggaaacaucgugagcgcagucaauaugaccucacgaaugcuguuaaaccgguucacgauggcccaucguaagccaaccuacgaaagagauguggaccugggcgcugguacacgccacguagccguggagccugaaguugcaaacuuggauauuaucgggcagaggauagagaauauuaaacacgaacauaaguccacuuggcacuaugacgaggauaaccccuacaaaaccugggccuaucauggaucuuacgaggucaagccuagcggcagugcuuccagcauggugaauggcguggucaagcuccugacaaaaccaugggacguuauccccauggugacucaaaucgcgaugaccgauacaaccccuuuugggcagcagcggguauucaaggaaaaaguggacacuagaacgccaaaggccaaacgcggaacagcacaaauuauggaggucaccgcuaaguggcuaugggguuuucuuucuaggaacaagaaaccccgaauauguacucgggaagaguucaccagaaaggugaggucaaaugccgcaaucggcgccguuuuuguggacgaaaaccaguggaauagugcuaaagaggccgucgaggaugaacgcuucugggaccuggugcaccgugagcgggaacuccauaagcaggggaaaugcgcgacaugcguauacaacaugaugggaaagagagagaagaaacugggcgaauuugguaaggcaaaaggguccagggccauuugguauaugugguugggagcucgcuuccuggaguucgaggcccucggcuuuaugaaugaagaucacugguucagccgagagaacucucuuucgggcguugaaggggagggacugcacaaguuagguuacauccugcgggacauuucaaaaaucccgggcgggaauauguaugcagaugacacggcuggaugggauaccagaauaacugaggacgauuugcagaacgaagccaagaucacagacauuauggagccugaacaugcucuccuggccaaaagcaucuuuaagcuaaccuaccaaaauaagguggucagggugcagcgcccagccaaaaacggcacugugauggaugucauuuccagacgggaccagagggguagugggcagguuggaacauauggccuuaauaccuucacaaacauggaggcgcaacugauccgucagauggaaucugagggcauauuuagccccuccgagcucgaaacuccuaaccuggccgggcgaguguuggauugguuagagaagcacggaguagaacgccugaaaagaauggcuauuucaggugacgacuguguggucaagccaaucgaugaccgguucgccaccgcacucacggcucuuaaugauaugggcaaagugaggaaggacaucccccagugggagccgaguaagggguggaacgauuggcagcaaguuccuuuuugcucucaucacuuccaccagcugauuaugaaagacggacgcgaaauagugguccccuguagaaaucaggaugagcuagugggccgggccaggguaagccagggugcaggguggucccugcgagagaccgccugccucggaaagucauacgcgcaaauguggcaguugauguauuuucaucguagagaccugcgccuugcugccaacgcaaucuguagcgccguuccaguggauugggucccuacaucucggacuaccugguccauucacgcucaucaccaguggaugacaacugaagacaugcugaguguguggaauaggguuuggaucgaggaaaaccccuggauggaggauaaaacccauauuagcucguggggcgacgugccauaccucggcaagagagaagaccaauggugcggguccuuaaucggacugacggcccgcgcaacaugggcuaccaauauacaggucgccaucaaccaggugcggagguugcuggguaaugagaacuaccucgauuauaugacuucuaugaaacgauucaagaaugagucagaccccgaaggcgcgcuuugguga

SEQ ID NO: 13645 - RNA, 9879 nt, Artificial Sequence
  derived and/or modified CDS sequence (opt3) from DENV-1__FJ432748__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggaucguucaaacuggagaaggaagucgccgagacgcagcacgguacagugcuuguucagauaaaguacgagggcaccgacgcuccuugcaaagugccauucucgacucaagaugaaaaggggguaacacagaacggacgcuugaucaccgcgaaucccauugucacugacaaagagaagccugugaacaucgaagcagagccacccuuuggcgagucuuauauaguuauuggugccggggaaaaagcucugaagcucuccugguucaagaaaggcucaaguaucggaaagauguuugaggccaccgcaagaggcgccaggcggauggcuauccugggggauacagccugggacuucggaagcauugguggcguguuuacguccgucgggaaacuugugcaucagaucuucggaaccgcauacggcguacuguuuucuggugugagcuggacuaugaagauugggauaggcguuuugcucacauggcugggauuaaauucacgaaguaccucccugagcaugacauguaucgcggucggccuagugacucucuaccugggggugaugguccaggcugauucuggaugcguuauuaacuggaaaggccgcgaacuuaagugugguucagggaucuucgugaccaaugaggugcacacguggacagaacaauauaaguuucaggccgacaguccgaaaagauugagcgcagccaucggaaaggcuugggaggagggcguaugcgguauuagguccgccacccggcuggaaaacauaauguggaaacagaucucuaacgagcucaaucauauucuguuagaaaacgacaugaaguucacugucgugguuggcgauguggcagggauccuggcucagggcaaaaagaugauucgcccucaacccauggaguacaaauauucguggaaaagcuggggcaaggccaagaucauaggggcggacguccagaauaccacauuuaucauugauggaccaaacacuccugaaugucccgacgaucagagagccuggaauaucugggagguggaggacuacggcuucgguauuuuuaccacaaacaucuggcuuaaguugagggauuccuauacgcagguuugcgaccaccgucucaugucagcugcaauaaaagauaguaaggccgugcacgcugacaugggguacuggauugaaucugagaaaaaugaaaccuggaagcuggcccgggcauccuucaucgagguaaagacuuguauuuggccaaaaucccauacacuauggucaaacggaguccuggaaagcgagaugaucauacccaagaucuauggcgguccuauuucucaacacaauuaccgaccaggcuacuucacccaggcggccgggccguggcaucucggaaaacuggagcuugauuuugacuugugcgaaggcacuacagugguggucgaugagcacugcgggaacagaggacccucccugaggaccacgacuguuaccggcaagaucauucacgaaugguguugccgcaguuguacauuaccuccacuccgguucaaaggugaggacgggugcugguauggaauggagaucagacccgugaaggaaaaggaggaaaaucugguaaaaagcauggugucugcuggcuccggugaggucgacucauuuagucuuggccuguuguguauaagcauuaugaucgaagaggugaugaggucgcgcuggucccgacggaugcucaugaccgggacucuggccguuuucuuucuacugaucaugggacagcucacauggaacgaucugauucgucuuugcaucauggugggcgcaaaugcuucugacagaauggggaugggaaccacauacuuggcccugauggcaacuuucaagaugaggccuauguuugccgucggcuuacucuuccgccggcugaccagcagagaggugcuucugcuaacgauuggucucucacugguugcuaguguggaauugccaaacucccuggaggaauuaggggauggacucgcgaugggcauaaugauccugaaacuucugacagacuuucaaucucaucaguugugggccacccuccugagccuaacuuucauuaagaccacauuuucccugcacuaugcauggaaaacuauggcuaugguccuuucaaucguaagccucuucccccuguguuugaguaccacgucucagaagacaaccuggcugccgguguuacucggcucccuggggugcaagccucuuacuauguuucugauugccgagaauaaaaucuggggaaggcgaagcuggccauugaacgaagguauaauggccguuggcaucgugucgauucuccugucaucucuacugaagaacgaugucccccuugcugggccucucaucgcaggaggcaugcugauugccuguuacgugaucagugguuccagcgcggacuugucuuuagagaaagcugccgagguaagcugggaagaggaagcagagcauuccggggccucacacaauauacugguggaaguccaggaugacggaacaaugaagauuaaagaugaggagcgcgacgauacccucacuauccugcuuaaggcuacacuguuggcaguuaguggcguguauccccuaagcaucccagccacccuguucgugugguacuucuggcagaaaaagaagcagcggucuggcguccucugggacacgccuucacccccagaaguggagagagcgguucuggaugacgggauuuauaggauaaugcagcguggacuuuuaggucgcagccagguaggcgugggggucuuucaagaaaacguguuccauacuauguggcacguuacccggggagcugugcugauguaccagggcaaaagacucgagccgaguugggccagcgucaagaaagacuugaucuccuacggugggggauggaggcugcagggcucuuggaauacaggcgaggaagugcagguaauugcagucgagccugggaagaaccccaaaaaugugcaaaccgccccaggaacauuuaagacucccgaaggugagguuggcgcuaucgcccucgauuucaagccugggaccucgggaagcccaauugugaaccgagaaggcaaaaucgucggucuguaugggaauggagugguuacgacaucaggcacuuacguguccgcaauagcucaggccaaggcgagucaggagggcccccuuccugagaucgaagacgaggucuuucggaaacgcaaccugaccauuauggauuugcacccggggucuggaaagacaagaagguaucuaccagccaucgugcgggaagcaauuaaacgaaagcugagaacccucaucuuagcucccacucgcguaguggccagcgagauggcugaagcacugaaggguaugccuauaagguaccaaaccacagccguuaaauccgagcauacgggcaaggagauugucgaccuuaugugccacgccacuuucaccaugcgucugcucucaccagugcgggugcccaauuauaacaugaucaucauggaugaagcucauuuuacagacccuucuagcauugcggcaagaggguacaucaguaccagggucggaaugggcgaggccgcugccauauucaugacugcaacaccgcccgguuccguagaagccuuuccacagagcaaugcugugauucaggaugaggaacgcgacaucccugagcgaucuuggaacucaggguaugaguggauuaccgauuuccccggaaaaacgguuugguuugugccauccaucaagaguggcaaugacauagcgaacuguuugaggaaaaauggcaagcgggucauucagcugagcaggaagacuuucgauacagaauaccagaaaaccaagaacaacgacugggacuacgugguuaccacugauaucucggagaugggggccaauuuccgcgcagaccgugugaucgauccuagacggugccucaaacccgucauucugaaggacggaccagaaagggugauccuugcugguccgaugccuguaacaguggccucugcagcccagcgccgaggcagaauugggcggaaccacaauaaagagggagaucaguauauauacaugggccagccccuaaacaaugacgaggaucaugcucacuggaccgaagccaagaugcuguuggacaacaucaauacaccagaggguauuauccccgcguuauuugaaccugagagggaaaaguccgcagccaucgauggggaguaucgccugagaggcgaggcuaggaaaacuuucguugaacucaugcggcguggagaccugccagucuggcuuagcuacaagguggccucagagggcuuucaauauagugaucgccgauggugcuucgacggggaaagaaacaaucaggugcuggaggaaaacauggaugucgagauuuggacgaaagagggagaaaggaagaaacuccggccccgcugguuggacgcuagaaccuacucugacccucuggcacuaagggaguuuaaggaguucgccgcuggucggcgauccguuagcggcgaucugauacucgagaucgggaaacuuccgcagcaccugacacagagagcccaaaaugcauuagacaacuuggugaugcugcauaauucagaacagggaggccgcgcguauaggcacgccauggaggagcucccagauacuauugaaacccugaugcuucuggcucucaucgccguauugacagguggggugacccuguuuuucuuaaguggccggggacuaggcaagacuagcauugggcugcucugugucauggcauccucugugcuucuguggauggcuagcguugagccccauuggaucgccgcauccauaaucuuggaauuuuuccugauggugcuccugauuccugagcccgaccgucagagaacgccacaggauaaccaacuugccuacgucguaaucggacuccuguuuaugauuuugaccguggcugcgaaugagaugggucuguuagaaacaacuaagaaagaccuaggcaucgggcacguugccguggagaaccaccaucacgcagcuaugcuggaugucgaccuccauccugccucagccuggacccuuuacgcaguggcuacaaccauaauuacucccaugaugaggcacacaaucgaaaacacgaccgccaauauuucucugacugcgaucgcuaaccaggccgcaauauugaugggacuggauaagggcuggccaaucaguaaaauggacauuggugucccucuccuggcccuugggugcuauagccaggugaauccguuaacacugaccgcugcaguucucauguugguggcccauuacgcgaucauuggccccggacugcaagcuaaggccacccgcgaggcacagaaacggacagccgcuggcaucaugaagaacccaacuguagaugggauaguggccauugaccuagauccugucguuuaugacgcaaaguucgaaaaacagcugggacagaucaugcuccuuauccuguguacgagccaaauuuugcugaugcgaaccacaugggcucucugcgaguccaucacucuggccaccggccccuuaacaacccuuugggaggguucuccagggaaguuuuggaauacuacgauagcggugucaauggccaacauuuucagaggaagcuaccuggcaggcgcuggucucgccuucucccuaaugaaaagucugggcgggggaaggcgcggcacaggggcacagggagaaaccuugggcgagaaguggaaacggcagcugaaucagcucucuaagagcgaauuuaacacuuauaagagaucagguaucauggaggucgaccguuccgaagcuaaagaggggcuuaagaggggagagaccacaaaacacgccgugagucggggcacugccaagcugcgcugguucguagaacgaaauuuggugaaaccugaggguaagguuauugaucugggcugugggagaggaggcuggagcuacuauugcgcggggcucaagaaagugaccgaagucaagggauacacaaaaggcggucccgggcacgaggaaccgaucccaauggcuacguacggauggaacuuagugaagcugcauucuggcaaagacgucuuuuucauaccucccgagaagugugauacccuucugugcgacaucggcgaguccucaccaaaucccacuauugaagaggggaggacacuacgggugcucaaaaugguugaaccuuggcugcgcggaaaccaauuuuguaucaagauuuugaauccguauaugcccagcguaguggagacccuggagcagaugcagagaaagcacgguggcaugcucgucaggaacccacuuucgcgaaauucuacucaugaaauguacugggugaguugcgggacaggaaacaucguuuccgcagugaauaugaccagccggaugcuguuaaaccguuucacgauggcccacagaaaaccuaccuaugagcgcgaugucgaccugggcgcugguacaaggcacguggccguagaacccgagguggcaaacuuggauauuaucgggcagcggauagaaaauauuaagcaugagcacaaaucaacuuggcauuacgacgaggauaacccuuauaagaccugggccuaccacggauccuaugaaguuaaaccaucuggcagcgcuaguuccauggucaauggcguggugaagcuccugacaaagcccugggacgucaucccuaugguuacucaaaucgcgaugaccgauacaaccccauuugggcagcagagaguguucaaagagaagguagacacucgcacgcccaaagccaagaggggaacagcacaaauuauggaagugaccgcuaaauggcuaugggguuuucuuagccgaaacaagaagccgcggauauguacuagagaggaguucaccaggaaaguccgcucuaaugccgcaaucggcgccguguuuguugacgagaaccaguggaacucagcuaaggaggccguggaagaugagcguuucugggaccugguccaucgggaaagagagcuccacaaacaggggaagugcgcgacaugcguguacaacaugaugggaaaaagggaaaagaagcugggcgaguuugguaaagcaaaggggagucgcgccauuugguacaugugguugggagcucgauuccuggaguucgaagcccucggcuuuaugaaugaggaucacugguucucccgggaaaacagccuuucuggcguagagggggagggacugcauaaauuagguuauauccugagagacauuucgaagaucccuggcgggaauauguacgcagaugacacggcuggaugggauaccaggauaacugaagacgauuugcagaacgaggcccgcaucacagacauuauggaaccagagcacgcucuccuggccaaaucaaucuuuaagcuaaccuaucaaaauaaaguugugagaguccagcggcccgcaaagaacggcacugugauggaugugauuagcaggcgugaccagcgagguuccgggcaggucggaacauacggccuuaauaccuucacaaacauggaagcgcaacugauccgccagauggagagugagggcauauuuucuccuagcgaacucgagacuccaaaccuggccgaaagaguuuuggauugguuagagaaguaugggguggaacggcugaaaaggauggcuauuuccggagacgacuguguagugaagcccaucgaugaccgcuucgccaccgcacucacggcucuuaaugauauggguaaagucagaaaggacaucccgcagugggagccuucaaaaggcuggaacgauuggcagcaagugcccuuuugcagucaucacuuccaccagcugauuaugaaggacgggcgggagauaguugugccauguaggaaucaggaugagcuagucggacgagcccgugugucucagggcgcagguuggagccugagagagaccgccugccucgggaaguccuacgcgcaaauguggcaguugauguauuuucaucgccgggaccugaggcuugcugccaacgcaaucuguucagccguaccuguugauuggauucccacaagcagaacuaccuggucuauccacgcucaucaccaguggaugacaacugaagacaugcuguccguguggaaucgcgucuggauugaggaaaacccauggauggaggauaaaacccauaucaguagcuggggagacgugcccuaccucggcaagcgggaggaccaauggugcggcucguuaauagggcugacggccagggcaacaugggcuaccaauauccagguugccauuaaccaggugcgaagauugaucggaaaugaaaacuaccuggauuauaugacuuccaugaaacgguucaagaaugagucugacccugaaggugcgcucugguga

SEQ ID NO: 13646 - RNA, 9879 nt, Artificial Sequence
  derived and/or modified CDS sequence (opt3) from DENV-1__FJ432749__SS-prME
agcgugaccaugcugcucaugcuuaugcccacagcccuggcuuuccacuugacuacgagaggcggggagccucauaugaucgucaccaagcaggaaaggggaaaauccuuacuguuuaagacaucugcagguguuaacaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagagcaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuaccccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaagcuucaaacuggagaaggaaguggcugagacccagcacgguacgguccuugugcagauaaaguacgagggcacagacgcgccuugcaaaaucccauucuugacccaagaugaaaaggggguuacucagaacggacgccugauuacagcaaaucccaucgugaccgacaaagagaagccuguaaacauagaagccgagccacccuuuggcgagucguauauugucaucggugcuggggaaaaagcccucaagcugucuugguucaagaaaggcuccucaaucggaaagauguuugaggcaacugccagaggcgcuaggcggauggccauucuuggggauaccgcaugggacuucggaaguaucgguggcguguuuacaagcguugggaaacuggugcaucagauuuucggaacggcguacggcgucuuguuuuccggugugucuuggaccaugaagauagggaucggcguacuccugacuugguuaggacugaauagccgaucaacaagucuauccaugaccuguauugcugugggccucguuacacuguaccuuggggucauggugcaggccgauagcggaugcgugaucaacuggaaaggccgcgaauugaagugugguucugggaucuucgucacuaaugagguucacaccuggacggaacaauauaaguuucaggcagacucaccgaaaagacugagugccgcuauuggaaaggccugggaggagggcgugugcgguauaaggagcgcaacacggcucgaaaacaucauguggaaacagauuuccaacgagcugaaucauaucuuacuggaaaacgacaugaaguucaccgugguagucggcgaugugguugggauucuugcucagggaaaaaagaugauccgcccucaacccauggagcacaaauacucuuggaagucguggggcaaggccaaaauaaucggggcggacgugcagaauacuaccuuuauuaucgauggaccaaacacaccugaaugucccgacgaucagagagccuggaauauuugggaggucgaggacuauggcuucgguaucuuuacuaccaacauaugguugaagcucagggauagcuacacacaggugugcgaccaccgucugauguccgcugcaauuaaagauucaaaggccguucaugcugacaugggguauuggaucgaaagugagaaaaaugaaacguggaagcuagcccgggcaucuuucauugaggugaagaccuguaucuggccaaaaagccacacucugugguccaacggaguacucgaaucagagaugauaauccccaagauuuacggcgguccuaucagccaacauaauuaucgaccaggcuacuucacacagaccgcggggccguggcaccugggaaaacuugaguuggauuuugaccugugcgaaggcacuacagucgugguggaugagcacugcgggaacagaggacccucuuuaaggaccacgacugucaccggcaagauuauccaugaaugguguugccgcuccuguacacucccuccacugcgguucaaaggugaggacgggugcugguacggaauggagauaagacccguuaaggaaaaggaggaaaaucuugugaaaaguaugguaagcgccggcucuggugagguggacuccuuuucacugggcuugcucuguauuaguaucaugaucgaagaggucaugaggagccgcuggucgcgaaagaugcugaugaccgggacucuagcuguguuccugcuccugauuaugggacagcuuacauggaacgauuugauccggcugugcauuaugguuggcgccaaugcauccgaccguauggggaugggaaccacauauuuagcucucauggccacuuuuaaaaugagaccuauguucgcagugggccugcuuuuuaggcgccugaccucucgggagguccuacuccugacgauagguuugagccugguggccucaguugaauuaccaaacagucucgaggaacugggggauggacuugcuaugggcaucaugauucugaaguugcucacagacuuccaaucccaccagcugugggcgacccuacugucucuuacuuuuaucaaaaccacacucagccugcauuacgccuggaagacuauggcaaugguguuguccauugucucacuguuccccuuaugucucagcaccacgagucagaagacaaccuggcugccgguacuucugggcucuuuggggugcaaaccucucacuauguuucugaucgcugagaauaagauauggggaagaaaauccuggccacuaaacgaagguaucauggccgugggcguugugagcauucugcuuucgucacuccugaagaacgauguccccuuggccgggccuuuaaucgcuggaggcaugcugauugcauguuaugugaucucugguaguuccgccgaccucagccuggagaaagcggcugagguaucuugggaagaggaagccgagcacagcggggcaucccauaauauacuuguggaaguccaggaugacggaacaaugaagauuaaagaugaggagagggacgauacccugacuaucuugcuaaaggccacacugcucgcuguuucaggcguguacccccugaguaucccagcaacccuuuucgugugguauuuuuggcaaaagaaaaagcagcgaagcggcgucuuaugggacacgccuucucccccagaaguggagaaagccguucuggaugacgggauuuaccgcauaaugcagcggggacucuuggguagaucccagguaggcgugggggucuuccaagaaaacguguuccacacuauguggcacguuaccaggggagcggugcugauguaucagggcaagcgucucgagccgucaugggcuagugucaaaaaggaccugaucagcuacggugggggauggcgccuucagggcuccuggaauacaggcgaggaagugcagguaauugccgucgagccugggaagaaccccaaaaaugugcaaaccgcaccaggaacauuuaagacucccgaaggugagguuggcgccaucgcucuggauuucaaaccugggaccucuggaucgccaauugugaaccgggaaggcaagaucgucgguuuguacgggaauggagugguuacgacaagcggcacuuaugugucagccauagcacaggcuaaagccucccaggagggcccccuaccugagaucgaagacgaggucuuuagaaagaggaaccugaccauuauggaucuccauccggggaguggaaagacacgacgguacuuaccagcgaucgugcgcgaagccauuaaaagaaagcugaggacccuuauccuggcacccacucggguaguggcuucugagauggccgaagcucucaaagguaugccuauacgauaucaaaccacagcaguuaagagcgagcacacgggcaaagagauugucgacuugaugugccaugccacuuucaccaugagacugcucuccccagugcgcgugcccaauuacaacaugaucaucauggaugaagcccacuuuacagacccuucaucuauugcugcgaggggguauaucagcacccgugucggaaugggcgaggcagccgcuauauucaugacugccacaccgcccgguaguguagaagcauuuccacaguccaaugccgugauucaggaugaggaacgggacaucccugagagaagcuggaacucuggguacgaguggauuaccgauuuccccggaaagacgguuugguuugugccaucaaucaaguccggcaaugacauagcuaacugucugaggaaaaauggcaagcgcgucauucagcuuagucgaaaaacuuucgauacagaauaucaaaagaccaaaaacaacgacugggacuacgugguuaccacugauaucagcgagaugggggcgaauuuuagagccgaccgggugaucgauccuaggcgcugccuaaagcccgucauucugaaggacggaccagaacgugugaucuuggcagguccgaugccuguaacaguggcuucggccgcacagagacggggcaggauugggcgcaaccauaauaaagagggagaucaguacauauauaugggccagcccuuaaacaaugacgaggaucacgcccacuggaccgaagcuaagaugcugcucgacaacaucaauacaccagaggguauuauccccgcccuguucgaaccugagcgagaaaaaucugcggcaaucgauggggaguacagacuucggggcgaggccaggaagacuuucguugaacugaugcgcagaggagaccucccagucugguuguccuauaaaguggcuagcgagggcuuucaauacucagauaggcgguggugcuucgacggggaacguaacaaucaggugcuggaggaaaacauggaugucgagauuuggacgaaggagggagaacgcaaaaagcuacgacccagauggcuggacgccaggaccuauagugacccucucgcucuucgggaguuuaaggaauucgcagccggucgcagaucuguuuccggcgaucugauauuagagaucgggaaauugccgcagcaucugacacagagggcucaaaaugcccucgacaaccuggugaugcuucacaauagcgaacagggaggccgggcauaccgacaugcgauggaggagcugccagauacuauugaaacccucauguugcuggccuuaaucgcuguacuaacagguggggugacccuguuuuuccucucaggcagaggacuuggcaagacuaguauugggguccugugugugauggccagcuccguuuugcuguggauggcaucuguggagccccacuggaucgcugccagcauaauccucgaauuuuuccugaugguccuucucauuccugagcccgaccgccagaggacgccacaggauaaccaacuggcauauguagugaucggauugcuguuuaugauuuuaaccguugccgcuaaugagaugggucuacuggaaacaacuaaaaaggaccucggcaucgggcacguggcggucgagaaccaucaccaugccaccaugcuugauguggaccugcacccugcauccgcuuggacauuguacgccgucgccaccacuauaauuacacccaugaugcggcauacgaucgaaaacaccacugcaaauauuucacugacagcuaucgccaaccaggcggcuauacucaugggacuggauaaaggcuggccaaucucuaagauggacauuggugugccucuuuuagcccuggggugcuacagucagguuaauccgcucaccuugaccgcagccgugcugaugcuaguagcucacuaugcaaucauuggccccggacugcaagccaaggcgacacgugaggcucagaaaagaacugccgcaggcaucaugaagaacccaacgguggaugggauagucgccauugaccucgauccuguuguguacgacgcuaaauucgaaaagcagcuuggacagaucaugcuguugauccuguguaccucgcaaauucuccugaugaggacaacuugggccuuaugcgagagcaucacccuugcaacaggcccccugaccacucucugggaggguuccccagggaaauuuuggaauacgacaauagcugucucuauggccaacauuuuccgcggaucauaucuagcgggcgccggucuggcauuuagcuugaugaagucccugggcgggggacggcgaggcaccggggcucagggagaaacucucggcgagaaguggaaaagacagcuuaaucagcugaguaagucugaauucaacaucuacaaaaggagcgguauuauggagguggaccgcucagaagccaaggagggguugaaacggggagagaccacaagacacgcaguaucccguggcacugcuaagcugaggugguucguggaacggaaucucguuaagccugaggguaaagugaucgauuuaggcugugggcgcggaggcuggaguuauuacugcgccgggcugaagaaagucaccgaagugaagggauauacaaaaggcggucccgggcaugaggaaccgauaccaauggccacguacggauggaaccuugucaagcugcacagcggcaaagacguguuuuucaccccucccgagaagugugauacucuacucugcgacaucggcgagucuuccccaaaucccacaauugaagaggggcgaacccugagaguuuugaagaugguagaaccuuggcugaggggaaaccaauuuuguaucaaaauucucaauccguacaugcccucaguggucgagacucuugagcagaugcagcggaagcaugguggcaugcuggugcgcaacccauuaagcagaaauucgacacacgaaauguauuggguuucuugcgggaccggaaacaucgugagugcggucaauaugacguccaggaugcuguugaaccgauucaccauggcucaccggaaaccuacauacgagcgugauguggaccucggcgcagguacuagacauguagccguggaacccgagguugcuaaccuggauauuaucgggcagcgcauagaaaauauuaagcacgagcauaaaagcaccuggcacuaugacgaggauaacccuuacaagacaugggccuaucauggaucauacgaagucaagccauccggcucugcaagcaguauggugaauggcguggucaaacuacuuacuaagcccugggacguuaucccuauggugacccaaaucgccaugacagauaccacuccauuugggcagcagaggguauucaaagagaagguggacacgcggacacccaaagcuaagagaggaaccgcgcaaauuauggaagucacugcccgcuggcugugggguuuucucuccaggaacaagaaaccgcgaauauguacccgggaggaauucacaagaaaggugaggagcaaugcagcuaucggcgccguuuuuguggacgagaaccaguggaauucugcaaaagaggccgucgaagaugagcgcuucugggaccuggugcagaaggaacgugaguugcacaaacaggggaagugcgcuacgugcguauauaacaugaugggaaagcgggaaaaaaagcugggcgaguuugguaaagccaaggggucaagagcgauuugguacauguggcucggagcaagguuccuugaguuugaagcccugggcuucaugaaugaggaucacugguucagucgcgaaaacuccuuaagcggcguugagggggagggacugcauaaauuggguuacauccuccgagacauuucuaagaucccuggcgggaauauguaugcugaugacaccgccggaugggauacucggauaacagaagacgaucugcaaaacgaggcaaaaaucaccgacauuauggaaccagagcacgcucuacuugccacuucgaucuuuaagcugacauaccagaauaagguggucagagugcagaggcccgcuaaaaacggcaccgugauggaugucauuucacgcagagaccagcgggguagcgggcaaguuggaacauauggccucaauacuuucaccaacauggaagcccagcugaucaggcagauggaguccgagggcauauuuuugccuagugaauuagagacgccaaaccuggcagaacgugugcucgauuggcuugagaaguacgggguagaacgacugaaacgcauggcgauuucuggagacgacuguguggucaagcccaucgaugacagauucgccaccgcucuaacagcccugaaugauauggguaaagugcggaaggacaucccgcagugggagccuagcaagggcuggaacgauuggcaacagguucccuuuugcucccaucacuuccaccagcucauuaugaaagacgggagggagauaguggucccaugucgcaaucaggaugaauuggugggaagagcacggguaucacaaggcgcugguuggagucugagggagacugccugccuugggaagucuuaugcacagauguggcagcugauguacuuucaucgacgugaccucagauuagccgcgaacgcuaucuguagcgccguuccuguggauuggguccccaccucccgcacaacuuggucaauucacgcacaucaccaauggaugaccacggaagacaugcugagcguguggaaucggguuuggaucgaggaaaacccauggauggaggauaaaacacaugugucuuccuggggagacguccccuauuugggcaagagggaggaccaguggugcggcagucugauugggcucaccgccagagcuacuugggccagcaauauccagguggcaauaaaccagguacgccggcuuaucggaaaugaaaacuaccuggauuacaugacaucgaugaaaagguucaagaaugagggugacccugaaggcgcuuuuugguga

SEQ ID NO: 13647 - RNA, 9879 nt, Artificial Sequence
  derived and/or modified CDS sequence (opt3) from DENV-1__FJ410212__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuugcaccccaugucggccuggguuuggaaacuagaaccgagacauggauguccucugaaggggccuggaaacagauccagaggguggagacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagacuuuguggagggucuuaguggcgcgacuuggguagauguuguguuggaacacggguccugugucacaaccauggcaaaggacaaacccacucuggauaucgagcuacucaagacagaagugaccaacccugccgugcugaggaaacuuugcauugaggcuaagaucucuaauacgaccacagacagccgguguccaacucaaggagaagccacccuggucgaggagcaggaugcaaacuucguuugccgccgaacauuuguggacagaggcugggguaauggguguggauuguucggcaaaggcucccuccugacuugcgcuaaguuuaagugcguaaccaaauuagaagggaagauagugcaguacgagaaccugaaauauucagucauugugacaguucacaccggagaucagcaucaaguggguaaugaaaguacugagcacggcacgacagccaccaucacuccccaggcgccuaccacagaaauucagcucaccgacuacggggcccuuacucuggacuguagcccaaggacaggauuggauuucaacgagaugguccuacugacgaugaaggagaaaucuuggcucgugcauaagcagugguuucuggaccuuccgcugcccuggaccuccggcgcaucaacuagccaagaaacauggaaucggcaggauuugcucguaaccuucaaaacagcucacgccaagaagcaggagguugugguccuggguagucaagaaggggcuaugcacacugccuuaaccggcgcaacggagauccagaccucuggaacaacuaccaucuuugccggccaucugaaaugccgucuaaagauggacaaacucacacugaaggggauguccuaugugauguguacuggaagcuucaaacuugaaaaggaggucgcugagacccagcacgguacgguguugguucagauuaaguacgaaggcacagaugcgccuugcaaaauaccauucucgacccaagacgagaagggggugacucagaacggacgccugaucacagcaaaucccauuguaaccgauaaagaaaagccugucaacaucgaggccgagccacccuuuggcgaaucuuauauagugauuggugcuggggagaaagcccucaagcuguccugguucaagaaaggcucaaguaucggaaagauguuugaagcaacugccagaggcgcuaggcggauggccauccuuggggacaccgcaugggauuucggaagcauugguggcguuuuuacauccguggggaaacugguccaucagaucuucggaacggcguacggcguguuguuuucugguguaagcuggaccaugaagauugggauaggcgcucuccugacuugguuaggacugaauucacgaaguacaucccuaagcaugaccuguaucgccgugggccucguuacacuguaccuuggggucauggugcaggcagacucuggaugcgugauuaacuggaaaggccgcgaguugaagugugguucagggaucuucgucacuaaugaaguucacaccuggacggagcaauauaaguuucaggccgauaguccgaaaagacugagcgcugccaucggaaaggcaugggaggaaggcgugugcgguauuagguccgcuacacggcucgagaacauaauguggaaacagaucucuaacgaacugaaucauauuuuacuggagaacgacaugaaguucaccgugguagucggcgacguggccgggauccuuguucagggaaaaaagaugauucgcccucaacccauggaauacaaauauucguggaagagcuggggcaaggcgaaaaucauaggggccgaugugcagaauuccacuuuuaucauugacggaccaaacaccccugagugucccgaugaccagagagcuuggaauaucugggaggucgaagauuacggcuucgguauuuuuacaacuaacaucugguugaagcucagggacucauauacccaggugugcgaucaccgucugaugagugcagccauaaaagacucuaaggcuguucacgccgauaugggguacuggauugagagcgaaaaaaaugagacauggaagcuagcacgggcguccuucaucgaagugaagacguguauuuggccaaaaucacauacccuguggagcaacggaguacucgagucugagaugaucauacccaagauccacggcgguccuauuucccaacauaauuaucgaccaggcuacuucacucagacagccgggccguggcaccugggaaaacuugaauuggacuuugaucugugcgagggcaccacugucgugguggacgaacacugcgggaacagaggacccaguuuaaggacaaccacggucacuggcaagaucauucaugagugguguugccgcagcuguacccucccuccacugcgguucagaggugaggaugggugcugguacggaauggaaaucaggcccguuaaagagaaggaagagaaucuugugaagucuaugguauccgcuggcucaggugaaguggacaguuuuagccugggcuugcucuguauaucgauuaugaucgaggaggucaugcgcucccgauggucucggaaaaugcugaugacagggacccuagccguguucuuucugcucaucaugggacagcugacuuggaacgaccuuauucguuugugcaucaugguuggcgcaaaugcuagcgauagaauggggaugggaacaaccuaucuggccuuaauggcaacauucaagaugaggccuauguuugccgugggccuccuguuccgccggcuuacuucaagagaaguccugcuacucaccauuggucugaguuugguggcuuccguugagcugccaaacucuuuagaagagcucggggacggacuggcgaugggcauaaugauccuuaaacuguugacggauuuucaaagcuaccagcucugggccacacugcuaucccugaccuucauuaagacuaccuuuucacuucacuaugcauggaaaacaauggcuauggugcucagcaucgucagucuguuccccuugugucugucuacuaccucccagaagacgacaugguuaccgguacuccugggcagccuugggugcaagccucugaccauguuuuugauugccgaaaauaaaaucuggggaaggaagucguggccacucaacgaggguauaauggccgugggcaucguuucaauucugcuaucuagucugcuuaaaaacgacgugccccucgcugggccucugaucgcaggaggcauguugauugccuguuacgucaucuccgguagcucugcggauuuaagccuggagaaggcugccgaaguguccugggaggaagaggcagaacauucaggggccagucacaauauacucguagaggugcaggacgauggaacuaugaaaauuaaggacgaggaacgagaugacacacugaccauccuucugaaagcuacuuugcuagcagucagcggcguuuauccccugucuaucccagccacacucuucguguggcauuucuggcaaaagaagaaacagcgcuccggcgugcugugggauaccccuucacccccagaggucgaacgggcggugcuugacgaugggauuuacagaauaaugcagaggggauuacugggucguagucagguuggcguagggguguuucaagagaacgucuuccacacgauguggcacgugacucgcggagcuguucucauguaucagggcaagcgguuggagccgagcugggccuccgugaaaaaggaccugaucucuuacggugggggauggagauuucagggcucguggaauaccggcgaagagguccaggugauugcaguagaaccugggaaaaaccccaagaauguccaaacagccccaggaaccuucaagacacccgagggugaagugggcgcuaucgcccucgacuuuaaaccugggacuagcggaucaccaauuguuaacagggagggcaagaucgugggucuguacgggaauggagucgugaccacguccggcacauauguuagugcaauagcucaggccaaagcgucucaggagggcccccuuccugaaaucgaggaugaaguguuccgaaagcggaaccugacuauuauggacuugcauccggggagcggaaaaacccgcagauaccuaccagccaucgucagggaggcaauuaagcggaagcugcgaacacucaucuuagcucccaccagagugguagccuccgaaauggcugaggcacugaaagguaugccuauacgcuaucaaacuaccgccgugaagucagagcacacaggcaaagaaauuguugaucuuaugugccaugccacguuuacuaugaggcugcucucuccaguccgugugcccaauuacaacaugaucaucauggacgaggcucacuucaccgauccuagcaguauugcggcacggggguauaucuccacaagagugggaaugggcgaagccgcugccauauuuaugaccgcaacuccgcccgguagcauggaggccuucccacagucuaaugcugucauucaggacgaagagagggauaucccugagcgcucauggaacuccggguacgaauggauuacagacuuucccggaaagaccguaugguucgugccaaguaucaaagcgggcaaugauauagccaacuguuugcgaaagaauggcaagagaguuauucagcugagccggaaaacguucgacacugaguaucaaaagacaaaaaacaacgauugggacuacguggucaccaccgacaucucggaaaugggggcaaauuuuagggcugaucgcgugaucgacccucguagaugccucaagcccguuauucugaaagauggaccagagcgggugauccuugccgguccgaugccugucacuguggcaucugccgcucagaggcgcggccgaauugggagaaaccauaauaaggagggagaccaguacauauauaugggccagccccuaaacaaugaugaagaccacgcccacuggacagaggcgaagaugcuguuggauaacaucaauaccccagaagguauuauccccgcauuauucgagccugaacgggagaaauccgccgcuaucgacggggaguacaggcugcgcggcgaagccagaaagacauuuguagagcucaugaggcggggagaucugccaguguggcuuagcuauaaaguugcuucagaaggcuuccaauacagugaccgucgcuggugcuuugauggggagcgaaacaaucagguccuggaagagaacauggacguggagauuuggacuaaggaaggagagagaaaaaagcucaggccccggugguuggaugcacgcacguauucugacccucuggcccuaagagaauucaaagaguuugcugccgguaggcgguccgugagcggcgaccugauacucgaaaucgggaagcuuccgcagcaucugacccagcgagcacaaaaugcguuagauaacuuggucaugcugcacaauucagagcagggaggcagagccuaccgccaugcuauggaggaacucccagacacaauugagacucugaugcuucuggcccucaucgcaguuuugaccgguggggugacacuguucuuuuuaaguggcaagggacuaggcaaaaccagcauugggcugcucuguguaauggcuuccucugugcuucuguggauggccagcgucgaaccccacuggaucgcagccuccauaaucuuggaguucuuucugauggugcuccugauuccugagcccgauaggcagcggacuccacaggacaaccaacuugcuuauguugugaucggacuccuguucaugauuuugacggucgcggccaaugaaaugggucuguuagagaccacaaagaaagaucuaggcaucgggcacguagcaguggaaaaccaucaccaugcugccaugcuggacguugaucuccacccugccucagcauggacucuuuacgcuguggccaccacaauagucacccccaugaugcgucauacuauugagaacacaacggcgaauaucucucugaccgcuauugccaaccaggcagccaucuugaugggacuggacaagggcuggccaauaaguaaaauggauaucggugugccucuccuggcucuugggugcuacucgcaggucaauccguuaacucugacagcagccgugcucauguugguugcgcacuaugcuauuaucggccccggacugcaagccaaggcaaccagagaagcccagaagaggaccgcugccggcauuaugaaaaacccaacaaucgacgggauaguggcaauugaucuagacccuguaguguacgaugcuaaguuugagaaacagcugggacagaucaugcuccuuauccuguguacuagccaaauuuugcugaugcgcacgaccugggcccucugcgaguccaucacacuggcgacuggccccuuaaccacacuuugggaagguucuccagggaaguucuggaauaccacuauagccgucucaauggcaaacauuuuccggggaagcuaucuggcuggcgccggucucgcauuuucccuaaugaaaagucugggcgggggacgaagaggcacgggggcucagggagagacauugggcgaaaaguggaagaggcagcugaaucagcucucuaaaagcgaguucaacaccuacaagcgcucagguaucauggaaguugaccgguccgaggccaaagaggggcuuaagagaggagaaacuaccaaacacgccgugagucguggcacagcgaagcugaggugguuugucgagcggaauuuggugaagccugaagguaaaguaauugaccugggcugugggcgcggaggcuggagcuauuacugcgcugggcucaagaaagugacugagguuaagggauauaccaaaggcggucccgggcaugaagagccgaucccaauggcaacauacggauggaacuuagugaagcugcacucuggcaaagaugucuucuuuauaccucccgagaagugugacacgcuucugugcgauaucggcgaauccucaccaaaucccaccauugaggaagggcgaacucuaagagugcucaagauggucgagccuuggcugaggggaaaccaauucuguaucaaaauuuugaauccguacaugcccagcgugguugagacacuggaacagaugcagcggaagcaugguggcaugcucguacgcaacccacuuucgagaaauucuacccacgagauguauugggugaguugcgggacuggaaacaucgucuccgccgugaauaugacaagcaggaugcuguuaaaccgauuuaccauggcucaccggaaaccuacguacgaacgugacguugaucugggcgccgguaccagacauguggcagucgagcccgaaguggccaacuuggacauuaucgggcagcgcauagagaauauuaagcacgagcauaaaucaacauggcacuaugaugaagacaacccuuacaagacuugggcuuaucauggauccuacgagguaaagccaucuggcagcgcgaguuccauggugaauggcguugucaaacuccugaccaagcccugggaugugaucccuauggugacacaaaucgccaugacugacaccacaccauucgggcagcagagggucuuuaaagaaaagguugauacccggacucccaaagcaaagagaggaacggcucaaauuauggaggugacagcccgcuggcuaugggguuuccuuagcaggaacaagaaaccgcgaauauguacccgggaagaguuuacuagaaagguaaggucuaaugcagccaucggcgcuguguucgucgacgagaaccaguggaauucagccaaagaagcgguggaggacgaucgcuuuugggaccugguucaccgugaacgggagcuccacaagcaggggaaaugcgcaaccugcguguauaacaugaugggaaagagagaaaagaaacugggcgaguucgguaaggccaaagggaguagggcuauuugguacaugugguugggagcccgcuuccuggaguuugaagcacucggcuucaugaaugaggaucauugguuuucccgagaaaacagccuuucuggcgucgagggggagggacugcacaaguuagguuacauccugcgggacauuucgaaaaucccuggcgggaauauguaugcugaugacacagccggaugggauacgagaauaaccgaagacgauuugcagaacgaggcuaagaucacugacauuauggaaccagagcaugcccuccuggcaaaaucaaucuucaagcuaacauaccaaaauaaggugguaaggguucagcgccccgcgaaaaacggcaccgugauggaugucauuagcagacgggaccagagggguuccgggcaggugggaacuuauggccuuaauacauuuaccaacauggaagcccaacugauccgucagauggagagugagggcauauuccucccuaacgaacuggagacaccaaauuuggcugggcgaguguuagauuggcuggaaaaguacggagucgagcgccucaaaagaauggccauuucuggugacgacuguguugugaagcccaucgaugaccgguuugcaacugcucuuaccgcccugaacgauaugggcaaaguaaggaaggacaucccgcagugggaaccuagcaagggguggaaugauuggcagcaagugcccuucugcucccaccacuuucaucagcuaauuaugaaagacggacgcgagauagucgugccauguagaaaccaggaugagcugguuggccgggcaagggugucacagggugccggguggagucuccgagaaacggcgugcuugggaaagucuuaugcucaaauguggcagcugauguacuuccaccguagagaccuucgccuggccgcaaaugccaucuguagcgcugucccuguggauuggguacccaccucccggacaacuuggucaauucaugcccaccaucaguggaugaccacagaggacaugcucagcguuuggaacaggguguggaucgaagagaauccauggauggaagauaaaacuagaauuucuuccugggaggacguccccuauuuaggcaagcgcgaggaccaauggugcggcagucugaucggguugaccgcacgggcuacgugggccacaaacauacagguggcgaucaaucagguuaggcgacugauuggaaacgaaaauuacagcgauuacaugaccucgaugaaaagauuuaagaacgaguccgaaccugagggugcucucugguga

SEQ ID NO: 13648 - RNA, 9879 nt, Artificial Sequence
  derived and/or modified CDS sequence (opt3) from DENV-1__FJ461307__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuugcaccccaugucggccuggguuuggaaacuagaaccgagacauggauguccucugaaggggccuggaaacagauccagaggguggagacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagacuuuguggagggucuuaguggcgcgacuuggguagauguuguguuggaacacggguccugugucacaaccauggcaaaggacaaacccacucuggauaucgagcuacucaagacagaagugaccaacccugccgugcugaggaaacuuugcauugaggcuaagaucucuaauacgaccacagacagccgguguccaacucaaggagaagccacccuggucgaggagcaggaugcaaacuucguuugccgccgaacauuuguggacagaggcugggguaauggguguggauuguucggcaaaggcucccuccugacuugcgcuaaguuuaagugcguaaccaaauuagaagggaagauagugcaguacgagaaccugaaauauucagucauugugacaguucacaccggagaucagcaucaaguggguaaugaaaguacugagcacggcacgacagccaccaucacuccccaggcgccuaccacagaaauucagcucaccgacuacggggcccuuacucuggacuguagcccaaggacaggauuggauuucaacgagaugguccuacugacgaugaaggagaaaucuuggcucgugcauaagcagugguuucuggaccuuccgcugcccuggaccuccggcgcaucaacuagccaagaaacauggaaucggcaggauuugcucguaaccuucaaaacagcucacgccaagaagcaggagguugugguccuggguagucaagaaggggcuaugcacacugccuuaaccggcgcaacggagauccagaccucuggaacaacuaccaucuuugccggccaucugaaaugccgucuaaagauggacaaacucacacugaaggggauguccuaugugauguguacuggaagcuucaaacuugaaaaggaggucgcugagacccagcacgguacgguguugguucagauuaaguacgaaggcacagaugcgccuugcaaaauaccauucucgacccaagacgagaagggggugacucagaacggacgccugaucacagcaaaucccauuguaaccgauaaagaaaagccugucaacaucgaggccgagccacccuuuggcgaaucuuauauagugauuggugcuggggagaaagcccucaagcuguccugguucaagaaaggcucaaguaucggaaagauguuugaagcaacugccagaggcgcuaggcggauggccauccuuggggacaccgcaugggauuucggaagcauugguggcguuuuuacauccguggggaaacugguccaucagaucuucggaacggcguacggcguguuguuuucugguguaagcuggaccaugaagauugggauaggcgugcuccugacuugguuaggacugaauucacgaaguacaucccuaagcaugaccuguaucgcuguuggccucgucacacuguaccuuggggugauggugcaggccgacucuggaugcgucauuaacuggaaaggccgcgaguugaagugugguucagggaucuucguuacuaaugaagugcacaccuggacggagcaauauaaguuucaggcagauaguccgaaaagacugagcgccgcuaucggaaaggccugggaggaaggcgugugcgguauuagguccgcaacacggcucgagaacauaauguggaaacagaucucuaacgaacugaaucauauuuuacuggagaacgacaugaaguucaccguagucgugggcgacguugcugggauccuugugcagggaaaaaagaugauucgcccucaacccauggaauacaaauauucguggaagagcuggggcaaggccaaaaucauaggggcggauguccagaauuccacuuuuaucauugacggaccaaacaccccugagugucccgaugaccagagagccuggaauaucugggagguggaagauuacggcuucgguauuuuuacaacuaacaucugguugaagcucagggacucauauacccagguuugcgaucaccgucugaugagugcugcaauaaaagacucuaaggccgugcacgcugauaugggguacuggauugagagcgaaaaaaaugagacauggaagcuagcccgggcauccuucaucgaaguaaagacguguauuuggccaaaaucacauacccuguggagcaacggaguccucgagucugagaugaucauacccaagauccacggcgguccuauuucccaacauaauuaucgaccaggcuacuucacucagacagcggggccguggcaccugggaaaacuugaauuggacuuugaucugugcgagggcaccacugugguggucgacgaacacugcgggaacagaggacccaguuuaaggacaaccacgguuacuggcaagaucauucaugagugguguugccgcagcuguacccucccuccacugcgguucagaggugaggaugggugcugguacggaauggaaaucaggcccgugaaagagaaggaagagaaucuuguaaagucuaugguguccgccggcucaggugaagucgacaguuuuagccugggcuugcucuguauaucgauuaugaucgaggaggugaugcgcucccgauggucucggaaaaugcugaugacagggacccuagcuguuuucuuucugcucaucaugggacagcugacuuggaacgaccuuauucguuugugcaucauggugggcgccaaugcaagcgauagaauggggaugggaacaaccuaucuggcuuuaauggccacauucaagaugaggccuauguuugcagucggccuccuguuccgccggcuuacuucaagagaagugcugcuacucaccauuggucugaguuugguugccuccguggagcugccaaacucuuuagaagagcucggggacggacuggcuaugggcauaaugauccuuaaacuguugacggauuuucaaagcuaccagcucugggcgacacugcuaucccugaccuucauuaagacuaccuuuucacuucacuaugccuggaaaacaauggcaaugguccucagcaucguaagucuguuccccuugugucugucuacuaccucccagaagacgacaugguuaccggugcuccugggcagccuugggugcaagccucugaccauguuuuugauugcugaaaauaaaaucuggggaaggaagucguggccacucaacgaggguauaauggccguuggcaucgugucaauucugcuaucuagucugcuuaaaaacgacgucccccucgccgggccucugaucgcuggaggcauguugauugcauguuacgugaucuccgguagcucugccgauuuaagccuggagaaggcggcugaaguauccugggaggaagaggccgaacauucaggggcaagucacaauauacucguggagguccaggacgauggaacuaugaaaauuaaggacgaggaacgagaugacacacugaccauccuucugaaagccacuuugcuagcuguuagcggcguguauccccugucuaucccagcaacacucuucguguggcauuucuggcaaaagaagaaacagcgcuccggcguccugugggauaccccuucacccccagagguggaacgggccguucuugacgaugggauuuacagaauaaugcagaggggauuacugggucguagucagguaggcgugggggucuuucaagagaacguguuccacacgauguggcacguuacucgcggagcggugcucauguaucagggcaagcgguuggagccgagcugggcuuccgucaaaaaggaccugaucucuuacggugggggauggagauuucagggcucguggaauaccggcgaagaggugcagguaauugccgucgaaccugggaaaaaccccaagaaugugcaaacagcaccaggaaccuucaagacacccgagggugaaguuggcgccaucgcucucgacuuuaaaccugggacuagcggaucaccaauugugaacagggagggcaagaucgucggucuguacgggaauggagugguuaccacguccggcacauaugugagugccauagcacaggcuaaagccucucaggagggcccccuuccugaaaucgaggaugaagucuuccgaaagcggaaccugacuauuauggacuugcauccggggagcggaaaaacccgcagauaccuaccagcgaucgugagggaggccauuaagcggaagcugcgaacacucaucuuagcacccaccagaguaguggcuuccgaaauggccgaggcucugaaagguaugccuauacgcuaucaaacuaccgcaguuaagucagagcacacaggcaaagaaauugucgaucuuaugugccaugccacguuuacuaugaggcugcucucuccagugcgugugcccaauuacaacaugaucaucauggacgaggcccacuucaccgauccuagcaguauugcugcgcggggguauaucuccacaagagucggaaugggcgaagcagccgcuauauuuaugaccgccacuccgcccgguagcauggaggcauucccacagucuaaugccguaauucaggacgaagagagggauaucccugagcgcucauggaacuccggguacgaauggauuacagacuuucccggaaagaccgugugguucguuccaaguaucaaagcuggcaaugauauagcgaacuguuugcgaaagaauggcaagagagugauucagcugagccggaaaacguucgacacugaguaucaaaagacaaaaaacaacgauugggacuacgucgugaccaccgacaucucggaaaugggggccaauuuuagggcagaucgcguuaucgacccucguagaugccucaagcccgugauucugaaagauggaccagagcgggucauccuugcugguccgaugccugugacuguagccucugcagcccagaggcgcggccgaauugggagaaaccauaauaaggagggagaccaguacauauauaugggccagccccuaaacaaugaugaagaccacgcucacuggacagaggccaagaugcuguuggauaacaucaauaccccagaagguauuauccccgcguuauucgagccugaacgggagaaauccgcagccaucgacggggaguacaggcugcgcggcgaagcuagaaagacauuuguggagcucaugaggcggggagaucugccaguuuggcuuagcuauaaagucgccucagaaggcuuccaauacagugaccgucgcuggugcuuugauggggagcgaaacaaucaggugcuggaagagaacauggacguggagauuuggacuaaggaaggagagagaaaaaagcucaggccccggugguuggaugcucgcacguauucugacccucuggcacuaagagaauucaaagaguuugccgcugguaggcgguccgucagcggcgaccugauacucgaaaucgggaagcuuccgcagcaucugacccagcgagcccaaaaugcauuagauaacuugguuaugcugcacaauucagagcagggaggcagagcguaccgccaugccauggaggaacucccagacacaauugagacucugaugcuucuggcucucaucgccguguugaccggugggguaacacuguucuuuuuaaguggcaagggacuaggcaaaaccagcauugggcugcucugugugauggcauccucuguccuucuguggauggcuagcguggaaccccacuggaucgccgcauccauaaucuuggaguucuuucugaugguucuccugauuccugagcccgauaggcagcggacuccacaggacaaccaacuugccuauguggucaucggacuccuguucaugauuuugacgguagcugcgaaugaaaugggucuguuagagaccacaaagaaagaucuaggcaucgggcacguggccguugaaaaccaucaccaugcagcuaugcuggacguggaucuccacccugccucagccuggacucuuuacgcagucgcuaccacaauaauuacccccaugaugcgucauacuaucgagaacacaacggccaauauuucucugaccgcgaucgcuaaccaggccgcaauauugaugggacuggacaagggcuggccaaucaguaaaauggauauuggugugccucuccuggcccuugggugcuacucgcaggucaauccguuaacucugacagcugcagugcucauguugguugcccacuaugcgaucauuggccccggacugcaagcuaaggccaccagagaagcacagaagaggaccgccgcuggcaucaugaaaaacccaacaauagacgggauuguggccaucgaucuagacccuguaguguacgaugcaaaguuugagaaacagcugggacagaucaugcuccuuauucuguguacuagccaaaucuugcugaugcgcacgaccugggcucucugcgaguccauaacacuggccacuggccccuuaaccacacuuugggaagguucuccagggaaguucuggaauaccacuauugcggucucaauggccaacaucuuccggggaagcuaucuggcaggcgcuggucucgccuuuucccuaaugaaaagucugggcgggggacgaagaggcacgggggcacagggagagacauugggcgaaaaguggaagaggcagcugaaucagcucucuaaaagcgaguucaacaccuacaagcgcucagguauuauggaaguugaccgguccgaggcuaaagaggggcuuaagagaggagaaacuaccaaacacgccgugagucguggcacagccaagcugaggugguuugucgagcggaauuuggugaagccugaagguaaaguaaucgaccugggcugugggcgcggaggcuggagcuauuacugcgcggggcucaagaaagugacugagguuaagggauauaccaaaggcggucccgggcaugaagagccgauaccaauggcuacauacggauggaacuuagugaagcugcacucuggcaaagaugucuucuuuaucccucccgagaagugugacacgcuucugugcgauauuggcgaauccucaccaaaucccaccaucgaggaagggcgaacucuaagagugcucaagauggucgagccuuggcugaggggaaaccaauucuguauuaaaaucuugaauccguacaugcccagcgugguugagacacuggaacagaugcagcggaagcaugguggcaugcucguacgcaacccacuuucgagaaauucuacccacgagauguauugggugaguugcgggacuggaaacauugucuccgcagugaauaugacaagcaggaugcuguuaaaccgauuuaccauggcccaccggaaaccuacguacgaacgugacguugaucugggcgcugguaccagacauguggccgucgagcccgaaguggcaaacuuggacaucauagggcagcgcauugagaauaucaagcacgagcauaaaucaacauggcacuaugaugaagacaacccuuacaagacuugggccuaucauggauccuacgagguaaagccaucuggcagcgcuaguuccauggugaauggcguugucaaacuccugaccaagcccugggaugugaucccuauggugacacaaauugcgaugacugacaccacaccauucgggcagcagagggucuuuaaagaaaagguugauacccggacucccaaagccaagagaggaacggcacaaauaauggaggugacagcucgcuggcuaugggguuuccuuagcaggaacaagaaaccgcgaaucuguacccgggaagaguuuacuagaaagguaaggucuaaugccgcaauuggcgccguguucgucgacgagaaccaguggaauucagcuaaagaagccguggaggacgaucgcuuuugggaccugguucaccgugaacgggagcuccacaagcaggggaaaugcgcgaccugcguguauaacaugaugggaaagagagaaaagaaacugggcgaguucgguaaggcaaaagggaguagggccaucugguacaugugguugggagcucgcuuccuggaguuugaagcccucggcuucaugaaugaggaucauugguuuucccgagaaaacagccuuucuggcgucgagggggagggacugcacaaguuagguuacauucugcgggacaucucgaaaauaccuggcgggaauauguaugcagaugacacagcuggaugggauacgagaaucaccgaagacgauuugcagaacgaggccaagauuacugacaucauggaaccagagcaugcucuccuggccaaaucaauuuucaagcuaacauaccaaaauaaggugguaaggguucagcgccccgcaaaaaacggcaccgugauggaugucaucagcagacgggaccagagggguuccgggcaggugggaacuuauggccuuaauacauuuaccaacauggaagcgcaacugauacgucagauggagagugagggcauuuuccucccuaacgaacuggagacaccaaauuuggccgggcgaguguuagauuggcuggaaaaguacggagucgagcgccucaaaagaauggcuaucucuggugacgacuguguugugaagcccaucgaugaccgguuugccacugcacuuaccgcucugaacgauaugggcaaaguaaggaaggacauuccgcagugggaaccuagcaagggguggaaugauuggcagcaagugcccuucugcucccaccacuuucaucagcuaauaaugaaagacggacgcgagaucgucgugccauguagaaaccaggaugagcugguuggccgggccagggugucacagggugcaggguggagucuccgagaaacggccugcuugggaaagucuuaugcgcaaauguggcagcugauguacuuccaccguagagaccuucgccuggcugccaaugcaauuuguagcgccgucccuguggauuggguacccaccucccggacaacuuggucaauccaugcucaccaucaguggaugaccacagaggacaugcucagcguuuggaacaggguguggauugaagagaauccauggauggaagauaaaacuagaaucucuuccugggaggacguccccuauuuaggcaagcgcgaggaccaauggugcggcagucugauaggguugaccgcccgggcaacgugggcuacaaacauccagguggccauuaaucagguuaggcgacugaucggaaacgaaaauuacagcgauuacaugauuucgaugaaaagauuuaagaacgaguccgaaccugagggugcgcucugguga

SEQ ID NO: 13649 - RNA, 9879 nt, Artificial Sequence
  derived and/or modified CDS sequence (opt3) from DENV-1__FJ410213__SS-prME
agcgugaccaugcugcucaugcuuaugcccaccgcccuggcuuuccacuugacuacgagaggaggggaaccucauaugaucguaaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggcauccuucaucgagguaaagaccuguauuuggccaaaaucccacacucuauggucaaacggaguccuggaaagcgagaugaucauacccaagaucuacggcgguccuauuucucaacauaauuaucgaccaggcuacuucacacagaccgcggggccguggcaccucggaaaacuggagcuugauuuugacuugugcgaaggcacuacagugguggucgaugagcacugcgggaacagaggacccucccugaggaccacgacuguuaccggcaagaucauucaugaaugguguugccgcaguuguacauuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaugaccgggacucuggcuguuuuccuacugcucaucaugggacagcugacauggaacgaucuuauucgguugugcaucauggugggcgccaaugcaucugaccguauggggaugggaaccacauaucuggcuuuaauggccacuuuuaaaaugagaccuauguucgcagucggccuccuguuuaggcgccuuaccagccgggaggugcugcuacucacgauuggucugucauugguugccaguguggaacugccaaacuccuuagaggaacucggggauggacuggcuaugggcauaaugauccuuaagcuguugacagacuuccaaucucaccagcucugggcgacccugcuaagccugacuuuuauuaaaaccacacuuucccuccauuacgccuggaagacuauggcaaugguccugucaaucgucagcuuguucccccuguguuuaaguaccacgucucagaagacaaccuggcucccggugcugcuuggcucccuggggugcaaaccuuugacuauguuucucauuacagagaauaagaucuggggaagaaaaagcuggccacugaacgaagguauaauggcuguuggcguggucucgauccuacugucaucucuucucaaggaugacgugccccuggccgggccuuugauugccggaggcauguuaaucgcuuguuauguaauuagugguuccagcgcagaucugucucucgagaaagccgcggaggugagcugggaagaggaagcugagcacuccggggccucacauaacauccuggucgaaguucaggacgauggaaccaugaagauaaaagacgaggagagggaugacacucuuacaauucuguugaaggcaacccuacuggccgugaguggcguguacccccucagcaucccagcuacgcuguucgucugguauuuuuggcaaaagaaaaagcagcgaucuggcgugcuuugggauacuccuucacccccagaaguugagcgcgcaguauuagacgacgggaucuaccggauuaugcagagaggacugcucgguaggagccaggugggcgucgggguguuccaagaaaauguuuuccacaccauguggcacgugacacguggagccgucuugauguaucagggcaaacgccuggagccgaguugggcgagcgugaagaaagaucucauauccuacggugggggauggcggcugcagggcucuuggaacaccggcgaggaaguacaggucaucgcuguggagccugggaagaaucccaagaacguucaaacagccccaggaacuuuuaaaacccccgaaggugaggugggcgcaauugcccuugacuucaagccugggacgucgggaagcccaaucgucaauagagaaggcaaaauugugggucuguacgggaacggaguugugacaacuucaggcaccuaugucuccgcuaucgcccaggcaaaggcuagucaggagggccccuugccugagauagaagaugagguguuuaggaaacgaaaucuaacaaucauggaccugcauccggggucuggaaagacccggcgcuaccucccagccauuguaagagaagcgaucaagaggaaauuacggacucugauucuugcccccacccgagugguugcaagcgagauggcugaagcccugaaggguaugccuaucagauaucaaacaacggcugucaaauccgagcacacuggcaaggagauaguggaucucaugugccaugcaaccuucacaaugcgcuugcugucaccagugaggguccccaacuacaauaugauuaucauggacgaagcccacuuuaccgauccuucuagcaucgccgcucguggguauauuaguacucggguaggaaugggcgaggcggcagccaucuucaugacagcuaccccgcccgguuccguggaagccuuuccacagagcaacgcaguuauacaggacgaggaaagagauauuccugagaggucuuggaacucaggguacgaguggaucacggacuuccccggaaaaacugugugguuugucccauccauuaagaguggcaacgauaucgccaauugucuccgcaagaacggcaaacgagugauacagcugagcagaaagacauucgacaccgaauaucagaaaaccaagaauaacgacugggauuacguugugacuacagacauuucggagaugggggcuaacuuucgggcggauagggucaucgacccucgccguugccuuaaacccgugauccuaaaggauggaccagaaagaguaauucuggccgguccgaugccugugaccguugcaucugcugcccagcggaggggccgcaucgggcgaaaucauaacaaggagggagaccaguacauuuauaugggccagcccuugaauaacgaugaggaccacgcacacuggacagaagccaaaauguuacuggauaauauaaacacuccagaggguaucauucccgcucucuucgaaccugagagagaaaaguccgccgcgaucgacggggaguaccggcugaggggcgaggcacgcaaaacguucgucgaacuuaugagaaggggagaucugccaguguggcucagcuauaagguggccucagagggcuuucaauacagugaccggcguuggugcuucgauggggaacgcaauaaccaggucuuggaggaaaauauggacguugagaucuggaccaaagagggagaacgaaagaaacugagacccagguggcuagacgcucggacauauucugauccucuggcccuccgcgaguuuaaggaguucgcugcagguagaagguccgugagcggcgaccuuauucuggagauagggaaguuaccgcagcauuugacucagcgggcccaaaacgcucuggauaaucucguaaugcugcacaacucagaacagggaggccgagccuacagacaugcaauggaggagcuuccagacaccaucgaaacacugaugcucuuggcgcugauugccguguuaaccgguggggucacucuauuuuuccugaguggccgcggacucggcaaaacgagcaucgggcuucugugugugauggcuuccucuguuuugcuguggauggccagcguggagccccacuggauugcagcuuccaucauacucgaauuuuuccugaugguccuucucaucccugagcccgauaggcagcggaccccacaggacaaucaacuggccuauguagugauuggauugcuguuuaugaucuuaacaguugcagccaacgagaugggucuacuggaaacuaccaagaaagaucucggcauugggcacguggcugucgagaaucaucaccaugcgacaaugcuugacguggaucugcacccugccucagcauggaccuuguacgcugucgccacuacaaucauaacgcccaugaugcgucauaccauugaaaacacuacagccaacaucucucugaccgcaauugcuaaucaggccgcgauccucaugggacuggacaagggcuggccaauaaguaaaauggauaucggugugccucuuuuagcucuggggugcuacucgcagguuaacccgcucaccuugacagccgcagugcugaugcuaguagcccacuaugcuauuaucggccccggacugcaagcaaaggccacuagagaggcgcagaagaggacggcugccggcauuaugaaaaauccaaccguggacgggaucgucgcaauagaucucgacccuguuguguacgacgccaaguucgaaaaacagcuuggacagauuaugcuguugauccuguguacaagccaaauccuccugaugcgcacuaccugggcuuuaugcgaguccauuacacuugccaccggcccccugacuacgcucugggaggguucuccagggaaguuuuggaacacaaccaucgcagucucaauggcuaauauauuccggggaagcuaucuagccggcgcgggucuggccuuuuccuugaugaaaagucugggcgggggacgaagaggcacuggggcacagggagaaacccucggcgagaaguggaagaggcagcuuaaccagcugucuaaaagcgaguucaauauuuacaagcgcucagguaucauggagguggaucgguccgaagcuaaagagggguugaagagaggagagacaacucgucacgccguaaguaggggcaccgcaaaacugcggugguucguggaacgcaaccucguuaagccugaggguaaggugauugacuuaggcugugggcgaggaggcuggagcuauuacugcgcugggcugaaaaaggucacagaagugaaaggauauacgaagggcggucccgggcaugaggaaccgaucccaauggccaccuacggauggaaucuugucaaacugcacucuggcaaggauguguuuuucacuccucccgagaaaugugacacacuacucugcgauauaggcgaguccucaccaaaccccaccaucgaagaggggagaacucugaggguuuugaagaugguagaaccuuggcugcggggaaaucaauuuuguauuaagauccucaacccguacaugcccagcguggucgagacacuugagcagaugcagcgcaaacaugguggcaugcuggugagaaauccauuaucgaggaacucuacccacgaaauguauuggguuaguugcgggacgggaaauauuguguccgccgucaacaugaccagccgaaugcuguugaaucgguucacaauggcgcaccguaagccuacuuacgagagagacguggaucucggcgcugguacccgccauguagcaguggaacccgagguugccaaccuggacaucauugggcagaggaucgaaaacauaaaacacgagcauaagucaacauggcacuaugaugaggacaauccuuacaaaacuugggcuuaucauggauccuacgaagucaagccaucuggcagcgccaguuccauggugaacggcguggucaagcuacuuaccaaacccugggauguuauuccuauggugacacaaaucgcaaugaccgacacuacgccauuugggcagcagcggguauucaaggagaaaguggacacaagaacccccaaggccaaacgcggaacugcucaaaucauggaagucaccgcgagguggcugugggguuuucucagccgaaauaagaagccgcggauuuguacaagagaggaguucacgaggaaagugcgcucuaacgccgcaauaggcgcuguuuuuguggaugagaaucaguggaacucagccaaggaggcagucgaagacgagcguuucugggaucuggugcagaaagaacgggaguugcacaagcaggggaaaugcgcaaccugcguauauaauaugaugggaaagagagaaaagaaacugggcgaguuugguaaggcuaaagggaguagggccaucugguacauguggcucggagcgcgcuuccuugaguuugaagcacugggcuucaugaacgaggaccacugguucucccgagaaaauagcuuaucuggcguugagggggagggacugcauaaguuggguuacauucuccgggauaucucgaaaauuccuggcgggaacauguaugccgacgauacugcuggaugggacacaagaaucaccgaagaugaccugcaaaaugaggccaagauaacugauaucauggaaccagagcacgcacuacuugcuacaucaauuuuuaaacugaccuaccagaacaagguggucagggugcagcgccccgccaagaauggcacagugauggacgucaucagcagacgggaucagagggguuccgggcaaguuggaacuuauggccucaacaccuucacgaauauggaagcucagcugauucgucagauggagagugagggcaucuuuuugccuucugaauuagagaccccaaaccuggccgaacgagugcucgacuggcuugagaaauacgggguagaacgccugaagagaauggcaauaagcggagacgauuguguggucaaacccauugacgaucgguucgcgacagcccuaacugcucugaacgacauggguaaggugaggaaagauaucccgcagugggagccuuccaagggcuggaaugacuggcaacagguucccuuuugcucacaucacuuccaccagcucaucaugaaggaugggcgcgagauuguggucccauguagaaaccaggacgaauuggugggacgggccaggguaagucaaggcgcagguuggucucugcgagagaccgcuugccuugggaaaagcuaugcccagauguggcagcugauguacuuucaucguagagaucuccgcuuagcagccaaugcgauauguuccgcuguuccuguggacuggguccccacaucacggacuaccuggagcauccacgcccaucaccaauggaugacgacagaagauaugcugucuguguggaacaggguuuggauugaggaaaauccauggauggaggacaagacccauguguccaguuggggagacguccccuauuugggcaaaagagaggaucaguggugcggcagccugaucgggcucacugcacgcgccacaugggcuucgaacauucagguggccaucaaucagguacggaggcuuauaggaaacgaaaauuaccuggacuacaugaccuccaugaagcgauucaaaaacgagggugauccugaaggcgcacuaugguga

SEQ ID NO: 13650 - RNA, 9879 nt, Artificial Sequence
  derived and/or modified CDS sequence (opt3) from DENV-1__FJ461308__SS-prME
agcgugacaaugcugcuaaugcuuaugcccacagcacuggcuuuccacuugacuacgcgaggcggggaaccucauaugaucgucuccaagcaggaaagggggaaaucuuuacuguuuaagacaucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagagccgaaaccuggauguccucugagggggcuuggaaacagauccagaggguggaaacaugggcauugcggcacccuggauuuacuguuauugcccucuuccuggcucaugccaucggcaccucgauuacacagaagggcaucauauuuauccugcucauguuagugaccccaucaauggcgaugcgcugcgucgggauuggaagcagagauuucguggagggucugaguggcgcaacguggguagacguugugcuugagcacggguccugugucacuacaauggccaaggauaaacccaccuuggacaucgaacugcuaaagacugaggugacaaacccugcugugcucaggaaacugugcauugaagccaagaucucuaauaccacgaccgauagccgguguccaacacaaggagaggcaacucuugucgaagaacaagacgcuaacuuuguuugccgccgaaccuucguggauagaggcugggguaauggguguggacuguuuggcaaaggcuccuugauaacaugcgccaaguucaagugcguaacuaaacucgaggggaagaccgugcaguacgaaaaccugaaauauucagucauugugacaguucacaccggagaccagcaucaaguggguaaugagaguacugaacacggcacgacagcgaccaucacuccccaggccccuagcaccgagauucaguuaacagacuacggggcacugacccucgauuguucuccaaggacuggacuugacuuuaacgaaaugguccuguugacaaugaaggagaaauccuggcuagugcauaagcagugguuccuggaucucccgcugcccuggacgucaggcgcuagcaccagucaagagacuuggaaucggaaagaccuucugguaacauuuaagaccgcccacgcuaagaaacaggaaguuguggucuuggguucucaggagggggccaugcacacagcacucacuggcgccaccgaaauccaaacguccggaaccacaacuaucuucgcuggccaucugaagugccguuuaaaaauggauaagcugacccuaaaagggaugagcuaugugauguguacaggaucguucaagcucgagaaggaagucgcggagacucagcacgguaccgugcugguucagauuaaauacgagggcacggacgcaccuugcaagauaccauuuucuacacaggaugaaaaaggggugacccaaaacggacgccuuaucacugccaaucccauuguaacagacaaggagaaaccugucaacaucgaagcugagccacccuucggcgaguccuguauagugauuggugccggggaaaaggcauugaagcugucaugguuuaaaaagggcaguagcaucggaaaaauguucgaggccaccgcuagaggcgccaggcggauggcaauccucggggauacugcgugggacuuuggauccauugguggcguuuucaccucuguggggaagcugguccaucagaucuuuggaacagcuuauggcgugcuuuucagcgguguaucauggacgaugaaaauugggauaggcgugcuguugaccuggcucggacugaauagucgauccacuagcuuaucuaugacaugcaucgccguuggccuggucacccuauaccucggggugauggugcaggcagauucaggaugugucauuaacuggaagggccgcgaacugaagugcgguagugggaucuuuguuacaaaugaggugcacacuuggaccgaacaguacaaauuccaagccgacagcccgaagagacuuuccgcugccaucggaaaagcaugggaggagggcgugugugguauuaggucugcuacgcgguuggaaaacauaauguggaagcagaucucgaacgagcugaaucauauucuccuggaaaacgacaugaaauuuacaguagucgugggcgauguugccgggaucuuagcgcagggaaagaaaaugauucgcccucagcccauggagcacaaguauagcuggaaguccuggggcaaagccaagaucauaggggcugacgugcaaaauaccacuuucaucauugauggaccaaacaccccugaaugccccgacgaucagagagcauggaauaucugggaggucgaggacuacggcuuugguauuuucacaacuaacaucuggcugaaacuuagggauucauauacccaggugugugaccaccguuugaugagugccgcuauaaaggauucuaaagccguucaugcagacaugggguacuggauugaaagcgagaagaaugaaacauggaagcucgcgcgggccuccuucaucgaggugaaaacgugcauuuggccaaagucacacacccuguggagcaacggaguacuagaaucugagaugaucauacccaaaaucuauggcgguccuauuucccagcauaauuaccgaccaggcuauuuuacucaaacagcugggccguggcaccugggaaagcucgagcuggauuucgaccuuugcgaaggcaccacugucgugguggaugagcacugugggaacagaggacccaguuugaggacaaccacggucacuggcaaaaucauucaugaauggugcugucgcagcugcacccugccuccauuacgguuuaagggugaggacggguguugguacggaauggagaucagacccguuaaggaaaaagaggaaaaucucgugaagucuaugguauccgccggcucaggugagguggacaguuucagccugggccuucugugcauaucgauuaugaucgaagaggucaugaggucccgcuggucucgaaaaauguugaugacagggacccucgcaguguuuuuccugcuaaucaugggacagcugacuuggaacgaucucauucggcuguguaucaugguuggcgcuaaugccagcgaccguauggggaugggaacaaccuaccuugcauugauggccacauuuaagaugagaccuauguucgcugugggccuguuauuuaggcgccucacuucacgggagguccugcuucugaccauuggucuaagucucguggcguccguugaacugccaaacucuuuggaggaacugggggauggauuagccaugggcauaaugauccucaaacugcuuacggacuuccagagccaccaacugugggcaacauugcucucccugaccuuuauuaagacuaccuucucacuacauuaugcuuggaagacaauggccauggugcugagcaucgucagucuuuuuccccucugccugucuacuaccucccagaaaacgacaugguugccgguacuguuaggcagccucggguguaagccucugaccauguuccuuauugccgagaauaaaaucuggggaagaaagucguggccacugaacgaagguauaauggcugugggcaucguuucaauuuugcucucuagucugcucaagaaugaugugccccuggcagggccucuuaucgccggaggcaugcucauugcgugcuacgucaucuccgguagcucugcugaccugagcuuggagaaggccgcagagguguccugggaagaggaagccgagcacucaggggcuagucauaauauauuaguagaagugcaggaugacggaacuaugaaaauuaaggaugaggagagggacgauacacugaccauccuccugaaggcaacucuucuggccgucagcggcguuuaucccuugucuaucccagcgacacuauucgugugguacuuuuggcagaaaaagaaacaacgauccggcgugcugugggacaccccuucacccccagaagucgagcgcgcugugcucgaugacgggauuuaucggauaaugcagagaggacugcuugguaggagucagguuggcguagggguguuccaggaaaacgucuuucacacgauguggcacgugacucguggagccguuuuaauguaccaaggcaagcgccuggagccgagcugggcauccgugaaaaaggaccucaucucuuauggugggggauggcgguugcagggcucguggaauaccggcgaggaaguccaggugauugccguagagccugggaagaaccccaaaaauguccagacagcuccaggaaccuucaagacaagcgaaggugaggugggcgccaucgcacuggauuuuaaacccgggacuucaggauccccuauuguuaacagagaaggcaagaucgugggucucuacgggaauggagucgugaccacgaguggcacauacguuucugcuauagcccaagcgaaagccagccaggagggcccacugcccgagaucgaagacgagguguucaggaagcgaaaccuuacuauuauggaucugcauccuggguccggaaagacccggcgcuauuugccggcaaucgucagagaagcuauuaaaaggaagcuacggacacugauccucgccccaacccgagugguagcuucagagauggcagaagccuuaaaagguaugcccauaagauaccagacuaccgccgugaagucugagcacacaggcaaagagauuguugaccugaugugucaugcuacguuuacuaugcgccuucugagcccugucagggugccaaauuauaacaugaucaucauggaugaagcgcacuucaccgaccccaguuccauugcagcccguggguacaucagcacacgggugggaaugggcgaggcugccgcaauauuuaugaccgccacuccuccggguucugucgaggcuuucccccaaucaaaugcgguaauucaggaugaggaaagagacaucccagagagguccuggaacaguggguaugaguggauuacagauuuuccuggaaagaccgugugguucguucccagcaucaagucgggcaaugacauagccaacugccuccgcaaaaauggcaagcgagugauucaguugucuagaaaaacguucgauacugaauaccagaagaccaagaacaacgacugggacuaugucgugaccaccgauaucuccgagaugggggcaaauuuucgggcugacaggguuaucgauccacgccguugccugaagccugugauucucaaggacggacccgaaagagucauccuggccgguccaaugccggugacuguagcaagcgccgcucaacggaggggccgcauugggcgaaaccauaauaaagagggagaucaguacauauacaugggccagccucuuaacaaugacgaggaucacgcccacuggacagaagcgaagaugcuacuggacaacaucaauacccccgaggguauuaucccagcauuguucgaacccgagagagaaaaaucagccgcuaucgauggggaguaucgguuaaggggcgaggcccgcaagacauuuguggaacugaugagaaggggagaccucccuguuuggcugaguuacaaagucgcuucugagggcuuccaguauuccgaucggcguugguguuuugacggggaacgcaacaaucaagugcuugaggaaaacauggauguggagauuuggacuaaggagggagaaaggaaaaagcugagaccaagauggcucgacgcacggacguacagcgaccccuuggcccugcgcgaguucaaggaauuugcugccgguagaaggucagucaguggcgaucuaauacuggagaucgggaaacucccucagcaucuuacccagcgggcacagaaugcgcuggacaacuuaguuauguugcacaauagcgaacaaggaggccgagccuauagacaugcuauggaggagcugccggauacaauugaaacucucaugcugcuugcccugaucgcagugcucaccggugggguaacauuguucuuucuguccggccgcggauuaggcaagaccucuauugggcuacugugcgugauggcuagcuccguccuccuuuggauggccucaguggagccacacuggaucgcagccucuauaauccuggaguucuuuuugaugguucugcucauucccgagccugacaggcagcggacuccccaggauaaccagcuggcuuacguggucaucggacuucucuucaugauucugacgguagcggccaaugagauggguuugcuggaaaccaccaaaaaggacuuaggcaucgggcacguggcaguugagaaccaucaccaugcugccaugcuagauguggaccugcacccagccagugcauggacucucuaugcugucgccaccacaauaauuaccccuaugaugcgucauacuaucgaaaacacaacggcgaauauuucgcuuaccgcuaucgccaaccaagcagccauacugaugggauuggauaaaggcuggcccaucagcaagauggacauuggugugccacugcucgcucugggguguuacucccaggucaauccucuuacuuuaacagcagccgugcugaugcucguugcgcacuacgcuaucauuggcccgggauugcaggccaaggcaaccagagaggcccagaaaaggaccgcugccggcaucaugaagaaccccacaguggaugggauaguagcaauugaccuggauccaguggucuaugacgcuaaauuugaaaagcagcuaggacagaucaugcugcucauccuuugcacuucucagauucuguugaugcgcacgaccugggcccugugugagucaaucacacucgcgacuggcccucugaccacauuaugggaggguagccccgggaaauucuggaauaccacuauagccguuuccauggcaaacauuuuccggggaaguuaccuugcuggcgccggucuggcauuuucucucaugaaaagccuaggcgggggacgaagaggcacgggggcucaaggagaaacacugggcgagaaguggaaaaggcaguugaaucagcugucaaaguccgaguucaacaccuauaaacgcagugguaucauggagguggaccggagcgaagccaaggaggggcucaaaagaggagagacuaccaagcacgccgucucucguggcacagcgaaacuuaggugguuuguggaacggaaucugguaaaaccagaggguaaggugauugauuugggcugcgggcgcggaggcugguccuacuauugugcugggcugaaaaagguuacugaagugaaaggauacaccaagggcgguccugggcaugaggaacccaucccgauggcaacauauggauggaaccucgucaaauuacacucaggcaaggacguguucuuuauaccaccugagaagugcgauacgcugcuuugugacaucggcgagagcucgcccaauccaaccauugaagaggggcgaacucugagaguccuaaaaaugguggaacccuggcucaggggaaaccaguucugcaucaagauucugaauccuuacaugccgucuguuguagagacauuggagcaaaugcagcggaaacaugguggcaugcuggugcgcaacccccucaguagaaauuccacccacgaaauguacugggucagcugugggacuggaaacaucgugucagccguuaauaugacauccaggaugcuucugaaccgauuuaccauggcucaccggaagccaacguaugagcgugauguggacuuaggcgccgguaccagacaugucgcaguggaaccugagguagccaaccuggauauuaucgggcagcgcauagaaaauauuaaacacgagcauaagucuacauggcacuacgacgaggauaaccccuauaagacuugggcuuaccauggaagcuaugaagugaaaccuaguggcuccgcgagcucuaugguuaauggcgucgugaaguugcucaccaaaccaugggacgugauccccauggucacacagaucgccaugacugauaccacaccuuucgggcaacagaggguuuuuaaggagaaaguggacacccggacuccaaaggcaaagagaggaacggcucagauuauggaaguaacagccaaauggcugugggguuuccuaucacgcaacaagaaacccaggauaugcacccgagaggaauuuacucggaaggugagaaguaaugcagccaucggcgcugucuucguggacgagaaccaauggaacuccgccaaagaggcgguugaagaugagagguuuugggaccuugugcaccgcgaacgugagcugcacaagcaggggaagugcgcaaccugugucuacaacaugaugggaaaacgggaaaagaaacucggcgaguucgguaaggccaaagggagcagagcuauuugguauauguggcugggagccagguucuuggaguuugaagcacugggcuucaugaaugaggaucauugguuuucucgcgaaaacucgcucucaggcguggagggggagggacuucacaagcuggguuacaucuuacgagacauuagcaaaaucccgggcgggaauauguacgcugaugacacagccggaugggauacgcggauaaccgaagacgaucugcagaacgaggcuaagaucacugacauuauggaaccugagcaugccuugcucgcaaaguccaucuucaaacugacauaucagaauaagguaguuagagugcaaaggccagcgaaaaacggcaccgucauggaugugauuagucgcagagaccagcgggguucuggacaggugggaacuuacggccuaaauacauuuaccaacauggaagcccagcuuaucaggcaaauggagagcgagggcauauucucccccucagaacuggagacaccuaaccucgcugggcguguccuggauugguuggaaaagcacggaguugagcgauuaaaacgcauggccauuaguggugacgacugcgugguaaagccaaucgaugacagauuugcaacugcucugaccgcccucaaugauaugggcaaggugcggaaagacaucccccagugggaaccgucuaagggguggaacgauuggcagcaggucccuuucuguagccaccauuuucaccaacuuauuaugaaagacggaagggagauagugguucccugccgcaaucaggaugagcuggugggcagagcacgggucucccagggugccggguggucacuaagggaaacggcgugucugggaaagagcuaugcucagauguggcaacucauguacuuccaucgacgugacuugagacuggccgcaaacgccaucugcucugcugugccaguagauuggguuccuaccucccgcacaacuuggaguauucacgcccaucaccaguggaugaccacagaggacaugcuuagcguguggaaucgggucuggaucgaagagaaccccuggauggaagauaaaacucacauuucguccuggggcgacgugccauaucugggcaagagggaggaccaguggugugggucucucaucggauuaaccgcaagagcuacgugggccacaaauauacaaguugcgaucaaccaggugcgccggcugauugguaaugagaacuacuuggauuauaugaccucaaugaagagguuuaaaaaugaaagcgaccccgagggcgcucugugguga

SEQ ID NO: 13651 - RNA, 9879 nt, Artificial Sequence
  derived and/or modified CDS sequence (opt3) from DENV-1__FJ461310__SS-prME
uccgugacaaugcugcucaugcuuaugcccacagcacuggcuuuccacuugacuacgagaggaggggaaccucauaugaucgucuccaagcaggaaaggggaaaaucuuuacuguuuaagaccucagccgguguuaauaugugcacacuaauugccauggaccucggagaacugugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggucguucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuaaucacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaaguucaccgugguagucggcgauguggcugggauccuggcccagggcaagaagaugauacgcccucaacccauggaguacaaauauucguggaaaagcuggggcaaggcgaagaucauuggggccgacguucagaauacuaccuuuaucauugauggaccaaacacaccugaaugucccgacgaucagagagcuuggaauaucugggagguggaggacuacggcuucgguauauuuacuaccaacauuuggcuuaaguugagggauuccuauacacaggucugcgaccaccgucucaugucagcagccaucaaagauaguaaggcugugcacgccgacaugggguacuggauugaaucugagaaaaaugaaacguggaagcuggcacgggcgagcuucaucgagguuaagaccuguauauggccaaaaucccauacucuauggucaaacggagugcuggaaagcgagaugaucauucccaagaucuauggcgguccuauuucucaacacaauuaccgaccaggcuacuucacacaggccgcugggccguggcaucucggaaaacuggagcuugauuuugacuugugcgaaggcaccacuguagucguggaugagcacugcgggaacagaggacccucccugaggacaaccacggugacuggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggcguaugcucaugacagggacccuggcagucuucuuucuacugaucaugggacagcucacuuggaacgaucugauuagacuuugcauaauggugggcgcuaaugccucugacaggauggggaugggaacaaccuacuuggcacugauggccacauucaaaaugcgcccuauguuugcuguuggcuuacucuuccggagacugacuagcagggaggugcuucugcuaaccaucggucucucacuggucgcgaguguggaauugccaaacucccuggaggaauuaggggauggacucgccaugggcauuaugauccugaaacuucugacggacuuucaaucucaucaguugugggcaacacuccugagccuaaccuucauuaaaacuaccuuuucccugcacuaugcuuggaagacaauggccaugguucuuucaaucgugagccucuucccccuguguuugaguacuaccucucagaaaacgacauggcugccggucuuacucggcucccuggggugcaagccucuuaccauguuucugauagccgagaauaagaucuggggacgacgcagcuggccauugaacgaagguauuauggcuguaggcaucgugucgauucuccugucaucucuacugaaaaacgauguuccccuugcagggccucucaucgccggaggcaugcugauagcguguuacgugauuagugguuccagcgcugacuugucuuuagagaaggccgcagaggucagcugggaagaggaagccgagcauuccggggcuucacacaauauccugguggaaguacaggaugacggaacuaugaaaaucaaggaugaggagcgggacgauacacucaccauucugcuuaaagcaacucuguuggccgugaguggcgucuauccccuaagcauaccagcgacacuguucguuugguacuucuggcaaagaaagaaacagaggucuggcgugcucugggacaccccuucacccccagaaguggagcgugcuguccuggaugacgggaucuaucgcauuaugcagcggggacuuuuagguagaagccaggugggcguugggguauuucaagaaaacguguuccauacgauguggcacgucacuaggggagccgugcugauguaccagggcaagcgacucgagccgaguugggcaagcguuaagaaagacuugaucuccuacggugggggauggcggcugcagggcucuuggaauaccggcgaggaagugcaggucauugccguggagccugggaagaaccccaaaaauguacaaacagcuccaggaaccuuuaagacacccgaaggugaggucggcgccaucgcacucgauuucaaaccugggacuucgggaagcccaauagugaaccgcgaaggcaagaucguuggucuguaugggaauggaguggucaccacgucaggcacauacguguccgcuauugcccaggcgaaggccagucaggagggcccccuuccugagaucgaagacgagguuuuuagaaaaaggaaccugacuauuauggauuugcacccggggucuggaaagacccggcgauaucuaccagcaaucgugagagaagcuauaaaacgcaagcugaggacacucauuuuagcccccacccgugucguggcuagcgagauggcagaagcccugaaagguaugccuauccgguaccaaacuaccgccguaaaguccgagcauacaggcaaggagaucguggaccuuaugugccacgcuacguucacuaugagacugcucucaccaguuaggguccccaauuauaacaugauuaucauggaugaagcgcauuuuaccgacccuucuagcauagcagcccgcggguacauuaguacacgagugggaaugggcgaggcugccgcaaucuucaugaccgccacuccgcccgguuccguggaggcuuuuccacagagcaaugcggucauucaggaugaggaaagagacaucccugagcggucuuggaacucaggguaugaguggauaacagauuuccccggaaaaaccguaugguuugugccauccauuaagaguggcaaugacaucgccaacuguuugaggaaaaauggcaagcgcguuauccagcugagccguaaaacguucgauacugaauaccaaaagacaaagaacaacgacugggacuacguggucaccaccgauauuucggagaugggggcaaauuucagagcugaccgggugaucgauccuaggcgcugccucaaacccguuauucugaaggacggaccagaacgagugauacuugccgguccgaugccugucacuguggcaucugccgcucagagacggggcaggaucgggcgcaaccacaauaaagagggagaucaguauauuuacaugggccagccccuaaacaaugacgaggaucaugcccacuggacagaagcgaagaugcuguuggacaacaucaauaccccagaggguaucauucccgcauuauuugaaccugagagagaaaaauccgccgcuauagauggggaguauaggcugcggggcgaggcccguaagacauucguagaacucaugcgccgaggagaccugccaguguggcuuagcuacaagguugcuucagagggcuuucaauauagugauagaagguggugcuucgacggggaacggaacaaucagguccuggaggaaaacauggauguggagaucuggacuaaagagggagaacgcaagaaacucagacccaggugguuggacgcacggacguacucugacccucuggcccuacgagaguuuaaggaguucgcugccgguagacgcuccgugagcggcgaucugauucucgagaucgggaaacuuccgcagcaccugacccagagggcacaaaaugcguuagacaacuuggucaugcugcauaauucagaacagggaggccgggccuaucgucacgcuauugaggagcucccagauacaaucgaaacucugaugcuucuggcccucauagcaguuuugaccgguggggugacacuguuuuucuuaaguggcagaggacuaggcaagaccagcaucgggcugcucuguguaauggcuuccucugugcuucuguggauggccagcgucgagccccauuggauugcagccuccaucauuuuggaauuuuuccugauggugcuccugaucccugagcccgacaggcagcgcacuccacaggauaaccaacuugcuuacguugugauaggacuccuguuuaugauuuugacggucgcggccaaugagaugggucuguuagaaaccaccaaaaaggaccuaggcaucgggcacguagcaguggagaaccaccaucacgcugccaugcuggauguugaccuccauccugccucagcauggacucuuuacgcuguggccaccacaauuaucacccccaugaugcggcacacuauagaaaacacaacggcgaauaucucucugaccgcuauugccaaccaggcagccaucuugaugggacuggauaagggcuggccaauuaguaaaauggacaucggugucccucuccuggcucuugggugcuauagccaggugaauccguuaacucugacagcagccguccucauguugguggcgcauuacgcuauaauuggccccggacugcaagccaaggcaacccgagaggcccagaaaagaaccgcugccggcaucaugaagaacccaacaguugaugggaucguggcaauugaccuagauccuguaguguaugacgcuaaauucgaaaagcagcugggacagaucaugcuccuuauacuguguacuagccaaauuuugcugaugaggacgaccugggcccucugcgaguccaucacacuggcgacuggccccuuaaccacacuuugggaggguucuccagggaaguuuuggaauaccacuauugccgucucaauggcaaacaucuuccgcggaagcuaccuggcuggcgccggucucgcauucucccuaaugaaaagucugggcgggggacggagaggcacgggggcucagggagaaacauugggcgagaaguggaaacgucagcugaaucagcucucuaagagcgaauuuaacaccuauaaaaggucagguauaauggagguugaccgguccgaagccaaggaggggcuuaagcgcggagagacuaccaaacacgccgugagucgaggcacagcgaagcugagaugguucgucgaaaggaauuuggugaaaccugaggguaagguaaucgaucugggcugugggcggggaggcuggagcuacuauugcgcugggcucaaaaaggugacugaaguuaagggauacaccaaaggcggucccgggcacgaggaaccgauuccaauggcaacauacggauggaacuuagugaagcugcauucuggcaaagacgucuuuuucaucccucccgagaagugugauacgcuucugugcgacauuggcgaguccucaccaaaucccaccaucgaagaggggcgcacucuaagagugcucaaaauggucgaaccuuggcugaggggaaaccaauuuuguauuaagaucuugaauccguauaugcccagcgugguugagacacuggagcagaugcagcgaaaacacgguggcaugcucguacggaacccacuuucgcguaauucuacccaugaaauguacugggugaguugcgggacuggaaacauagucuccgccgugaauaugacaagcagaaugcuguuaaaccgcuucaccauggcucacaggaagccuacguaugagcgggauguugaccugggcgccgguaccagacacguggcagucgaacccgagguggccaacuuggauauuaucgggcagcgcaucgaaaauauuaagcaugagcacaaaucaacauggcauuacgacgaggauaacccuuauaagacuugggcuuaccacggauccuaugaaguaaaaccaucuggcagcgcgaguuccauggugaauggcguugucaagcuccugaccaaacccugggacgugauaccuauggugacacaaaucgccaugacugauaccacaccauuugggcagcagagggucuucaaggagaagguugacacccgaacucccaaagcaaagcggggaacggcucaaauuauggaagugacagccaaauggcuaugggguuuucuuagcagaaacaagaaaccgaggaucuguacccgcgaggaguucacucguaagguacggucuaaugcagccauuggcgcuguguuugucgacgagaaccaguggaacucagccaaggaggcgguggaagaugagagauucugggaccugguucauagggaacgcgagcuccacaaacaggggaagugcgcaaccugcguguacaacaugaugggaaaacgagaaaagaaacugggcgaguuugguaaggccaaggggagucgggcuaucugguacaugugguugggagccagauuccuggaguucgaagcacucggcuuuaugaaugaggaucacugguucuccagggaaaacagccuuucuggcgucgagggggagggacugcauaaauuagguuauauacugcgcgacaucucgaagauuccuggcgggaauauguacgcugaugacacagccggaugggauacgagaaucaccgaagacgauuugcagaacgaggcucggauuacugacaucauggaaccagagcacgcccuccuggcaaaaucaauauuuaagcuaacauaucaaaauaaagugguaaggguucagcgucccgcgaagaacggcaccgugauggaugucauuagccgacgcgaccagagagguuccggacaggugggaacuuacggccuuaauacauucaccaacauggaagcccaacugauccggcagauggagagugagggcaucuuuucuccuagcgaacucgagacaccaaaccuggcugaaaggguguuggauugguuagagaaauauggggucgaacgccugaagagaauggccauuuccggagacgacuguguugugaagcccauagaugaccgguucgcaacugcucucaccgcccuuaaugauauggguaaaguaaggaaggacaucccgcagugggagccuucaaaaggcuggaacgauuggcagcaagugcccuuuugcagucaucacuuccaccagcugauuaugaaggacgggcgagagaucgucgugccaugucguaaucaggaugagcuaguuggcagagcacgcgugucucagggcgccgguuggagccugcgggagacggcgugccucgggaaauccuacgcucaaauguggcaguugauguauuuucauaggagagaccugcgccuugccgcaaacgccauuuguucagcugucccuguggauuggauccccaccagccggacaacuuggucuauacacgcccaucaccaguggaugaccacagaagacaugcuguccguauggaauaggguuuggaucgaggaaaacccauggauggaggauaagacucauauuaguagcuggggagacgugcccuaccucggcaagcgagaggaccaauggugcggcucguuaaucgggcugaccgcaagagcuacgugggccacaaauauucaggucgcgaucaaccaggugcggagguugauuggaaaugaaaacuaccuggauuauaugaccuccaugaaacgcuucaagaaugagucugacccugaaggugcucucugguga

SEQ ID NO: 13652 - RNA, 9879 nt, Artificial Sequence
  derived and/or modified CDS sequence (opt3) from DENV-1__FJ906728__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagagcaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucauccuugauuguagcccaaggacuggacuggacuucaacgaaauggucuugcuaacaaugaaggagaaaucuuggcuggugcauaagcagugguuucucgaucugccgcuucccuggacguccggcgcaucaaccagccaagagacuuggaaucggcaggaccuguugguaacauucaaaaccgcucacgccaagaagcaggaaguugugguccucgguagucaagagggggcuaugcacacagcccugacuggcgcaaccgaaauucagacgucuggaaccacaacuauauuugccggccauuuaaaaugccgucugaagauggauaaacuaacccucaaggggauguccuaugugauguguacaggaccuuucaaacuggagaaggaagucgcugagacucagcacgguaccgugcuuguucagaucaaguacgagggcacggacgcgccaugcaaaauucccuucagcacacaagaugaaaagggggugacccagaacggacgcuugaucacugcaaauccuauaguaacagacaaagagaagccagucaacauugaagccgagcccccguuuggcgagucguauaucgugaucggugcuggggaaaaagcccugaagcucucuugguucaagaaaggcuccucaauuggaaagauguuugaggcaaccgccagaggcgcuaggcggauggccauccugggggauacugcaugggacuucggaaguauugguggcguuuuuaccagcguggggaaacuuguccaucagauauucggaacagcguacggcgugcuguuuuccgguguaucuuggacgaugaagaucgggauuggcguguugcucaccuggcugggauuaaauagccgaucaacuagucuguccaugacauguaucgcuguuggccuagucacccucuaccugggggugauggugcaggccgauagcggaugcgucaucaacuggaaaggccgcgaacuuaagugugguucugggauuuucguuacaaaugaggugcacacuuggaccgaacaauauaaguuucaggcagacucaccuaaaagauugagugccgcuauaggaaaggccugggaggagggcgugugcgguaucaggagcgcaacgcggcuggaaaacauuauguggaaacagaucuccaacgagcucaaucauauucuguuagaaaacgacaugaagcugacaguagucgugggcgauguugcugggauccuuggacagggcaaaaagaugauacgcccccaaccaauggaguacaaauauucuuggaagucgugggggaaggccaaaaucauuggagcggacgcccagaauaccacuuucaucauugauggcccuaacacccccgaauguccagacgaucagagagcuuggaauaucugggagguggaggacuacgguuuugggauauucacaacuaacauuugguugaagcucagggauagcuauacccaggucugcgaccaccgucugauguccgcagccaucaaagauucaaaggcugugcacgccgacaugggauacuggauugaaagugagaaaaaugaaacauggaagcuagcacgggcgucuuuuaucgagguuaagacguguauauggcccaaaagccauacccugugguccaacggcgugcucgaaucagagaugaucauuccuaagaucuaugguggcccaauuagccaacacaauuaccgaccgggguacuucacucagacagccggacccuggcaucugggcaaacuugaguuggauuucgaccugugcgaagggaccacuguagucguggaugagcacugcggaaacagaggcccuucuuuaaggacaaccacggugacugguaagaucauacacgaaugguguugccgcuccuguacccucccaccccugcgguuuagaggggaggacggaugcugguauggcauggagauuaggccugucaaagaaaaggaggaaaaucuuguuaagaguauggugagcgcugguucuggcgagguagacuccuucucacugggguugcucuguaucaguaucaugauugaagaggugaugcgcagccgauggucgcggaaaaugcugaugacaggaacccuagccgucuuuuuccugcucaucaugggccagcugacuuggaacgaucuuauucguuugugcauaauggugggggcaaaugcuuccgacagaaugggaaugggcacaaccuaccuggccuuaauggcaacauuuaagaugaggccaauguucgccguuggucuccugcuucgccggcugacuucuagagaggugcuacuccugaccaucggguugagccuggucgcuucaguggaauuacccaacagucucgaggaacugggagauggccuugcgaugggcauuaugauccugaaauugcucacggacuuucaaucccaucagcugugggccacacuacugucucuuaccuucauuaagacuaccuuuagccuccacuaugcauggaaaacaauggcuaugguucuguccaucgugucauuguucccgcuguguuuaagcacuaccagucagaagacgacauggcucccuguccugcuugggucucugggaugcaagccauugaccauguuucucauagccgagaauaaaaucugggguaggaaguccuggccccugaacgaaggcauuauggccguagggaucgugagcauucuacugucgucacuucucaaaaacgauguuccucuggcuggacccuugaucgcaggcgguauguuaauagccuguuacgugauuucugggaguuccgcggaccugagccucgagaaggcugccgaggucucuugggaagaggaagcagagcauagcggagccucccacaauauccugguggaaguacaggaugacggcacuaugaaaaucaaggaugaggagcgagacgauacacuuaccauucuguugaaagcuacucuacuggcagugucaggcgucuauccacucaguauaccugccacacuguucguuugguacuuuuggcaaaagaagaaacagcgcagcggggugcuuugggacacccccucuccaccggaaguggagcgggcggucuuagaugacggaaucuauagaauuaugcagaggggucugcucggccguucccagguggggguuggaguauuccaagaaaacguguuccauacgauguggcacgucacucgcggcgcuguguugauguaccaggguaagcggcuggagccuucaugggccaguguuaaaaaggaccucaucagcuacgggggaggcuggagacugaggggcuccuggaauaccggggaggaagugcaggucauugcaguggagcccggaaaaaacccaaagaauguacagacagcccccgguaccuuuaagacaccugaaggcgaggucggggcuaucgcccuugauuucaaaccaggaacuucuggcucgcccauagugaaccgagaagguaagaucguugggcuguauggaaauggcguggucaccacgagcggcacauacgugucagcaauugcucaagccaaagcgucccaggaggggccuuugccggagaucgaagacgagguuuuucggaagcgcaaccuaacuauuauggaucugcacccaggaagugguaaaaccagaagguaucuccccgccaucgugcgggaagcaauaaagcgaaaguuaagaacacugauucuugcuccuacccgcgucguggccucugagauggcugaagcacugaaaggcaugccaaucagguaccagacuaccgccguaaagagcgagcauacagggaaagagaucguggaccucaugugccacgccacguucacuaugcguuugcugucccccguucgggucccuaauuauaacaugauuaucauggaugaagcucauuuuaccgacccgucaucuauagcggcaagaggauacauuagcacaagggugggcaugggugaggccgcugccaucuucaugaccgcaacucccccagggaguguggaagccuuuccucaauccaaugcugucauucaggaugaggaacgcgacauccccgagcgaagcuggaacacaggauaugaguggauaaccgauuucccaggcaagacgguaugguuugugccuucuauuaaaucaggcaaugacaucgcgaacugucucagaaagaaugggaagcggguuauccagcuguccaggaaaacuuucgauacagaauaccagaagaccaaaaacaacgacugggacuacguggucaccacugauauuagugagaugggagccaauuuucgcgcagaccgugugaucgaucccagacggugccuuaagccaguuauucuaaaagacgguccggaaagggugauacuggcuggcccuaugcccgucacaguggccagcgcagcccaacgccgagggagaaucggacggaaccacaauaaggagggcgaucaguauauuuacaugggucagccauugaacaaugacgaggaucaugcucacuggaccgaagccaagauguuacuggacaacaucaauacacccgaggggaucauuccugcgcucuucgaaccagagagggaaaaaucggcagccguagauggcgaguaucgccugagaggagaggcuaggaagacuuucguggaacuuaugcggcguggcgaccugcccguuuggcucucuuacaaagucgccuccgagggguuucaguauagcgaucgccgauggugcuucgacggagaaagaaacaaucaaguguuggaggaaaacauggauguggagauauggacgaaggagggugaaaggaaaaagcugcggccucgcuggcuagacgcuagaaccuacucagacccgcuggcacucagggaguuuaaagaauucgccgcuggccggcgaagugucucuggggaucuuauccuggagauuggaaaguuaccacagcacuugacacagagagcccagaaugcacuggacaaccucguuaugcugcauaauuccgaacaaggcggucgcgcguauaggcacgccauggaggagcuucccgauacuaucgaaacccugaugcucuuggcucugauugccguguuaacagggggcguaacccuauuuuuccugagcggacggggccucgggaagacuucaaucggacuucugugugugauggcaaguagcgucuugcuguggauggcuuccguggagccucauuggauagccgcaucuaucauucucgaauuuuuccugaugguucuucucauccccgagccagaccgucagagaacgccucaggauaaccagcuggccuacguggucauugguuugcuguuuaugaucuuagcuguagcggccaaugagaugggccuacuggaaaccacaaaaaaggaccucgggauaggacacguggcaguugagaaccaccaucacgcugccaugcuugauguggaccugcaucccgccagcgcauggacuuuguacgcugucgccaccacaauuaucaccccaaugaugaggcacacuauugaaaacacaacggcgaauaucucccugaccgcuauagccaaccaagcagccauccucaugggccuggauaaagguuggccuauuucaaagauggacaucggggugccgcuuuuagcucugggcugcuauucucaggucaauccccucacuuugacagcagccgugcugaugcuaguugcgcauuacgcuauuaucggaccaggccugcaggccaaagcaacccgcgaggcccaaaagcggaccgcugccgggauaaugaagaacccuacaguggauggaauuguagcaaucgaccucgaucccguggucuaugacgcuaaauucgaaaagcagcuuggccagaucaugcuguugauucuguguacuagucagauccuccugaugcgaacgaccugggccuuaugcgagucgauaacacuugcgacugguccacugaccacacucugggaggggagcccuggaaaauuuuggaauaccacuauugccguuuccauggcaaacaucuucagaggcucuuaccuagcuggugccggccuggcauuuucauugaugaagagccuggggggaggcaggcgcgggacgggagcucaaggcgaaacacucggugagaaauggaagcggcagcuuaaucagcuguccaagagugaauucaacaccuauaaaagaucugggauuauggagguggaccguagcgaagccaaggagggauugaaaaggggcgagacuaccaagcacgccgucucacgggguacagcgaaacugcgcugguucguggaacgaaaucucguaaagcccgagggcaaggugaucgauuuaggguguggaagaggcgggugguccuacuauugcgcuggacugaaaaagguuacugaagugaaaggcuacaccaagggugggccgggacacgaggaaccaauaccuauggcaacauacggcuggaaccuugucaaacugcauaguggcaaggacguguuuuucauccccccagagaaaugugauacgcuacucugcgacauuggggagagcucucccaauccuaccaucgaagagggaaggacucugcgggucuugaagaugguggaaccguggcugcgcgguaaccaguuuuguauuaagauccucaaucccuauaugccauccguuguagagacacuugagcaaaugcagagaaaacacggcgggaugcuggugaggaacccuuuaucacgaaauagcacccaugaaauguacugggucucgugcggaacuggcaacauugugucugccguuaauaugacaagucggaugcuguugaaccguuucaccauggcucacagaaagcccacguaugagcgcgauguggaccucgguaccgggacaaggcacgucgccguggaaccugagguagcaaaccuggauaucauaggacagcggauugaaaauaucaaacaugagcacaaguccacuuggcauuacgacgaggauaacccauauaaaaccugggccuaccacggcagcuaugaagugaagcccucaggcuccgcuucuagcaugguuaauggggucgugaagcuacuuacaaaaccuugggacgugaucccaauggucacucagauugcgaugaccgauacaacccccuuuggacaacagagaguuuucaaggagaaaguggacacucgcacgccgaaggccaaaagggguacagcacagauaauggaaguaaccgcucgauggcuguggggcuuucucagucggaacaagaagccuagaaucuguacuagggaggaauucacccgcaaagugcguuccaaugccgcaauuggggccgucuuuguggacgagaaccaauggaauagcgcuaaggaggccguugaagaugagcgguucugggaccuggugcauagagaaagggaguugcacaaacagggaaagugcgcgacaugcgucuacaacaugaugggcaaacgcgaaaagaagcugggugaguuugggaaagcaaagggaucucgagccaucugguacauguggcucggcgcucgguuccuugaguuugaagcccugggcuucaugaaugaggaucacugguucucaagagaaaacaguuuauccgggguggagggagagggucugcauaaauugggcuauauucucagggacaucagcaagauaccagggggaaauauguacgcagaugacacggcuggcugggauacccgcaucacugaagacgaucugcagaacgaggccaaaauuacagacaucauggaacccgagcacgcucuacuugccaaggcaauuuuuaaacugaccuaucagaauaagguaguuagagugcaacggccugcgaagaacgguacugucauggaugugaucucuaggcgugaccagcgagggucgggacaggugggcacauacggccucaauaccuucacaaacauggaagcccagcugauacgccaaauggagucagaggggauuuuuagcccauccgaauuggagacucccaacuuagcugaaagagcccuggauuggcucgagaaauauggagucgaacggcuuaagaggauggcaaucaguggugacgacuguguugugaaaccgaucgaugaccgcuucgcuaccgcccugacggcacuaaaugauaugggcaagguaagaaaagacauuccucagugggagcccucuaagggguggaacgauuggcagcaggugccauuuugcagccaucacuuccaccaacugauaaugaaggacggacgggagaucgucgugccuuguaggaaucaggaugaacucguuggccgagcccgugugucccagggugcgggguggucauugagagagaccgcuugccugggaaaaaguuacgcccagauguggcaacuuauguauuuucaucgccgggaccugaggcucgcagccaacgcuauuuguucugccguccccguggauuggguaccaacaagcagaacuaccugguccauccacgcacaucaccaguggaugacaacugaagacauguuaucaguuuggaaucgcguguggauugaggaaaaccccuggauggaggauaagacccauaucagcucuugggaggacgucccuuaccugggcaaacgggaagaccaguggugcggcuccuugauagggcugacggcuagggccacaugggcgaccaauauccaaguggcuauuaaccagguucgaagacucaucggaaaugagaacuaccuugauuauaugacuaguaugaagcgguucaaaaaugaaagcgacccagagggugcccugugguga

SEQ ID NO: 13653 - RNA, 9879 nt, Artificial Sequence
  derived and/or modified CDS sequence (opt3) from DENV-1__FJ461313__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacauuaauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggucguucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggccauggugcaggcagauucuggaugcgugaucaacuggaaaggccgcgaacuuaagugugguucagggaucuucgucacuaaugagguucacaccuggacggaacaauauaaguuucaggccgacaguccgaaaagauugagcgcugccauuggaaaggcaugggaggagggcgugugcgguauaagguccgcuacacggcuggaaaacaucauguggaaacagauuucuaacgagcucaaucauauccuguuagaaaacgacaugaagcugaccgugguagucggcgauguggccgggauucuuggacagggcaaaaagaugauccgcccucaacccauggaguacaaauauucguggaaaagcugggggaaggcgaaaauaaucggagccgacgcucagaauacuaccuucauuaucgauggcccaaacacaccugaaugucccgacgaucagagagcauggaauauuugggagguugaggacuacgguuuugggaucuucacuaccaacauaugguugaagcucagggauuccuauacacaggugugcgaccaccgucugaugucagccgcuauuaaagauaguaaggccguccacgcagacaugggauacuggaucgaaucugagaaaaaugaaacguggaagcuagcgcgggccagcuuuauugaggugaagaccuguaucuggccaaaaucccauacucuguggucaaacggcguucucgaaagcgagaugauaauccccaagauuuaugguggcccuaucucucaacacaauuaccgaccaggguacuucacacagaccgcuggaccguggcaucugggcaaacuugaguuggauuucgaccugugcgaagggacuacagugguagucgaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgugaaagaaaaggaggaaaaucuugucaagagcaugguuucugccgguuccggcgagguggacucauucagucugggguugcucuguauuagcaucaugaucgaagagguaaugcgcucgcgauggucccggaaaaugcugaugaccggaacucuagcaguguuuuuccugcucauuaugggccagcugacauggaacgaucuuauccguuugugcauuauggucggggcuaaugccucugacagaaugggaaugggcaccacauaccuggcauuaauggccacuuuuaagaugaggccuauguucgcugugggucuccuguuucgccggcuuaccagcagagagguucugcuacucacgauagggcugucauugguggcgagugucgaacugccaaacuccuuagaggaacucggagauggccuggccaugggcaucaugauucuuaaacuguugacagacuuccaaucucaucagcucugggcaacccugcuaagccugacuuuuaucaagaccacauucucccuucacuaugcuuggaaaacuauggccauggugcucucaauuguuagccuguuucccuugugucugaguaccacgucucagaagacaaccugguuaccggugcuccuggggucccuuggaugcaagccucugacuauguucuugaucgccgagaauaaaauaugggguaggaaguccuggccacucaacgaaggcaucauggcugucgggauuguaucgauccugcuaucaucucugcuuaaaaacgaugugccccucgcaggaccucugauugccggcgguauguugaucgcguguuacguuauaaguggguccagcgcugacuuaucucuggagaaggccgcagaggugagcugggaagaggaagccgagcauuccggagcuucacacaauauucucgucgaagugcaggaugacggcacaaugaaaaucaaggaugaggagcgagacgauacccugacuauccuucugaaagcaacauugcuagccguaaguggcguguauccccugagcauuccagcgacccucuuugucugguacuucuggcaaaagaagaaacagcgcucugggguucugugggacacgccuucacccccagaaguggagcgggcugugcuugaugacggaauauauagaaucaugcagagggguuuacugggccguagccaggucggggugggaguuuuccaagaaaacguauuucauacuauguggcacgugacccgcggcgccguccucauguaccaggguaagcgguuggagccgaguugggcaagcgugaaaaaggaccugauuuccuacgggggaggcuggagacucaggggcucuuggaauacaggggaggaaguucaggugaucgccgucgagccuggcaaaaaccccaagaaugugcagaccgcuccagguacauucaagacucccgaaggcgagguaggggccauugcacuggauuuuaaaccuggaaccucgggcagcccaaucgucaaccgagaagguaagauaguggggcuuuauggaaauggcguugugacgacaucaggcacuuacgucuccgcuaucgcccaagcgaaagccagucaggaggggccccugccugagauugaagacgagguguuccggaagcgcaacuugaccaucauggaucuacacccgggaucugguaaaacaagaagguaucugccagcaauuguucgggaagcuaucaagcgaaagcucagaaccuuaauacuggcccccacucgcguggucgcuagcgagauggcagaagcccuuaaaggcaugccuauuagguaccagaccacagccgugaaguccgagcauacggggaaagagaucguagaccugaugugccacgcuacuuuuaccaugcgucucuugucaccagugcggguucccaauuauaacaugaucauuauggaugaagcgcauuucacagacccuucuagcaucgcagccagaggauacauaaguaccagggucggcaugggugaggcugccgcaauuuuuaugacugccacaccgcccggguccguggaggcuuucccacaaagcaaugcggugauccaggaugaggaacgcgacauuccugagcgaucuuggaacucaggauaugaguggaucaccgauuuucccggcaagacggucugguucguaccauccauaaaaaguggcaaugacauugccaacugucugagaaagaaugggaagcgggugauccagcucagcaggaaaacuuuugauacagaauaccagaagaccaaaaacaacgacugggacuacguugugaccacugauaucucggagaugggagcaaauuuccgcgcugaccgugucauugauccuagacggugccugaagcccgugauccuuaaagacgguccagaaaggguuauucuagccggcccgaugccugugacagucgcaucugccgcucaacgccgagggagaauaggacggaaccacaauaaggagggcgaucaguauaucuacaugggucagccccugaacaaugacgaggaucaugcccacuggaccgaagcgaagauguuguuagacaacauuaauacaccagaggggaucauccccgcacuguucgaaccugagagggaaaaauccgccgcuguggauggcgaguaucgccucagaggagaggccaggaagacuuuuguagaacugaugcggcguggcgaccuuccaguguggcugagcuacaaaguugcuucagagggguuccaguauagugaucgccgauggugcuuugacggagaaagaaacaaucaaguccucgaggaaaacauggauguggagauuuggacgaaggagggugaaaggaaaaaguugcggccccgcuggcuggacgcaagaaccuacucugacccucuagcccugagggaguucaaagaauuugcugccggccggcgauccgugagcggggaucucauacuugagaucggaaagcugccgcagcacuuaacacagagagcacagaaugcguuggacaaccuggucaugcuccauaauucagaacaaggcggucgcgccuauaggcacgcuauggaggagcugccagauacuauugaaacccuuaugcugcucgccuugaucgcaguucugacagggggcgugaccuuauucuuucuaaguggacggggccuggggaagacuagcauuggacuccuuuguguaauggcuuccucugugcuguuguggauggccagcgucgagccccauuggaucgcagccuccauaauccuggaguucuuucucauggugcugcuuauuccugagcccgaccgucagagaacgccacaggauaaccagcucgcuuacguugugaucggucuguuguucaugauucugaccgucgcggccaaugagaugggcuuacuagaaacaacuaaaaaggaccuggggaucggacacguagcaguggagaaccaccaucacgcugccaugcucgauguugaccuucauccugccucagcauggacccuguacgcuguggccacaaccauaauuacucccaugaugaggcacacaaucgaaaacacgaccgcgaauauuucuuugacugcuaucgccaaccaagcagccauacugaugggccucgauaaagguuggccaaucaguaagauggacauuggggucccucugcuugcuuuaggcugcuauagccaggugaauccgcugacacucaccgcagccgucuugaugcugguggcgcauuacgcuaucauuggacccggccuacaggccaaagcaacccgcgaggcccaaaagcggacagcugccgggaucaugaagaacccaacuguugauggaauaguggcaauugaccuggauccuguaguguaugacgcuaaauuugaaaagcagcucggccagaucaugcuucugaucuuguguacgagccagauucugcucaugcgaaccacaugggcccugugcgaguccaucacuuuagcgaccgguccccuuacaacccugugggaggggucuccaggaaaauucuggaauacuacgauagccgucucaauggcaaacauuuuuagaggcagcuaccucgcuggugccggccuagcauucucccugaugaagagucuagggggaggcaggcgcucuacaggggcucaaggagaaacccugggcgagaaauggaagcggcagcucaaucagcuuagcaagucagaguucaacacuuauaaaagauccgguaucauggagguugaccguagugaagccaaggaggggcugaaaaggggagagaccacaaagcacgccgugagccggggcacugcgaaauugcgcugguuugucgaacgaaaucuggugaagccugaggguaagguaauugaucucggcugugggagaggaggcuggucuuacuauugcgcugggcuaaagaaggugaccgaaguuaaaggauacacaaagggcggucccgggcacgaggaaccgaucccaauggcaacguacggauggaaccuggugaaacuucauuccggcaaggacgucuucuuuauaccucccgagaaaugugauacccugcuaugcgacaucggcgagucaagcccaaaucccacuauugaagaggggaggacacuccgggugcugaagauggucgaaccuugguugcgcggaaaccaguucuguaucaagauucugaauccguauaugcccucggugguugagacccucgagcaaaugcagagaaaacacgguggcaugcuuguaaggaacccacugucucgaaauaguacucaugaaauguacuggguguccugcgggacaggaaacaucgucagcgccgugaauaugaccucacggauguuacugaaccguuuuacgauggcucacagaaagccuaccuaugagcgcgauguugacuugggcacagguacuaggcacguggccgucgaacccgagguggcaaaccucgauauuaucgggcagcggauagaaaauauuaaacaugagcacaaguccaccuggcauuacgacgaggauaacccuuauaaaacaugggccuaccacggaucuuaugaaguaaagccaagcggcagugcuuccagcauggugaauggcguugucaagcugcuaacuaaacccugggacgugaucccuauggugacccagaucgcgaugacagauaccacuccauucgggcaacagagagucuuuaaggagaaaguugacacgcgcacacccaaggccaaaaggggaaccgcacagauuauggaagugacugcucgauggcuuugggguuuccugucucggaacaagaagccgagaauauguaccagggaggaauuuacacgcaaaguacguucaaaugccgcaaucggcgccguguucgucgacgagaaccaauggaauagugcuaaggaggccguggaagaugagcgguuuugggaccucguucauagagaaagggagcugcacaaacaggggaagugcgcgacgugcguguacaacaugaugggaaaacgcgaaaagaaguugggcgaguucgguaaagcaaaggggucccgagccauuugguacauguggcugggagcucgguuucucgaguucgaagcccuuggcuucaugaaugaggaucacugguuuagcagagaaaacucucugucgggcgucgagggggagggauuacauaaacuggguuauaucuugagggacauuucaaagaucccuggcgggaauauguacgcagaugacaccgcuggaugggauacucgcauaacagaagacgaucuccagaacgaggccaaaaucaccgacauuauggaaccagagcacgcucugcuagccaaggcaaucuucaaacuuacuuaucagaauaaggugguaagaguucaacggcccgcgaagaacggcacagugauggaugucauuagcaggcgugaccagcgagguuccggacaggugggaaccuacggccugaauacauuuacuaacauggaagcccagcucauccgccaaauggagagugagggcauauucucuccuagcgaacuggagaccccaaacuuggcugaaagagccuuaaauuggcuggagaaauaugggguggaacggcucaagaggauggcaauuuccggagaugacugugucguuaaacccaucgacgaucgcuuugcuacggcccuuaccgcacugaacgacauggguaaggugagaaaagauaucccgcagugggagccuucaaagggcuggaaugacuggcagcagguacccuucugcagucaucacuuucaccaacuaauuaugaaggaugggcgggagauaguggucccauguaggaaccaggacgaacuggugggacgagcccguguuucucagggcgcggguuggagccucagagagacagcuugcuuggggaaauccuacgcccagauguggcaacugauguauuuccaucgccgggaucuuaggcuggcagccaaugcuaucuguucagccgugccugucgacugggugcccacuagcagaaccacauggucuauucacgcacaucaccaguggaugacuaccgaagauaugcucuccguauggaaccgcguuuggaucgaggaaaauccauggauggaggacaagacgcauauuaguagcugggaggaugugcccuacuuaggaaaacgggaagaccaguggugcggcucgcugaucggcuugacagcuagggccaccugggcgacuaacauacaagucgcuaucaaucaggugcgaagacugauugggaacgagaauuaccucgacuauaugacauccaugaagcgguuuaaaaacgaaucugauccugagggagcccuuugguga

SEQ ID NO: 13654 - RNA, 9879 nt, Artificial Sequence
  derived and/or modified CDS sequence (opt3) from DENV-1__FJ547063__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggaguacaaauauucguggaaaagcuggggcaaggccaagauaaucggggcggacguucagaauaccacauuuauuaucgauggaccaaacacuccugaaugucccgacgaucagagagccuggaauauuugggagguggaggacuacggcuucgguaucuuuaccacaaacauaugguugaagcucagggauuccuauacgcaggucugcgaccaccgucugaugucagcugcaauuaaagauaguaaggccgugcacgcugacaugggguacuggaucgaaucugagaaaaaugaaaccuggaagcuagcccgggcauccuucauugagguuaagacuuguaucuggccaaaaucccauacacuguggucaaacggagugcucgaaagcgagaugauaauccccaagauuuauggcgguccuaucucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauuaugggacagcugaccuggaacgaucuuauccguuugugcauuauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaauaggucugucauuggucgccaguguggaacugccaaacuccuuagaggaacucggggauggacuggcuaugggcaucaugauucuuaaacuguugaccgacuuucaaucucaucagcucugggcgacucugcuaagccugaccuucaucaagacaacuuuuucccuucacuaugccuggaaaaccauggcaaugauucucucaaucguuagccuguuccccuugugucugaguacgacaucucagaagaccacuugguuaccggugcuccugggcucccuugggugcaagccucugacaauguuuuugauagcugagaauaaaaucuggggaaggcgaagcuggccacucaacgaagguauuauggccgucggcaucguaucgauucugcuaucaucucugcuuaagaacgaugugccccucgccgggccucugaucgcuggaggcauguugauagcauguuacguuauuagugguuccagcgccgacuuaucucuggagaaagcggcugaggugagcugggaagaggaagccgagcauuccggggcaucacacaauauccucgucgaagugcaggaugacggaaccaugaagaucaaagaugaggagcgcgacgauacucugacaauucuucugaaggccaccuugcuagcuguaaguggcguguauccccugagcauaccagcaacacucuucgucugguacuucuggcagaagaagaagcagcggucuggcguucugugggacacuccuucacccccagaaguggagagagccgugcuugaugacgggaucuauaggauuaugcagcguggauuacugggucgcagccaggucggcguggggguuuuucaagaaaacguauuccauaccauguggcacgugacacggggagcgguccucauguaccagggcaaaagauuggagccgaguugggcuagcgugaagaaagaccugaucuccuacggugggggauggaggcuccagggcucuuggaauaccggcgaggaaguucaggugauugccgucgagccugggaagaaccccaaaaaugugcaaacagcaccaggaacuuuuaagacccccgaaggugagguaggcgccaucgcucuggauuucaagccugggacgucgggaagcccaauagucaaccgagaaggcaaaaucgugggucuuuaugggaauggaguugugacaacuucaggcaccuacgucuccgccauugcacaggcuaaggccagucaggagggcccccugccugagaucgaagacgagguguuucggaaacgcaacuugacaauuauggaucuacacccggggucuggaaagaccagaagguaucugccagcgaucguucgggaagccauaaaacgaaagcucagaacuuuaauucuggcacccacccgcguggucgcuagcgagauggccgaagcucuuaaggguaugccuaucagguaccaaacaacggcagugaaauccgagcauacuggcaaggagaucguagaccugaugugccacgccaccuucacaaugcgucucuugucaccagugcggguucccaauuauaacaugauuaucauggaugaagcccauuuuaccgacccuucuagcauagcugcgagaggguacauuaguacuagggucggaaugggcgaggcagccgcuaucuucaugacagccaccccgcccgguuccguggaagcauuuccacagagcaaugccgugauucaggaugaggaacgcgacaucccugagcgaucuuggaacucaggguaugaguggauaacggauuuccccggaaaaacugucugguuuguaccauccauuaagaguggcaaugacaucgcuaacugucugaggaaaaauggcaagcgggugauccagcucagcaggaagacauucgauaccgaauaccagaaaaccaagaacaacgacugggacuacguugugacuacagauauuucggagaugggggcgaauuuccgcgccgaccgugucaucgauccuagacggugccugaaacccgugauucuuaaggacggaccagaaaggguuauacuagcagguccgaugccugugaccgucgcuucugccgcacagcgccgaggcagaaucgggcggaaccacaauaaagagggagaucaguauauuuacaugggccagccccugaacaaugacgaggaucaugcccacuggacagaagcuaagauguuguuagacaacaucaauacuccagaggguaucauucccgcccuguuugaaccugagagggaaaaguccgcggcaauagauggggaguaucgccucagaggcgaggccaggaaaacguucguggaacugaugcggcguggagaccuuccaguauggcugagcuacaagguggcuucagagggcuuucaauauagugaucgccgauggugcuucgacggggaaagaaacaaucagguucucgaggaaaacauggaugucgagaucuggaccaaagagggagaaaggaagaaauugcggccccgcuggcuggacgccagaacauacucugacccucuagcucugagggaguuuaaggaguucgcagccggucggcgauccgugagcggcgaucucauucuugagaucgggaaacugccgcagcacuuaacucagagagcucaaaaugccuuggacaaccuggugaugcuccauaauucagaacagggaggccgcgcauauaggcacgcgauggaggagcugccagauaccauugaaacacuuaugcugcucgccuugaucgcuguccugaccggugggguuacuuuauuuuuccuaaguggccggggacugggcaagacgagcauagggcuccuuugugugauggccuccucuguacuguuguggauggcaagcguggagccccauuggaucgcugccuccauuauccuggaauuuuuccucaugguccugcuuauuccugagcccgaccgucagagaaccccacaggauaaccaacucgcauacgugguuaucggacuguuguuuaugauacugacaguggccgcuaaugagauggguuuacuagaaacuaccaagaaagaccugggcauugggcacgucgcgguagagaaccaccaucacgccgcaaugcucgauguggaccuucauccugcuucagccuggacacuguacgccguugcaaccacuaucauuacacccaugaugaggcacacgaucgaaaacaccacugcuaauauaucuuugacagccaucgcgaaccaggcugccauucugaugggacucgauaagggcuggccaaucaguaaaauggacauuggugugccucugcuugcauuagggugcuauucgcaggucaauccgcugacccucaccgccgcuguguugaugcuggucgcacauuacgccaucauaggccccggacuacaagcgaaggcuacacgcgaggcccagaaacggacugcagccggcauuaugaagaacccaacgguggaugggaucguugcuaucgaccuggauccugugguauaugacgccaaguucgaaaaacagcucggacagauuaugcuucugaucuuguguaccagccaaauacugcucaugcgaacaacuugggcacugugcgaguccauuaccuuagcuacaggcccccuuaccacucugugggaggguucuccagggaaguuuuggaauacgacaaucgccgugucaauggcgaacauuuucagaggaagcuaccucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuauaagagaucagguaucauggaggucgaccguuccgaagcaaaagaggggcugaagaggggagagacaacuaaacacgcuguuagucggggcaccgccaaguugcgcugguucguggaacgaaaucuggucaaaccugaggguaaggugauagaucucggcugugggagaggaggcuggagcuacuauugcgccggguuaaagaaaguaacagaagugaagggauacacgaaaggcggucccgggcacgaggaaccgaucccaauggcgaccuacggauggaaccugguuaaacuucauucuggcaaagacguguuuuucauuccucccgagaagugugauacucugcuaugcgacaucggcgaguccucaccaaaucccacaauugaagaggggaggacccuccggguccugaaaaugguggaaccuugguugcgcggaaaccaauuuuguaucaagauucugaauccguauaugcccagcgucguggagacucucgagcagaugcagagaaagcacgguggcaugcuuguuaggaacccacugcagcgaaauucgacacaugaaauguacuggguaucuugcgggaccggaaacaucgugagugcugucaauaugacgucccggauguuacugaaccguuucaccauggcacacagaaaaccuacauaugagcgcgauguggacuugggcgccgguacuaggcacguugcuguggaacccgaggucgccaaccucgauauaauugggcaacggaucgaaaauaucaagcaugagcacaaaagcaccuggcauuacgacgaggauaacccuuauaagacaugggcauaccacggaucauaugaagugaaaccauccggcucugccagcaguaugguaaauggcgugguuaagcugcuaacuaagcccugggacgucauuccuauggugacccagauagcuaugacagauaccacuccauuugggcagcaaagaguguucaaagagaaggucgacacgcgcacacccaaagcgaagaggggaaccgcccagaucauggaaguuacugcaaaauggcuuugggguuuucugucccgaaacaagaagccgcggauuuguaccagagaggaguucacaaggaaagugcgcagcaaugcugccaucggcgcaguauuuguggacgagaaccaguggaacucugccaaggaggcugucgaagaugagcguuucugggaccucgugcaucgggaaagagagcugcacaaacaggggaagugcgccacgugcguuuacaacaugaugggaaaaagggaaaagaaguugggcgaguuugguaaagcgaaggggucacgcgcaauuugguacauguggcugggagcccgauuccucgaguucgaagcucuuggcuuuaugaaugaggaucacugguucagucgggaaaacucccugagcggcguggagggggagggauuacauaaacuggguuauaucuugagagacauaucuaagaucccuggcgggaauauguacgccgaugacaccgcaggaugggauacuaggauuacagaagacgaucuccaaaacgaggcucgcaucaccgacauuauggaaccagagcacgcccugcuagcuaaaucgaucuuuaaacuuacuuaucagaauaaagucgugagaguacagcggcccgccaagaacggcacaguuauggaugugauaucaaggcgugaccagcgagguagcgggcaagucggaaccuacggccugaauacauucacuaacauggaagcacagcucauucgccagauggaguccgagggcaucuuuaguccuucugaacuggagaccccaaacuuggcggaaagaguguuagauuggcuggagaaguaugggguggaacggcucaaaaggauggccaucagcggagacgacugugucguuaagcccauugaugaccgcuucgcuacggcccuuaccgcacugaaugauauggguaaagugagaaaggacauaccgcagugggagccuuccaaaggcuggaacgauuggcaacagguacccuuuugcucacaucacuuccaccagcuaaucaugaaggacgggcgggagauuguggucccauguaggaaucaggaugaacuggugggacgagcucguguuagucaaggcgccgguuggucucucagagagacagcaugcuugggaaagagcuacgcccagauguggcagcugauguauuuucaucgccgggaccuuaggcuggcggcuaacgccaucuguuccgcagugccugucgauuggauucccacuucaagaaccacauggagcauccacgcccaucaccaauggaugacuaccgaagacaugcucucuguguggaaucgcguauggauagaggaaaacccauggauggaggauaaaacgcauaucuccaguuggggagacguucccuacuuaggcaagcgggaggaccaguggugcggcagccugauuggguugacagcuagggccaccugggcaacuaauauccagguggcuauuaaccagguccgaagacugaucggaaaugaaaacuaccucgauuauaugacaucgaugaaacgguucaagaaugaguccgacccugaaggugcccuuugguga

SEQ ID NO: 13655 - RNA, 9879 nt, Artificial Sequence
  derived and/or modified CDS sequence (opt3) from DENV-1__FJ410218__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaaaaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggcauccuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggcuccggugagguggacucauuuagucuuggccuguuguguauuagcaucaugaucgaagaggucaugaggucgcgcuggucccgaaagaugcucaugaccgggacucuggcuguguuccuacugcucauuaugggacagcugacauggaacgaucuuauccgguugugcauuaugguuggcgccaaugcaucugaccguauggggaugggaaccacauaucuggcuuuaauggccacuuuuaaaaugagaccuauguucgcagugggccuccuguuuaggcgccuuaccagccgggagguccugcuacucacgauaggucugucauugguggccaguguugaacugccaaacuccuuagaggaacucggggauggacuggcuaugggcaucaugauucuuaagcuguugacagacuuccaaucucaccagcucugggcgacccugcuaagccugacuuuuaucaaaaccacacuuucccuccauuacgccuggaagacuauggcaauggugcugucaauugucagcuuguucccccuguguuuaaguaccacgucucagaagacaaccuggcucccgguacugcuuggcucccuggggugcaaaccuuugacuauguuucucaucguggagaauaagauauggggaagaaaaagcuggccacugaacgaagguaucauggcuguuggcguggucucgauucuacugucaucucuucucaagaacgaugugccccuggccgggccuuugaucgccggaggcauguuaauugcuuguuauguaaucagugguuccagcgcagaccugucucucgagaaagccgcggaggugagcugggaagaggaagcugagcacuccggggccucacauaauauacuggucgaaguucaggaugacggaacaaugaagauuaaagaugaggagagggacgauacccuuacuauccuguugaaggcaacacuacuggccgugaguggcguguacccccucagcaucccagcuacccuguucgucugguauuuuuggcaaaagaaaaagcagcgaucuggcgugcuuugggacacgccuucacccccagaaguugagcgcgcaguauuagaugacgggauuuaccggauaaugcagagaggacugcucgguaggagccaggugggcgucgggguguuccaagaaaacguuuuccacacuauguggcacgugacccguggagccgucuugauguaucagggcaaacgccuggagccgaguugggcgagcgugaagaaagaccucaucuccuacggugggggauggcggcugcagggcucuuggaauacaggcgaggaaguacaggucauugcuguggagccugggaagaaccccaagaauguucaaaccgccccaggaacauuuaaaacucccgaaggugaggugggcgcaaucgcccuugauuucaagccugggaccucgggaagcccaauugucaacagagaaggcaaaaucgugggucuguacgggaauggaguugugacgacaucaggcacuuaugucuccgcuauagcccaggcaaaggcuagucaggagggccccuugccugagaucgaagacgagguguuuaggaaacgaaaccuaaccauuauggaucugcauccggggucuggaaagacacggcgcuaccucccagccaucguaagagaagcgauuaagaggaaauuacggacccugauccuugcccccacucgagugguugcaagcgagauggcugaagcccugaaggguaugccuauaagauaucaaaccacagcugucaaauccgagcacacgggcaaggagauuguggaccucaugugccaugcaacuuucaccaugcgcuugcugucaccagugaggguccccaauuacaacaugaucaucauggaugaagcccacuuuacagacccuucuagcauugccgcucguggguauaucaguacccggguaggaaugggcgaggcggcagccauauucaugacugcuacaccgcccgguuccguggaagccuuuccacagagcaaugcaguuauucaggaugaggaaagagacaucccugagaggucuuggaacucaggguacgaguggauuaccgauuuccccggaaaaacggugugguuugucccauccaucaagaguggcaaugacauagccaacugucuccgcaagaauggcaaacgagugauucagcugagcagaaagacuuucgauacagaauaucagaaaaccaagaacaacgacugggacuacguugugaccacugauaucucggagaugggggcuaauuuucgggcggacagggucaucgauccucgccguugccuuaaacccgugauucuaaaggacggaccagaaagaguaauccuggccgguccgaugccugugacaguugcaucugcugcccagcggaggggccgcauugggcgaaaccauaauaaggagggagaucaguacauauauaugggccagcccuugaacaaugacgaggaucacgcacacuggaccgaagccaaaauguuacuggacaacaucaauacaccagaggguauuauccccgcucucuucgaaccugagagagaaaaguccgccgcgaucgauggggaguaccggcugaggggcgaggcacgcaaaacuuucgucgaacuuaugagaaggggagaccugccaguguggcucagcuauaagguggccucagagggcuuucaauacagugaucggcguuggugcuucgacggggaacgcaacaaucaggucuuggaggaaaacauggauguugagauuuggacgaaagagggagaacgaaagaaacugagacccagguggcuagacgcucggaccuauucugacccucuggcccuccgcgaguuuaaggaguucgcugcagguagaagguccgugagcggcgaucuuauacuggagaucgggaaguuaccgcagcauuugacacagcgggcccaaaaugcucuggacaaccucguaaugcugcacaauucagaacagggaggccgagccuacagacaugcaauggaggagcuuccagauacuauugaaacccugaugcucuuggcgcugaucgccguguuaacagguggggucacccuauuuuuccugaguggccgcggacucggcaaaacuagcauugggcuucugugugugauggcuuccucuguuuugcuguggauggccagcguggagccccacuggaucgcagcuuccauaauccucgaauuuuuccugaugguccuucucauuccugagcccgacaggcagcggacgccacaggauaaccaacuggccuauguagugaucggauugcuguuuaugauuuuaaccguugcagccaaugagaugggucuacuggaaacaacuaagaaagaccucggcaucgggcacguggcugucgagaaccaucaccaugcgaccaugcuugauguggaccugcacccugccucagcauggacauuguacgcugucgccaccacuauaauuacacccaugaugcgucauacgaucgaaaacaccacugccaauauuucucugacagcaaucgcuaaccaggccgcgauacucaugggacuggauaagggcuggccaaucaguaaaauggacauuggugugccucuuuuagcucuggggugcuacucgcagguuaauccgcucaccuugaccgccgcagugcugaugcuaguagcccacuaugcuaucauuggccccggacugcaagcaaaggccacaagagaggcgcagaagaggacugcugccggcaucaugaaaaacccaacgguggaugggauagucgcaauugaccucgauccuguuguguacgacgccaaguucgaaaaacagcuuggacagaucaugcuguugauccuguguaccagccaaauucuccugaugcgcacaacuugggcuuuaugcgaguccaucacccuugccacaggcccccugaccacucucugggaggguucuccagggaaguuuuggaauacgacaauagcagucucaauggcuaacauuuuccggggaagcuaucuagccggcgcgggucuggccuuuuccuugaugaaaagucugggcgggggacgaagaggcaccggggcacagggagaaacucucggcgagaaguggaagaggcagcuuaaucagcugucuaaaagcgaguucaacaucuacaagcgcucagguauuauggagguggaccgguccgaagcuaaagagggguugaagagaggagagaccacacgucacgccguaaguaggggcacugcaaaacugcggugguucguggaacgcaaucucguuaagccugaggguaaggugaucgauuuaggcugugggcgaggaggcuggagcuauuacugcgcugggcugaaaaaggucaccgaagugaaaggauauacaaagggcggucccgggcaugaggaaccgauaccaauggccacguacggauggaaccuugucaaacugcacucuggcaaggacguguuuuucaccccucccgagaaaugugauacucuacucugcgacaucggcgaguccucaccaaaucccacaauugaagaggggagaacccugaggguuuugaagaugguagaaccuuggcugcggggaaaccaauuuuguaucaagauucucaauccguacaugcccagcguggucgagacucuugagcagaugcagcgcaaacaugguggcaugcuggugagaaacccauuaucgagaaauucuacacacgaaauguauuggguuaguugcgggaccggaaacaucguguccgccgucaauaugacgagccgaaugcuguugaaccgguucaccauggcgcaccguaagccuacauacgagagagauguggaccucggcgcugguacucgccauguagcaguggaacccgagguugccaaccuggauauuaucgggcagaggauagaaaauauuaaacacgagcauaagucaaccuggcacuaugacgaggauaacccuuacaaaacaugggcuuaucauggauccuacgaagucaagccaucuggcagcgccaguuccauggugaauggcguggucaagcuacuuacuaaacccugggacguuaucccuauggugacccaaaucgcaaugacagauaccacuccauuugggcagcagcggguauucaaggagaaaguggacacgagaacacccaaggccaaacgcggaaccgcucaaauuauggaagucacugcgagguggcugugggguuuucucagccgaaacaagaagccgcggauauguaccagagaggaguucacaaggaaagugcgcucuaaugccgcaaucggcgcuguuuuuguggacgagaaccaguggaacucagccaaggaggcagucgaagaugagcguuucugggaccuggugcagaaagaacgggaguugcacaagcaggggaaaugcgccacgugcguauauaacaugaugggaaagagagaaaagaaacugggcgaguuugguaaggcuaaagggaguagggccauuugguacauguggcucggagcgcgcuuccuugaguuugaagcacugggcuucaugaaugaggaucacugguucucccgagaaaacagcuuaucuggcguugagggggagggacugcauaaguuggguuacauccuccgggacauuucgaaaaucccuggcgggaauauguaugccgaugacaccgcuggaugggauacuagaauaacagaagacgaucugcaaaacgaggccaagaucaccgacauuauggaaccagagcacgcacuacuugcuacuucaaucuuuaaacugacauaccagaauaagguggucagggugcagcgccccgccaagaacggcaccgugauggaugucauuagcagacgggaccagagggguuccgggcaaguuggaacauauggccucaauacuuucaccaacauggaagcucagcugauccgucagauggagagugagggcauauuuucuccuagcgaauuggagauuccaaacuuagccgaacgagugcuggauuggcucgagaaauacgggguagaacgccuuaagagaauggcaaucuccggagacgacuguguggucaaacccaucgaugaccgguucgcgacggcccugaccgcucuaaaugauauggguaaggugaggaaagacguuccgcagugggagccuucaaagggcuggaacgauuggcaacaggugcccuuuugcagucaucacuuccaccagcugauuaugaaggacgggcgcgagauagucgugccauguagaaaucaggaugaacucguaggacgggccaggguuucucaaggcgcagguuggagcuugcgagagacagcuugccuggggaaauccuaugcccagauguggcagcuuauguacuuucaucguagagaccugcgccucgcagccaacgcgaucuguucagcugugccugucgauugggugcccacuagccggaccacauggucuauucacgcccaucaccaauggaugacuaccgaagacauguuauccguuuggaauaggguguggaucgaggaaaacccauggauggaggauaagacgcaugucaguagcuggggagacgugcccuaucugggcaaaagagaggaccaguggugcggcucguugauugggcugacagcacgcgccaccugggcuuccaauauccagguagccauaaaccaggugcggaggcucaucggaaaugaaaacuaccuugauuacaugacuucuaugaagcgauucaaaaaugagggugacccugaaggcgcacugugguga

SEQ ID NO: 13656 - RNA, 9879 nt, Artificial Sequence
  derived and/or modified CDS sequence (opt3) from DENV-1__FJ461316__SS-prME
agcgugaccaugcugcucaugcuuaugcccacagcccuggcuuuccacuugacuacgagaggaggggagccucauauggucguuuccaagcaagaaagaggaaaaucuuuacuguuuaagaccucagcgggugugaauaugugcacacugaucgccauggaccucggcgagcugugugaagauacuaugaccuacaaaugcccacggauuacagaggcggaaccggacgauguagacuguuggugcaaugcuaccgauacuugggugacauaugggaccuguagucaaacgggagagcaccgccgagacaagcguagcgucgcccuugcaccccaugugggccuggguuuggagacuagaaccgaaacauggauguccucugagggggccuggaaacagauacagaggguugaaacuugggcucuccggcacccuggauucaccgugaucgcacuguuucuggcccaugcuauuggcacaucgaucacccagaagggcauuaucuucauacucuuaaugcuggucacgccaucaauggccaugcgcugcguggggaucggaagcagagauuuuguagagggucuuaguggcgcgacuuggguugacguggucuuggagcacggguccugugugacaaccauggcaaaggauaaacccacucuggacauugaacugcucaagacagaggugaccaacccugccauccugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauaggguugggcgugcuccugacuugguuaggacuaaauucacgaaguacaucccuaagcaugaccuguaucgcuguuggccucgucacacuguaccuuggggugauggugcaggccgauucuggaugcgucauuaacuggaaaggccgcgaauugaagugugguucagggaucuucguuacuaaugaggugcacaccuggacggaacaauauaaguuucaggcagacaguccgaaaagacugagcgccgcuaucggaaaggccugggaggagggcgugugcgguauuagguccgcaacacggcucgaaaacguaauguggaaacagauaucuaacgagcugaaucauaucuuacuggaaaacgacaugaaguucaccgucgugguuggcgauguggcugggauucuugcccagggcaaaaagaugauccgcccucaacccauggaguacaaauauucguggaaaagcuggggcaaggcgaagauuaugggggccgacguccagaauacuaccuuuaucauagauggaccaaacacaccugaaugucccgacgaucagagagcuuggaauaucugggagguggaggacuacggcuucgguauuuuuacuaccaacaucugguugaagcucagggauuccuauacacagguuugcgaccaccgucugaugucagcagccauuaaagauaguaaggcugugcacgccgacaugggguacuggaucgaaucugagaaaaaugaaacguggaagcuagcacgggcgagcuucauagagguaaagaccuguauuuggccaaaaucccauacucuguggucaaacggaguccucgaaagcgagaugaucauucccaagaucuauggcgguccuauaucucaacacaauuaccgaccaggcuacuucacacagaccgccgggccguggcaucugggaaaacuugaguuggauuuugaccugugcgaaggcacuacagugguggucgaugagcacugcgggaacagaggacccuccuuaaggaccacgacuguuaccggcaagaucauucacgaaugguguugccgcaguuguacacucccuccacugcgguucagaggugaggacgggugcugguauggaauggagaucaggcccgugaaagaaaaggaggaaaaucuuguaaagagcauggugucugcuggcuccggugaggucgacucauuuagucugggcuugcucuguauuagcaucaugauagaagaggugaugcgcucgcgauggucccggaaaaugcugaugaccgggacucuagccguuuuccugcuccugauuaugggacagcuuacauggaacgauuugauccgucugugcaucauggugggcgcaaaugcuucugacagaauggggaugggaaccacauacuuagcccucauggcaacuuuuaagaugaggccuauguucgccgucggccugcuuuuucgccggcugaccagcagagaggugcuacuccugacgauugguuugucacugguugcuaguguggaauuaccaaacucccucgaggaacugggggauggacuugcgaugggcaucaugauucugaaauugcucacagacuuccaaucucaucagcugugggccacccuacugagccuuacuuuuauaaagaccacauucucccuccacuaugcauggaaaacuauggcuaugguccugucaaucguauccuuguuuccccuguguuuaaguaccacgucucagaagacaaccuggcucccggugcugcuuggcucccuggggugcaagccuuugacuauguuccucauugccgagaauaaaaucuggggaaggcgaagcuggccacugaacgaagguauuauggccguuggcaucgugucgauacuacugucaucucuucucaagaacgaugucccccuggcugggccuuugaucgcaggaggcauguuaauugccuguuacgugaucagugguuccagcgcggaccugucucucgagaaagcugccgagguaagcugggaagaggaagcagagcauuccggggccucacacaauauucugguggaaguccaggaugacggaacaaugaagaucaaagaugaggagcgcgacgauacccuuacuauacuguugaaggcuacacuacuggcaguuaguggcguguauccccucagcauuccagccacccuguuugugugguacuucuggcagaaaaagaagcagcggucuggcguccuuugggacacgccuucacccccagaaguggagagagcgguuuuagaugacgggaucuauaggaucaugcagcguggacugcucggucgcagccagguaggcgugggggucuuccaagaaaacguguuucauacuauguggcacguuacccggggagcuguguugauguaccagggcaaaagacuggagccgaguugggccagcgucaagaaagaccucauuuccuacggugggggauggaggcugcagggcucuuggaauacaggcgaggaagugcagguaauagcagucgagccugggaagaaccccaaaaaugugcaaaccgccccaggaacauucaagacucccgaaggugagguuggcgcuaucgcccuugauuuuaagccugggaccucgggaagcccaauugugaaccgagaaggcaaaaucgucggucuguaugggaauggagugguuacgacaucaggcacuuacguguccgcaauugcucaggccaaggcgagucaggagggccccuugccugagaucgaagacgaggucuuccggaaacgcaaccuaaccauaauggaucugcacccggggucuggaaagacaagaagguaucucccagccaucgugcgggaagcaauuaaacgaaaguuaagaacccugauccuugcucccacucgcguaguggccagcgagauggcugaagcacugaaggguaugccuauuagguaccaaaccacagccguuaaauccgagcauacgggcaaggagaucgucgaccucaugugccacgccacuuuuaccaugcguuugcugucaccagugcgggugcccaauuauaacaugauaauuauggaugaagcucauuucacagacccuucuagcaucgcggcaagaggguacaucaguaccagggucggaaugggcgaggccgcugccauuuuuaugacugcaacaccgcccgguuccguagaagccuucccacagagcaaugcugugauccaggaugaggaacgcgacauaccugagcgaucuuggaacucaggguaugaguggauuaccgauuuucccggaaaaacgguuugguucgugccauccaucaagaguggcaaugacauugcgaacugucucaggaaaaauggcaagcgggucauccagcugagcaggaagacuuuugauacagaauaccagaaaaccaagaacaacgacugggacuacgugguuaccacugauauaucggagaugggggccaauuuccgcgcagaccgugugauugauccuagacggugccuuaaacccgucauccuaaaggacggaccagaaagggugauccuggcugguccgaugccuguaacaguggccucugcagcccagcgccgaggcagaauugggcggaaccacaauaaagagggagaucaguauaucuacaugggccagcccuugaacaaugacgaggaucaugcucacuggaccgaagccaagauguuacuggacaacauuaauacaccagaggguauaauccccgcacucuucgaaccugagagggaaaaguccgcagccauugauggggaguaucgccugagaggcgaggcuaggaaaacuuuuguugaacuuaugcggcguggagaccugccagucuggcucagcuacaagguggccucagagggcuuccaauauagugaucgccgauggugcuuugacggggaaagaaacaaucagguguuggaggaaaacauggaugucgagaucuggacgaaagagggagaaaggaagaaacugcggccccgcuggcuagacgcuagaaccuacucugacccucuggcacucagggaguucaaggaauuugccgcuggucggcgauccguuagcggcgaucuuauccuggagauugggaaauuaccgcagcacuugacacagagagcccaaaaugcacuggacaaccucgugaugcugcauaauucagaacagggaggccgcgcguauaggcacgccauggaggagcuuccagauacuauagaaacccugaugcucuuggcucugaucgccguauuaacagguggggugacccuauucuuucugaguggccggggacucggcaagacuagcauugggcuucugugugucauggcauccucuguguugcuguggauggcuagcguugagccccauuggaucgccgcauccauuauccucgaguucuuucugauggugcuucucauaccugagcccgaccgucagagaacgccacaggauaaccaacuggccuacgucguaaucggauugcuguucaugauuuuaaccguggcugcgaaugagaugggucuacuggaaacaacuaagaaagaccucggcaucgggcacgccgcaguuggaaaccaccaucacgcugccaugcuugauguggaccugcauccugccucagcauggaccuuguacgcugucgccacaaccauuaucacucccaugaugaggcacacaauagagaacacgaccgcgaauauuucucugacugcuaucgccaaccaggcagccauucucaugggccuggauaaggguuggccaaucaguaaaauggacauaggggugccucuuuuagcucugggcugcuauucgcaggucaauccgcucacauugaccgcagccgugcugaugcuaguugcgcauuacgcuaucauuggacccggccugcaagccaaggcaacccgcgaagcccagaaacggacagcugccgggaucaugaagaacccaacuguggauggaauuguagcaaucgaccucgauccuguggucuaugacgcuaaguuugagaaacagcuuggccagauaaugcuguugauucuguguacgagccaaauccuccugaugcgaaccacaugggccuuaugcgaauccaucacucuugcgaccgguccccugacaacccucugggaggggucuccaggaaaguucuggaauacuacgauugccguuucaauggcaaacaucuuuagaggcagcuaccuagcuggugccggccuggcauucuccuugaugaaaagucuagggggaggcaggcgcgggacaggagcucagggcgagacccucggugaaaaguggaaacggcagcuuaaucagcugucuaagagcgaguucaacacuuauaagagaucagggauaauggaaguggaccguuccgaggccaaagaaggauugaagaggggcgagaccacaaaacacgccgucagucgggguacugcgaagcugcgcugguuuguggagcgaaaucucguaaaaccugaaggcaaggugauugauuuaggguguggaagaggcggguggagcuacuauugcgcuggacugaagaaaguuaccgaggugaagggcuacacaaaaggugggcccggacacgaagaaccgaucccaauggcaacguacggcuggaaccuugucaagcugcauucuggcaaagacguguucuuuauuccucccgaaaagugugauacccuacucugcgacaucggggaguccucaccaaaucccacuauagaggaaggaaggacacugcgggucuugaaaaugguggagccuuggcugcgcgguaaccaauucuguaucaagauucucaauccguauaugcccagcguuguagaaacccuugagcagaugcagagaaagcacggcgggaugcuggugaggaacccauuaucgcgaaauucuacucaugagauguacugggucaguugcggaacaggcaacaucguguccgccguuaauaugaccagccggaugcuguugaaccguuuuacgauggcucacagaaaaccuaccuaugaacgcgauguggaccucggugccgggacaaggcacgucgcaguggagcccgaaguagccaaccuggauauuaucggacagcggauugagaauaucaagcaugaacacaaaucaacuuggcauuacgacgaggauaacccuuauaagaccugggcuuaccacggcuccuaugaggugaaaccaucuggcagcgcgaguuccaugguuaauggggucgugaagcuacuuacaaagcccugggacgugauaccuauggucacucaaauugccaugaccgauacaaccccauucggacagcagagaguuuuuaaagaaaagguggacacucgcacgcccaaagcaaagagggguacagcucaaaucauggagguaaccgccaaauggcuguggggcuuccucagccgaaacaagaagccgcggaucuguacuagagaagaguuuaccaggaaagugcgcucuaaugcagccauuggggcugucuucguggacgaaaaccaguggaacucagccaaggaggcgguugaggaugaacguuuuugggaccuggugcaucgggagagagaauugcacaaacagggaaagugcgcaacaugcgucuacaacaugaugggcaaaagggagaagaagcugggugaguucgggaaagccaagggaagucgcgcuauaugguacauguggcucggcgcccgauuucuugaguucgaggcacugggcuucaugaaugaagaucacugguuuucccgggagaacagcuuaucugggguggaaggagagggucugcauaaauugggcuauauccucagagacauuucgaagaucccugggggaaauauguacgcugaugacacggccggcugggauaccaggauuacugaggacgaucugcagaacgaagcucgcaucacagacauaauggagccagaacacgcccuacuugcaaaaucaaucuucaagcugaccuaucaaaauaaaguaguuagagugcagcggcccgcgaagaacgguacugucauggaugugauuagcaggcgugaccagcgaggguccggacaggugggcacauacggccucaauaccuuuacaaacauggaggcccaacugauccgccagauggaaagugaggggauuuucucuccuagcgaguuggaaacuccaaacuuagcugagagaguccuggauuggcucgaaaaguauggaguugagcggcuuaaaaggauggccaucuccggugacgacugugugguaaagcccauagaugaccgcuuugcaaccgcucugacggcccuaaaugauaugggcaaagugagaaaggacauuccgcagugggaaccuucaaaaggguggaacgauuggcagcaaguccccuucugcagucaucacuuucaccagcugaucaugaaggacggacgggagaucgugguuccauguaggaaucaggaugagcucgugggccgagcacgugucucucagggugccggguggagcuugagagaaaccgcgugccugggaaaguccuacgcucaaauguggcagcuuauguauuuccaucgccgggaccugaggcucgccgcaaacgccauuuguucagcugugccuguagauuggauacccacaagcagaacuaccuggucuauccacgcccaucaccaguggaugacaacugaggacauguuauccguuuggaaucgcguguggauugaagagaacccauggauggaagauaaaacccauaucaguagcuggggcgacguccccuaccugggcaagcgggaggaccaauggugcgggucguugauuggacugacggcaagggcuacaugggccaccaauauccagguggcgauaaaccagguucgaagacucaucgguaaugagaacuaccuugauuauaugacuuccaugaaacgguuuaagaaugaaucugacccugagggcgcucugugguga

SEQ ID NO: 13657 - RNA, 9879 nt, Artificial Sequence
  derived and/or modified CDS sequence (opt3) from DENV-1__FJ410220__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuugcaccccaugucggccuggguuuggaaacuagaaccgagacauggauguccucugaaggggccuggaaacagauccagaggguggagacuugggcucuccggcacccuggauucaccguuauugcacuguuucuggcccaugcuaucggcacaucgauuacccagaagggcaucguguucauacucuuaaugcuggucacgccaucaauggccaugcgcugcguggggaucggaagcagagacuuuguagagggucuuaguggcgcgacuuggguugauguggucuuggaacacggguccugugugacaaccauggcaaaggacaaacccacucuggauauugagcuacucaagacagaagugaccaacccugccguccugaggaaacuuugcaucgaggcuaagauuucuaauacgaccacagacagccgguguccaacucaaggagaagccacccugguugaggagcaggaugcaaacuucgugugccgccgaacauuuguagacagaggcugggguaauggguguggauuguucggcaaaggcucccuccugacuugcgcuaaguuuaagugcgugaccaaauuagaagggaagaucguccaguacgagaaccugaaauauucagugauaguuacagugcacaccggagaucagcaucaagucgguaaugaaaguacugagcacggcacgacagccaccauuacuccccaggcgccuaccacagaaauccagcucaccgacuacggggcccuuacucuggacuguagcccaaggacaggauuggauuucaacgagauggugcuacugacgaugaaggagaaaucuuggcucguacauaagcagugguuucuggaccuuccgcugcccuggaccuccggcgcaucaacuagccaagaaacauggaaucggcaggauuugcucguuaccuucaaaacagcucacgccaagaagcaggagguggucgugcuggguagucaagaaggggcuaugcacacugccuuaaccggcgcaacggagauucagaccucuggaacaacuaccaucuuugccggccaucugaaaugccgucuaaagauggacaaacucacacugaaggggauguccuaugucauguguacuggaagcuucaaacuugaaaaggagguggcugagacccagcacgguacgguuuuggugcagaucaaguacgaaggcacagaugcgccuugcaaaauuccauucucgacccaagacgagaaggggguaacucagaacggacgccugauaacagcaaaucccaucgucaccgauaaagaaaagccugugaacauugaggccgagccacccuuuggcgaaucuuauaucguuauaggugcuggggagaaagcccucaagcuguccugguucaagaaaggcucaaguauuggaaagauguuugaagcaacugccagaggcgcuaggcggauggccauccuuggggacaccgcaugggauuucggaagcaucgguggcguguuuacauccgucgggaaacuggugcaucagauuuucggaacggcguacggcguauuguuuucuggugugagcuggaccaugaagaucgggauuggcguucuccugacuugguuaggacugaauucacgaaguacaucccuaagcaugaccuguauagcugucggccucgugacacuguaccuuggggugaugguccaggccgacucuggaugcguuaucaacuggaaaggccgcgaguugaagugugguucagggauuuucgugacuaaugaagugcacaccuggacggagcaauauaaguuucaggcagauaguccgaaaagacugagcgccgcuaucggaaaggccugggaggaaggcguaugcgguaucagguccgcaacacggcucgagaacauuauguggaaacagauaucuaacgaacugaaucauaucuuacuggagaacgacaugaaguucaccgucgugguuggcgacguggcugggauucuuguccagggaaaaaagaugauccgcccucaacccauggaauacaaauauucguggaagagcuggggcaaggccaaaauuaucggggcggaugugcagaauuccacuuuuauaaucgacggaccaaacaccccugagugucccgaugaccagagagccuggaauauuugggagguugaagauuacggcuucgguaucuuuacaacuaacauuugguugaagcucagggacucauauacccaggugugcgaucaccgucugaugagugcugcaaucaaagacucuaaggccguacacgcugauaugggguacuggauagagagcgaaaaaaaugagacauggaagcuagcccgggcauccuucauugaagucaagacguguaucuggccaaaaucacauacccuguggagcaacggagugcucgagucugagaugauuauccccaagauacacggcgguccuaucucccaacauaauuaucgaccaggcuacuucacucagacagcggggccguggcaccugggaaaacuugaauuggacuuugaucugugcgagggcaccacuguggucguugacgaacacugcgggaacagaggacccaguuuaaggacaaccacggugacuggcaagauuauccaugagugguguugccgcagcuguacccucccuccacugcgguucagaggugaggaugggugcugguacggaauggaaauuaggcccguaaaagagaaggaagagaaucuugugaagucuauggucuccgccggcucaggugaaguggacaguuuuagccugggcuugcucuguaucucgauaaugauugaggagguuaugcgcucccgauggucucggaaaaugcugaugacagggacccuagcuguguucuuucugcucaucaugggacagcugacuuggaacgaccuuauccguuugugcauuauggucggcgccaaugcaagcgauagaauggggaugggaacaaccuaucuggcuuuaauggccacauucaagaugaggccuauguuugcagugggccuccuguuccgccggcuuacuucaagagaaguucugcuacucaccaucggucugaguuugguggccuccgucgagcugccaaacucuuuagaagagcucggggacggacuggcuaugggcauuaugauacuuaaacuguugacggauuuucaaagcuaccagcucugggcgacacugcuaucccugaccuucaucaagacuaccuuuucacuucacuaugccuggaaaacaauggcaaugguacucagcauugugagucuguuccccuugugucugucuacuaccucccagaagacgacaugguuaccgguucuccugggcagccuugggugcaagccucugaccauguuuuugaucgcugaaaauaaaauuuggggaaggaagucguggccacucaacgaggguaucauggccgugggcauagucucaauccugcuaucuagucugcuuaaaaacgacgugccccucgccgggccucugauugcuggaggcauguugaucgcauguuacguaauuuccgguagcucugccgauuuaagccuggagaaggcggcugaaguguccugggaggaagaggccgaacauucaggggcaagucacaauauccucgucgagguucaggacgauggaacuaugaaaauaaaggacgaggaacgagaugacacacugaccauucuucugaaagccacuuugcuagcugugagcggcguguauccccugucuaucccagcaacacucuucgucuggcauuucuggcaaaagaagaaacagcgcuccggcgugcugugggauaccccuucacccccagagguugaacgggccguacuugacgaugggaucuacagaauuaugcagaggggauuacugggucguagucaggugggcgucgggguguuucaagagaacguuuuccacacgauguggcacgugacucgcggagcgguccucauguaucagggcaagcgguuggagccgagcugggcuuccgugaaaaaggaccugauaucuuacggugggggauggagauuucagggcucguggaauaccggcgaagagguacaggucaucgccguggaaccugggaaaaaccccaagaauguucaaacagcaccaggaaccuucaagacacccgagggugaagugggcgccauugcucucgacuuuaaaccugggacuagcggaucaccaaucgucaacagggagggcaagauugugggucuguacgggaauggaguugugaccacguccggcacauaugucagugccaucgcacaggcuaaagccucucaggagggcccccuuccugaaauagaggaugaaguguuccgaaagcggaaccugacuaucauggacuugcauccggggagcggaaaaacccgcagauaccuaccagcgauuguaagggaggccaucaagcggaagcugcgaacacucauuuuagcacccaccagagugguugcuuccgaaauggccgaggcucugaaagguaugccuauccgcuaucaaacuaccgcagucaagucagagcacacaggcaaagaaauaguggaucuuaugugccaugccacguuuacuaugaggcugcucucuccagugcguguccccaauuacaacaugauuaucauggacgaggcccacuucaccgauccuagcaguaucgcugcgcggggguauauuuccacaagaguaggaaugggcgaagcagccgcuaucuuuaugaccgccacuccgcccgguagcauggaggcauucccacagucuaaugccgugauacaggacgaagagagggauauuccugagcgcucauggaacuccggguacgaauggaucacagacuuucccggaaagaccguuugguucgugccaaguauuaaagcuggcaaugauaucgcgaacuguuugcgaaagaauggcaagagagucauacagcugagccggaaaacguucgacacugaguaucaaaagacaaaaaacaacgauugggacuacgugguuaccaccgacauuucggaaaugggggccaauuuuagggcagaucgcgugaucgacccucguagaugccucaagcccgucauccugaaagauggaccagagcgggugauucuugcugguccgaugccuguaacuguggccucugcagcccagaggcgcggccgaaucgggagaaaccauaauaaggagggagaccaguacauuuauaugggccagccccuaaacaaugaugaagaccacgcucacuggacagaggccaagaugcuguuggauaacauaaauaccccagaagguaucauucccgcguuauucgagccugaacgggagaaauccgcagccaucgacggggaguacaggcugcgcggcgaagcuagaaagacauuuguugagcucaugaggcggggagaucugccagucuggcuuagcuauaaaguggccucagaaggcuuccaauacagugaccgucgcuggugcuuugauggggagcgaaacaaucaggugcuggaagagaacauggacgucgagaucuggacuaaggaaggagagagaaaaaagcucaggccccggugguuggaugcucgcacguauucugacccucuggcacuaagagaauucaaagaguuugccgcugguaggcgguccguuagcggcgaccugauucucgaaauagggaagcuuccgcagcaucugacccagcgagcccaaaaugcauuagauaacuuggugaugcugcacaauucagagcagggaggcagagcguaccgccaugccauggaggaacucccagacacaaucgagacucugaugcuucuggcucucauugccguauugaccgguggggugacacuguucuuuuuaaguggcaagggacuaggcaaaaccagcaucgggcugcucugugucauggcauccucugugcuucuguggauggcuagcguugaaccccacuggauugccgcauccaucauauuggaguucuuucugauggugcuccugaucccugagcccgauaggcagcggacuccacaggacaaccaacuugccuaugucguaauuggacuccuguucaugaucuugacgguggcugcgaaugaaaugggucuguuagagaccacaaagaaagaucuaggcauugggcacguugccguggaaaaccaucaccaugcagcuaugcuggacgucgaucuccacccugccucagccuggacucuuuacgcaguggcuaccacaaucauaacccccaugaugcgucauacuauugagaacacaacggccaauaucucucugaccgcgauugcuaaccaggccgcaaucuugaugggacuggacaagggcuggccaauaaguaaaauggauaucggugucccucuccuggcccuugggugcuacucgcaggugaauccguuaacucugacagcugcaguucucauguugguggcccacuaugcgauuaucggccccggacugcaagcuaaggccaccagagaagcacagaagaggaccgccgcuggcauuaugaaaaacccaacaaucgacgggauaguagccauugaucuagacccuguggucuacgaugcaaaguuugagaaacagcugggacagaucaugcuccuuauccuguguacuagccaaauuuugcugaugcgcacgaccugggcucucugcgaguccaucacacuggccacuggccccuuaaccacacuuugggaagguucuccagggaaguucuggaauaccacuauagcgguuucaauggccaacauuuuccggggaagcuaucuggcaggcgcuggucucgccuuuucccuaaugaaaagucugggcgggggacgaagaggcacgggggcacagggagagacauugggcgaaaaguggaagaggcagcugaaucagcucucuaaaagcgaguucaacaccuacaagcgcucagguaucauggaaguggaccgguccgaggcuaaagaggggcuuaagagaggagaaacuaccaaacacgccgucagucguggcacagccaagcugaggugguuuguggagcggaauuugguaaagccugaagguaaagugauugaccugggcugugggcgcggaggcuggagcuauuacugcgcggggcucaagaaaguuacugaggugaagggauauaccaaaggcggucccgggcaugaagagccgaucccaauggcuacauacggauggaacuuagucaagcugcacucuggcaaagauguguucuuuauaccucccgagaagugugacacgcuucugugcgauaucggcgaauccucaccaaaucccaccauugaggaagggcgaacucuaagaguccucaagaugguggagccuuggcugaggggaaaccaauucuguaucaaaauuuugaauccguacaugcccagcguuguagagacacuggaacagaugcagcggaagcaugguggcaugcucgugcgcaacccacuuucgagaaauucuacccacgagauguauugggucaguugcgggacuggaaacaucguguccgcaguuaauaugacaagcaggaugcuguuaaaccgauuuaccauggcccaccggaaaccuacguacgaacgugacguggaucugggcgcugguaccagacaugucgccguggagcccgaaguagcaaacuuggacauuaucgggcagcgcauagagaauauuaagcacgagcauaaaucaacauggcacuaugaugaagacaacccuuacaagacuugggccuaucauggauccuacgaggugaagccaucuggcagcgcuaguuccaugguuaauggcgucgugaaacuccugaccaagcccugggaugugaucccuauggucacacaaaucgcgaugacugacaccacaccauucgggcagcagaggguuuuuaaagaaaagguggauacccggacucccaaagccaagagaggaacggcacaaauuauggagguaacagcucgcuggcuaugggguuuccuuagcaggaacaagaaaccgcgaauauguacccgggaagaguuuacuagaaaggugaggucuaaugccgcaaucggcgccgucuucguggacgagaaccaguggaauucagcuaaagaagccguugaggacgaucgcuuuugggaccuggugcaccgugaacgggagcuccacaagcaggggaaaugcgcgaccugcgucuauaacaugaugggaaagagagaaaagaaacugggcgaguucgguaaggcaaaagggaguagggccauuugguacaugugguugggagcucgcuuccuggaguuugaagcccucggcuucaugaaugaggaucauugguuuucccgagaaaacagccuuucuggcguggagggggagggacugcacaaguuagguuacauccugcgggacauuucgaaaaucccuggcgggaauauguaugcagaugacacagcuggaugggauacgagaauaaccgaagacgauuugcagaacgaggccaagaucacugacauuauggaaccagagcaugcucuccuggccaaaucaaucuucaagcuaacauaccaaaauaagguaguuagggugcagcgccccgcaaaaaacggcaccgucauggaugugauuagcagacgggaccagagggguuccgggcaggugggaacuuauggccuuaauacauuuaccaacauggaagcgcaacugauccgucagauggagagugagggcauauuccucccuaacgaacuggagacaccaaauuuggccgggcgagucuuagauuggcuggaaaaguacggaguugagcgccucaaaagaauggcuauuucuggugacgacugugugguaaagcccaucgaugaccgguuugccacugcacuuaccgcucugaacgauaugggcaaagugaggaaggacaucccgcagugggaaccuagcaagggguggaaugauuggcagcaaguccccuucugcucccaccacuuucaucagcuaauuaugaaagacggacgcgagauagugguuccauguagaaaccaggaugagcuggugggccgggccagggucucacagggugcaggguggagucuccgagaaacggccugcuugggaaagucuuaugcgcaaauguggcagcugauguacuuccaccguagagaccuucgccuggcugccaaugcaaucuguagcgccgugccuguagauuggguucccaccucccggacaacuuggucaauucaugcucaccaucaguggaugaccacagaggacaugcucagcguguggaacagggucuggaucgaagagaauccauggauggaagauaaaacuagaauuucuuccugggaggacgugcccuauuuaggcaagcgcgaggaccaauggugcggcagucugaucggguugaccgcccgggcaacgugggcuacaaacauacagguugccaucaaucaggugaggcgacugauuggaaacgaaaauuacagcgauuacaugaccucgaugaaaagauuuaagaacgaguccgaaccugagggugcgcucugguga

SEQ ID NO: 13658 - RNA, 9879 nt, Artificial Sequence
  derived and/or modified CDS sequence (opt3) from DENV-1__JF937649__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaagcuuugcauugaagccaaaaucucuaauacgaccacagauagcagguguccaacucaaggagaggcuacccugguugaagagcaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauccagacguccggaaccacaacuauuuuugcaggccauuuaaagugccggcugaaaauggauaagcuaacccucaaagggaugagcuaugucauguguacaggaucguucaagcuggagaaggaaguggccgagacucagcacgguaccguucuugugcagauaaaauacgagggcacggacgcuccuugcaagaucccauucucuacacaagaugaaaaagggguaacccagaacggacguuugauuacugcgaaucccaucgucacagacaaggagaaaccugugaacauagaagcagagccacccuuuggcgaguccuauauuguuaucggugccggggaaaaggcucugaagcucucaugguucaaaaagggcaguagcaucggaaaaauguuugaggccaccgcacgcggcgccagaaggauggcuauucugggggauacugccugggacuucggauccaucgguggcguguuuaccucugucgggaagcuugugcaucagauuuucggaacagcauacggcguacuguuuagcggugugucauggacgaugaaaauagggaucggcguuuugcucaccuggcugggauuaaauagucgguccacuagccugucuaugacauguauugcggucggccuagugacccucuaccugggggugaugguccaggcugauucaggaugcguuaucaacuggaagggccgagaacuuaagugugguagugggaucuucgugacaaaugaggugcacacuuggaccgaacaauauaaauuucaggccgacagcccgaagcgcuuguccgcagccauuggaaaagcuugggaggagggcguaugcgguauaagaucugccacgaggcuggaaaacaucauguggcggcagauuucgaacgagcucaaucauauccuguuagaaaacgacaugaaguucacagucgugguuggcgauguggucgggauucuggcacagggaaaaaagaugauccgcccucaacccauggagcacaaauacagcuggaaguccuggggcaaggcuaaaauaaucggggccgacgugcagaauaccacuuuuauuaucgauggaccaaacaccccugaaugucccgacgaucagagagcguggaauauuugggagguugaggacuauggcuucgguaucuuuacaacuaacauauggcuuaaguugagggauucauacacccaggugugcgaccaccgucucaugagugccgcuauuaaagauucuaaggcaguacaugccgacaugggguauuggaucgaaagcgagaaaaaugaaacauggaagcuggcucgggccuccuucauugaggucaagacguguaucuggccaaaaucacacacccuauggagcaacggagugcuggaaucugagaugauaauccccaagauuuacggcgguccuaucucccaacauaauuaucgaccaggcuacuucacucagacagcagggccguggcaccucggaaaacuggagcuugauuuugacuugugcgaaggcaccacuguggucguugaugagcacugcgggaacagaggacccagucugaggacaaccacggugacuggcaagauuauccaugaaugguguugccgcagcuguaccuuaccuccacuccgguucaaaggugaggacgggugcugguacggaauggagauaagacccguaaaggaaaaggaggaaaaucuggugaaaucuauggucuccgcgggcucaggugagguggacaguuuuagccuuggccuguuguguauuucgaucaugaucgaagagguuaugaggucccgcuggucucgaaagaugcucaugacagggacccuggccguguucuuucuacugauuaugggacagcucacuuggaacgaucugauccggagcugcauuauggucggcgcuaaugccucagaccguauggggaugggaacaaccuaucuugcauugauggcuacauucaaaaugagaccuauguuugccgugggccuguuauucaggcgccucacuagucgggagguucugcuucugaccauaggucuaucccucguggcaucugucgaacugccaaacagcuuggaggaacugggggauggauuagccaugggcaucaugauucucaagcugcuuacggacuuucaauccuaccagcugugggcuacauugcucucacugaccuucaucaaaacuaccuuuagccuacacuaugcguggaagacaauggccaugguacugaguauugugucucuucucccccuguguuuguccacuaccagccagaagacgacauggcugccgguuuuacucggcucgcuggggugcaaaccucuuaccauguuccugaucgcagagaauaagauauggggaagaaaaucauggccauugaacgaagguaucauggcugugggcauugucucuauccuccugaguucccuacugaagaacgaugugccccuugccgggccucucauugccggaggcaugcugaucgcuuguuacguaauaagcgguucuagcgcagacuuguccuuagagaaagccgcggaggugucaugggaagaggaagcugagcauaguggggccagccacaauauucuggucgaaguucaggaugacggaacuaugaagaucaaagaugaggagagggacgauacacucaccauccugcuuaaggcaacucuguuggccgugucuggcguguauccccuauccauuccagcuacacuguuugucugguacuucuggcaaaagaaaaagcagcgaucaggcgugcucugggacaccccuagucccccagaaguugagcgcgcaguacuggaugacgggauauaucggaucaugcagagaggacuuuuagguaggagccaggugggcgucgggguguuccaagaaaacguuuuucauacgauguggcacgugacucguggagccguccugauguaccagggcaaacgccucgagccguccugggcgucugugaagaaagacuugauuucguacggugggggauggcggcugcagggcagcuggaauaccggcgaggaaguacaggucaucgcuguggagccugggaagaaccccaagaauguucaaacagccccaggaaccuucaaaacacccgaaggugaggugggcgcaauugcccucgauuuuaagccugggacuucaggauccccaaucgucaacagagaaggcaaaauagugggucuguaugggaauggaguugugaccacgaguggcacauacgucucugcuaucgcccaggcaaaggcuagccaggagggcccccuuccugagauugaagacgagguguucaggaaacgaaaccugacuaucauggauuugcacccgggguccggaaagacccggcgcuaucuaccagccauuguaagagaagcgaucaagaggaaacugcggacacucauauuagcccccacccgagugguugcaucagagauggcugaagcccugaaggguaugccuauuagauaccaaacuaccgcugucaaaucugagcauacaggccgcgagaucguggaccuuaugugccacgcaacguuuacuaugaggcugcucagcccagugcguguccccaauuauaacaugaucauuauggaugaagcccauuucaccgacccuaguuccaucgccgcucggggguacauaagcacaagaguaggaaugggcgaggcggcagccauuuuuaugaccgcuacuccgcccgguucuguggaagccuucccacagucaaaugcaguuauccaggaugaggaaagggacauuccugagcgcuccuggaacaguggguaugaguggaucacagauuuucccggaaagaccgugugguucgucccaagcauaaaaucgggcaaugacauugccaacuguuugcgaaagaauggcaagagagugauccagcugucucggaaaacguuugauacugaauaccaaaagacaaaaaacaacgacugggacuacguugugaccaccgauaucuccgagaugggggcuaauuucagggcggaccgcgucauugauccucguagaugccucaagcccgugauccugaaagacggaccagaacggguaauucuugccgguccgaugccugugacuguugcaagcgcugcccagaggcgcggccgaauagggagaaaccacaauaaggagggagaucaguauaucuacaugggccagccccuaaacaaugacgaggaucaugcacacuggacagaagccaagaugcuguuggacaacauuaauaccccagaggguaucauccccgcuuuauucgaaccugagcgggaaaaaucagccgcgauugauggggaguauaggcugcgcggcgaggcaagaaagacauuugucgaacucaugaggcggggagaccugccaguguggcuuaguuacaaaguggccucugagggcuuccaauauuccgaucgucgcuggugcuuugacggggaacgaaacaaucagguccuggaggaaaacauggauguugagauauggacuaaggagggagaaagaaaaaagcucaggccccggugguuggacgcucgcacguacagcgacccucuggcccuaagagaguucaaagaauuugcugcagguaggcggucagugaguggcgaucugauccucgagauugggaagcuuccgcagcaccugacccagcgagcccaaaaugcuuuagacaacuugguaaugcugcauaauagcgaacagggaggcagagccuaucgccacgcaauggaggagcucccagauacaaucgaaacucugaugcuucuggcgcucauugccguguugaccgguggggucacacuguucuuuuuauccggcaagggacuaggcaaaaccucuaucgggcugcucugugugauggcuagcuccgcccuucuguggauggcaucaguugagccccauuggauagcugccucuaucauuuuggaauucuuucugauggugcuccugaucccugagcccgacaggcagcggacuccacaggauaaccaacuugcauacgucguaauuggacuccuguucaugaucuugacgguggccgcuaaugagaugggucuguuagaaaccacaaagaaagaccuaggcauagggcacguugcgguggagaaccaccaucacgccacuaugcuggaugucgaccuccauccugcaagugcuuggacccuuuacgccguggccacaaccauuaucacucccaugaugcgucacacaauugaaaacacgaccgcaaauaucucgcugacugcuauagccaaccaggcggcuaucuugaugggacuggauaagggcuggccaauuagcaaaauggacaucggugucccucuccuggcccuugggugcuauucccaggugaauccguuaacacugaccgcagccguucucauguugguggcucauuacgcaauuaucggccccggacugcaagccaaggcgaccagagaggcucagaagaggacagccgcaggcauaaugaaaaacccaacuguagaugggauuguggccaucgaccuagauccugucguuuaugacgcuaaguuugaaaaacagcugggacagaucaugcuccuuauucuguguacgucucaaaucuugcugaugcgcaccacaugggcccucugcgagucaauaacucuggcaaccggccccuuaacaacccuuugggaggguagcccagggaaguucuggaauacuacgauugcuguguccauggccaacaucuuucggggaaguuaccuggcgggcgccggucucgcauucucucuaaugaaaagccugggcgggggacgaagaggcacaggggcucagggagaaaccuugggcgagaaguggaagaggcagcugaaucagcucucaaaauccgaauucaacacuuauaagcgcagugguauuauggaggucgaccggagcgaagccaaagaggggcuuagacguggagagaccacaaagcacgcagugucuaggggcacugcuaaacugcggugguuuguagaacgcaauuuggugaagccugaggguaagguuaucgaucugggcugugggcgaggaggcugguccuacuauugcgccgggcucaaaaaggugaccgaagucaaaggauacacaaagggcggucccgggcacgaggaaccgauaccaauggccacguacggauggaacuuagugaaacugcauucaggcaaggacgucuucuuuaucccucccgagaaaugugauacccuucugugcgacauuggcgagagcucgccaaaucccacuaucgaagaggggagaacacuaagggugcucaagaugguugaaccuuggcugcggggaaaccaauucuguauuaagaucuugaauccguauaugcccucuguaguggagacccuggagcagaugcagcgcaaacacgguggcaugcucgucagaaacccacuuaguaggaauuccacucaugaaauguacugggugagcugcgggacaggaaacauuguuucagcggugaauaugaccucccgaaugcuguuaaaccgguuuacgauggcucaccguaagccuaccuaugagagagaugucgaccugggcgcagguacacgccacguggccguagaacccgagguggcuaacuuggauaucauagggcagaggauugaaaauaucaaacaugagcacaagucuacuuggcauuacgacgaggauaacccuuauaaaaccugggccuaccacggaagcuaugaaguuaagccaaguggcuccgcaagcucuauggucaauggcguggugaagcuccugacaaaacccugggacgucaucccuaugguuacucaaauugccaugaccgauacaaccccauucgggcagcagcggguguuuaaggagaaaguagacacuagaacgcccaaggcuaaacgcggaacagcgcaaauaauggaagugaccgccagguggcuaugggguuuccuuucacgaaacaagaagccgcggaucuguacuagagaggaauuuaccaggaaaguccgcaguaaugcagcuauuggcgccguguucguugacgagaaccaguggaauuccgcaaaggaggccguggaagaugagcguuuuugggaccugguccaucgggaaagagagcuccacaaacaggggaagugcgcuacaugcguguacaacaugaugggaaaaagggaaaagaagcugggcgaguucgguaaagccaaggggagccgcgcgaucugguacaugugguugggagcacgauuucuggaguucgaagcccucggcuucaugaaugaggaucacugguuuucucgggaaaacucgcuuucaggcguagagggggagggacugcauaaauuagguuauauucugagagacaucagcaagauaccuggcgggaauauguacgcugaugacacggccggaugggauaccaggaucacugaagacgauuugcagaacgaggcaaaaauuacagacaucauggaaccagagcacgcucuccuggccaccuccauuuucaagcuaacuuaucaaaauaaaguugugcgcguccagagacccgcucggaacggcacagugauggaugugaucaguaggcgugaccagcgagguucugggcaggucggaaccuacggccuuaauacauuuacuaacauggaagcccaacugauacgccagauggagagcgagggcauuuucuccccuucagaacucgagaccccaaaccuggcagaaagaguuuuggauugguuagagaagcaugggguggaacggcugaagaggauggcgaucaguggagacgacuguguagugaaacccaucgaugaccgcuuugccacggcucucucugcccuuaaugauauggguaaggucagaaaagacauuccgcagugggagccuagcaagggcuggaacgauuggcagcaagugcccuucugcucccaccacuuucaucagcugauaaugaaagacgggcgggagaucguugugccauguaggaaucaggaugaacuagucggacgagcacgugugucacagggcgcugguuggagccugagagagaccgccugccucgggaagucuuaugcacaaauguggcaguugauguacuuccaccgccgggaccugaggcuugccgcgaacgcuauuuguuccgccguaccuguugauugggugcccacaaguagaacuaccuggagcauccaugcacaccaucaguggaugacaacugaagacaugcugucggucuggaaucgcguguggauugaggaaaacccauggauggaggauaagacccacaucuccucuuggggagacguucccuaucucggcaaacgggaggaccaauggugcggcucauuaauagggcugacggccagggcuacaugggccaccaauauccagguggcaauuaaccagguccgaagauugaucggaaaugaaaacuaccuggauuacaugacuagcaugaagcgguuuaaaaaugagagugacccugaaggugcucucugguga

SEQ ID NO: 13659 - RNA, 9879 nt, Artificial Sequence
  derived and/or modified CDS sequence (opt3) from DENV-1__FJ410222__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaaaaagaugauccgcccucaacccauggaguacaaauauucguggaaaagcuggggcaaggccaagauaaucggggcggacguucagaauaccacauuuauuaucgauggaccaaacacuccugaaugucccgacgaucagagagccuggaauauuugggagguggaggacuacggcuucgguaucuuuaccacaaacauaugguugaagcucagggauuccuauacgcaggucugcgaccaccgucugaugucagcugcaauuaaagauaguaaggccgugcacgcugacaugggguacuggaucgaaucugagaaaaaugaaaccuggaagcuagcccgggcauccuucauugagguuaagacuuguaucuggccaaaaucccauacacuguggucaaacggagugcucgaaagcgagaugauaauccccaagauuuauggcgguccuaucucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauuaugggacagcugaccuggaacgaucuuauccguuugugcauuauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaauaggucugucauuggucgccaguguggaacugccaaacuccuuagaggaacucggggauggacuggcuaugggcaucaugauucuuaaacuguugaccgacuuucaaucucaucagcucugggcgacucugcuaagccugaccuucaucaagacaacuuuuucccuucacuaugccuggaaaaccauggcaaugguucucucaauugugagccuguugccccuguguuuaaguacgacaucucagaagaccacuuggcucccgguccugcuuggcucccuggggugcaagccuuugacaauguuccucaucgcugagaauaaaauauggggaaggcgaagcuggccacugaacgaagguaucauggccguaggcauugugucgauccuacugucaucucuucucaagaacgauguuccccuggccgggccuuugauugcuggaggcauguuaaucgcauguuacgugauaagugguuccagcgccgaccugucucucgagaaagcggcugaggucagcugggaagaggaagccgagcauuccggggcaucacacaauauucugguggaaguacaggaugacggaaccaugaagaucaaagaugaggagcgcgacgauacucuuacaauccuguugaaggccacccuacuggcugugaguggcgucuauccccucagcauuccagcaacgcuguuuguuugguacuucuggcagaaaaagaagcagcggucuggcgugcuuugggacacuccuucacccccagaaguggagagagccgucuuagaugacgggauauauaggaucaugcagcguggacugcucggucgcagccaggugggcguugggguauuccaagaaaacguguuucauaccauguggcacgucacacggggagcgguguugauguaccagggcaaaagacuggagccgaguugggcuagcguuaagaaagaccucauuuccuacggugggggauggaggcugcagggcucuuggaauaccggcgaggaagugcaggucaucgccguggagccugggaagaaccccaaaaauguacaaacagcaccaggaacuuucaagacccccgaaggugaggucggcgccauugcucuugauuuuaagccugggacgucgggaagcccaaucgugaaccgagaaggcaaaauaguuggucuguaugggaauggaguggucacaacuucaggcaccuacguguccgccaucgcacaggcuaaggccagucaggagggccccuugccugagauugaagacgagguuuuccggaaacgcaaccuaacaaucauggaucugcacccggggucuggaaagaccagaagguaucucccagcgauugugcgggaagccaucaaacgaaaguuaagaacucugauacuugcacccacccgcgucguggcuagcgagauggccgaagcucugaaggguaugccuauuagguaccaaacaacggcaguaaaauccgagcauacuggcaaggagaucguggaccucaugugccacgccaccuuuacaaugcguuugcugucaccaguucggguccccaauuauaacaugaucauuauggaugaagcccauuucaccgacccuucuagcaucgcugcgagaggguacauaaguacuagggugggaaugggcgaggcagccgcuauuuuuaugacagccaccccgcccgguuccguggaagcauucccacagagcaaugccgucauccaggaugaggaacgcgacauuccugagcgaucuuggaacucaggguaugaguggaucacggauuuucccggaaaaacuguaugguucgugccauccauaaagaguggcaaugacauugcuaacugucucaggaaaaauggcaagcggguuauccagcugagcaggaagacauuugauaccgaauaccagaaaaccaagaacaacgacugggacuacguggucacuacagauaucucggagaugggggcgaauuuccgcgccgaccgugugauugauccuagacggugccuuaaacccguuauccuaaaggacggaccagaaagggugauucuggcagguccgaugccugucaccguggcuucugccgcacagcgccgaggcagaauagggcggaaccacaauaaagagggagaucaguauaucuacaugggccagcccuugaacaaugacgaggaucaugcccacuggacagaagcuaagauguuacuggacaacauuaauacuccagaggguaucauccccgcccucuucgaaccugagagggaaaaguccgcggcaauugauggggaguaucgccugagaggcgaggccaggaaaacguuuguagaacuuaugcggcguggagaccugccaguguggcucagcuacaagguugcuucagagggcuuccaauauagugaucgccgauggugcuuugacggggaaagaaacaaucaggucuuggaggaaaacauggauguggagauauggaccaaagagggagaaaggaagaaacugcggccccgcuggcuagacgccagaacauacucugacccucuggcucucagggaguucaaggaauuugcagccggucggcgauccgugagcggcgaucuuauccuggagauugggaaauuaccgcagcacuugacucagagagcucaaaaugcccuggacaaccucgucaugcugcauaauucagaacagggaggccgcgcauauaggcacgcgauggaggagcuuccagauaccaucgaaacacugaugcucuuggcccugauugcuguuuuaaccgguggggugacucuauucuuucugaguggccggggacucggcaagacgagcaucgggcuucuguguguaauggccuccucuguguugcuguggauggcaagcgucgagccccauuggauagcugccuccaucauucucgaguucuuucugauggugcuucucaucccugagcccgaccgucagagaaccccacaggauaaccaacuggcauacguugugauuggauugcuguucaugaucuuaacagucgccgcuaaugagaugggucuacuggaaacuaccaagaaagaccucggcauagggcacguagcgguggagaaccaccaucacgccgcaaugcuugauguugaccugcauccugcuucagccuggacauuguacgccguggcaaccacuauuaucacacccaugaugaggcacacgauugaaaacaccacugcuaauaucucucugacagccauagcgaaccaggcugccauccucaugggacuggauaagggcuggccaauuaguaaaauggacaucggugucccucuuuuagcacuggggugcuauagccaggugaauccgcucaccuugaccgccgcuguccugaugcuaguggcacauuacgccauuaucggccccggacugcaagcgaaggcuacacgcgaggcccagaaacggacugcagccggcauaaugaagaacccaacgguugaugggauuguggcuaucgaccucgauccuguaguguaugacgccaaguuugaaaaacagcuuggacagaucaugcuguugauucuguguaccagccaaauccuccugaugcgaacaacuugggcauuaugcgaguccauaacccuugcuacaggcccccugaccacucucugggaggguucuccagggaaguucuggaauacgacaauugccgucucaauggcgaacaucuuuagaggaagcuaccuagccggcgcaggucuggcuuucuccuugaugaaaagucugggcgggggaaggcgcggcaccggggcccagggagaaacucucggcgagaaguggaaacggcagcuuaaucagcugucuaagagcgaguucaacaccuauaagagaucagguauuauggagguugaccguuccgaagcaaaagagggguugaagaggggagagacaacuaaacacgcugugagucggggcaccgccaagcugcgcugguuugucgaacgaaaucucgugaaaccugaggguaagguaaucgauuuaggcugugggagaggaggcuggagcuacuauugcgccgggcugaagaaagugacagaaguuaagggauacacgaaaggcggucccgggcacgaggaaccgauaccaauggcgaccuacggauggaaccuugugaagcugcauucuggcaaagacgucuucuuuaucccucccgagaagugugauacucuacucugcgacauuggcgaguccucaccaaaucccacaaucgaagaggggaggacccugcggguguugaaaauggucgaaccuuggcugcgcggaaaccaauucuguauuaagauccucaauccguauaugcccagcgugguugagacucuugagcagaugcagagaaagcacgguggcaugcugguaaggaacccauuaucgcgaaauucuacacaugaaauguacugggugaguugcgggaccggaaacauugucuccgcugugaauaugacgagccggaugcuguugaaccguuuuaccauggcacacagaaaaccuacauaugagcgcgauguugaccucggcgccgguacuaggcacguggcugucgaacccgagguggccaaccuggauaucauagggcagcggauugaaaauaucaagcaugagcacaaaucaaccuggcauuacgacgaggauaacccuuauaagacaugggcauaccacggauccuaugaaguaaaaccaucuggcagcgccaguuccauggugaauggcguugucaagcuacuuacuaagcccugggacgugaucccuauggugacccaaauugcuaugacagauaccacuccauucgggcagcagagagucuuuaaagagaagguugacacgcgcacacccaaagcgaagaggggaaccgcccaaauaauggaagugacugcaaaauggcugugggguuuccucagccgaaacaagaagccgcggaucuguaccagagaggaauuuacaaggaaaguacgcucuaaugcugccauuggcgcaguguucgucgacgagaaccaguggaacucagccaaggaggcuguggaagaugagcguuuuugggaccugguucaucgggaaagagaguugcacaaacaggggaagugcgccacgugcguguacaacaugaugggaaaaagggaaaagaagcugggcgaguucgguaaagcgaaggggagucgcgcaaucugguacauguggcucggagcccgauuucuugaguucgaagcucugggcuucaugaaugaggaucacugguuuucccgggaaaacagcuuaucuggcgucgagggggagggacugcauaaauuggguuauauucucagagacaucucgaagauaccuggcgggaauauguacgccgaugacaccgcaggaugggauacuaggaucacagaagacgaucugcagaacgaggcucgcauuaccgacaucauggaaccagagcacgcccuacuugcuaaaucaauuuucaagcugacuuaucaaaauaaagugguaagaguucagcggcccgccaagaacggcacagugauggaugucaucagcaggcgugaccagcgagguuccggacaggugggaaccuacggccucaauacauuuacuaacauggaagcacaacugauacgccagauggagagugagggcauuuucucuccuagcgaauuggagaccccaaacuuagcgaagagagugcuggauuggcucgaaaaauauggggucgagcggcuuaagaggauggccaucuccggagacgacuguguugugaaacccaucgaugaccgcuuugcuacggcccugaccgcacuaaaugauauggguaagguaagaaaagacauuccgcagugggaaccuucaaagggcuggaacgauuggcagcaagugcccuucugcagucaucacuuucaccagcugauaaugaaggacgggcgggagaucgucgugccauguaggaaucaggaugagcucguuggacgagcucgugugucucagggcgccgguuggagcuugagagaaacagcaugccuggggaaauccuacgcccaaauguggcagcuuauguauuuccaucgccgggaccugaggcucgcggcuaacgccauuuguucagcagucccuguggauuggauccccacuagcagaaccacauggucuauucacgcccaucaccaguggaugacuaccgaggacauguuauccguauggaaucgcguuuggaucgaagagaacccauggauggaagauaagacgcauauaaguagcuggggagacgugcccuaccugggcaaacgggaggaccaauggugcggcucguugaucgggcugacagcuagggccaccugggcaacuaauauucaggucgcuaucaaccaggugcgaagacucauuggaaaugagaacuaccuugauuauaugacauccaugaagcgguuuaaaaaugaaucugacccugagggugcccugugguga

SEQ ID NO: 13660 - RNA, 9879 nt, Artificial Sequence
  derived and/or modified CDS sequence (opt3) from DENV-1__FJ461319__SS-prME
agcgugaccaugcugcucaugcuuaugcccacagcccuggcuuuccacuugacuacgagaggaggggagccucauauggucguuuccaagcaagaaagaggaaaaucuuuacuguuuaagaccucagcgggugugaauaugugcacacugaucgccauggaccucggcgagcugugugaagauacuaugaccuacaaaugcccacggauuacagaggcggaaccggacgauguagacuguuggugcaaugcuaccgauacuugggugacauaugggaccuguagucaaacgggagagcaccgccgagacaagcguagcgucgcccuugcuccccaugugggccuggguuuggagacuagaaccgaaacauggauguccucugagggggccuggaaacagauacagaggguugaaacuugggcccuccggcacccuggauucaccgugaucgcacuguuucuggcccaugcuauuggcacaucgaucacccagaagggcauuaucuucauacucuuaaugcuggucacgccaucaauggccaugcgcugcguggggaucggaagcagagauuuuguagagggucuuaguggcgcgacuuggguugacguggucuuggagcacggguccugugugacaaccauggcaaaggauaaacccacucuggacauugaacugcucaagacagaggugaccaacccugccauccugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauaggguugggcgugcuccugacuugguuaggacuaaauucacgaaguacaucccuaagcaugaccuguaucgcuguuggccucgucacacuguaccuuggggugauggugcaggccgauucuggaugcgucauuaacuggaaaggccgcgaauugaagugugguucagggaucuucguuacuaaugaggugcacaccuggacggaacaauauaaguuucaggcagacaguccgaaaagacugagcgccgcuaucggaaaggccugggaggagggcgugugcgguauuagguccgcaacacggcucgaaaacguaauguggaaacagauaucuaacgagcugaaucauaucuuacuggaaaacgacaugaaguucaccgucgugguuggcgauguggcugggauucuugcccagggcaaaaagaugauccgcccucaacccauggagcacaaauacucguggaaaagcuggggcaaggcgaagauuaucggggccgacguccagaauacuaccuuuauaaucgauggaccaaacacaccugaaugucccgacgaucagagagcuuggaauauuugggagguggaggacuauggcuucgguaucuuuacuaccaacauuugguugaagcucagggauuccuacacacagguuugcgaccaccgucugaugucagcagccaucaaagauaguaaggcugugcaugccgacaugggguauuggauagaaucugagaaaaaugaaacguggaagcuagcacgggcgagcuucauugagguaaagaccuguaucuggccaaaaucccacacucuguggucaaacggaguccucgaaagcgagaugauuauccccaagauauacggcgguccuaucucucaacauaauuaucgaccaggcuacuucacacagaccgccgggccguggcaccugggaaaacuugaguuggauuuugaccugugcgaaggcacuacagugguggucgaugagcacugcgggaacagaggacccuccuuaaggaccacgacuguuaccggcaagauuauccaugaaugguguugccgcaguuguacacucccuccacugcgguucagaggugaggacgggugcugguacggaauggagauuaggcccgugaaagaaaaggaggaaaaucuuguaaagagcauggugucugcuggcuccggugaggucgacucauuuagucugggcuugcucuguaucagcauaaugauugaagaggugaugcgcucgcgauggucccggaaaaugcugaugaccgggacucuagccguuuuccugcuccugaucaugggacagcuuacauggaacgauuugauccgucugugcauuauggugggcgcaaaugcuucugacagaauggggaugggaaccacauauuuagcccucauggcaacuuuuaagaugaggccuauguucgccgucggccugcuuuuucgccggcugaccagcagagaggugcuacuccugacgaucgguuugucacugguugcuaguguggaauuaccaaacucccucgaggaacugggggauggacuugcgaugggcauuaugauacugaaauugcucacagacuuccaaucucaccagcugugggccacccuacugagccuuacuuuuaucaagaccacauucucccuccauuacgcauggaaaacuauggcuaugguccugucaauuguauccuuguuuccccuguguuuaaguaccacgucucagaagacaaccuggcucccggugcugcuuggcucccuggggugcaagccuuugacuauguuccucaucgccgagaauaaaauuuggggaaggcgaagcuggccacugaacgaagguaucauggccguuggcauagugucgauccuacugucaucucuucucaagaacgaugucccccuggcugggccuuugauugcaggaggcauguuaaucgccuguuaugugauuagugguuccagcgcggaccugucucucgagaaagcugccgagguaagcugggaagaggaagcagagcacuccggggccucacauaauauccugguggaaguccaggaugacggaacaaugaagauaaaagaugaggagcgcgacgauacccuuacuauucuguugaaggcuacacuacuggcaguuaguggcguguacccccucagcaucccagccacccuguuugugugguauuucuggcagaaaaagaagcagcggucuggcguccuuugggacacgccuucacccccagaaguggagagagcgguuuuagaugacgggaucuacaggauuaugcagcguggacugcucggucgcagccagguaggcgugggggucuuccaagaaaacguguuucacacuauguggcacguuacccggggagcuguguugauguaucagggcaaaagacuggagccgaguugggccagcgucaagaaagaccucauauccuacggugggggauggaggcugcagggcucuuggaauacaggcgaggaagugcagguaaucgcagucgagccugggaagaaccccaaaaaugugcaaaccgccccaggaacauucaagacucccgaaggugagguuggcgcuauugcccuugauuuuaagccugggaccucgggaagcccaaucgugaaccgagaaggcaaaauugucggucuguacgggaauggagugguuacgacaucaggcacuuauguguccgcaaucgcucaggccaaggcgagucaggagggccccuugccugagauagaagacgaggucuuccggaaacgcaaccuaaccaucauggaucugcauccggggucuggaaagacaagaagguaccucccagccauugugcgggaagcaaucaaacgaaaguuaagaacccugauucuugcucccacucgcguaguggccagcgagauggcugaagcacugaaggguaugccuaucagguaucaaaccacagccguuaaauccgagcacacgggcaaggagauagucgaccucaugugccaugccacuuuuaccaugcguuugcugucaccagugcgggugcccaauuacaacaugauuaucauggaugaagcucacuucacagacccuucuagcaucgcggcaagaggguauauuaguaccagggucggaaugggcgaggccgcugccaucuuuaugacugcaacaccgcccgguuccguagaagccuucccacagagcaaugcugugauacaggaugaggaacgcgacauuccugagcgaucuuggaacucaggguacgaguggaucaccgauuuucccggaaaaacgguuugguucgugccauccauuaagaguggcaaugacaucgcgaacugucucaggaaaaauggcaagcgggucauacagcugagcaggaagacuuuugauacagaauaucagaaaaccaagaacaacgacugggacuacgugguuaccacugauauuucggagaugggggccaauuuccgcgcagaccgugugaucgauccuagacggugccuuaaacccgucauccuaaaggacggaccagaaagggugauucuggcugguccgaugccuguaacaguggccucugcagcccagcgccgaggcagaaucgggcggaaccauaauaaagagggagaucaguacauuuauaugggccagcccuugaacaaugacgaggaucacgcucacuggaccgaagccaagauguuacuggacaacauaaauacaccagaggguaucauucccgcacucuucgaaccugagagggaaaaguccgcagccaucgauggggaguaccgccugagaggcgaggcuaggaaaacuuuuguugaacuuaugcggcguggagaccugccagucuggcucagcuauaagguggccucagagggcuuccaauacagugaucgccgauggugcuuugacggggaaagaaacaaucagguguuggaggaaaacauggaugucgagaucuggacgaaagagggagaaaggaagaaacugcggccccgcuggcuagacgcuagaaccuauucugacccucuggcacucagggaguucaaggaauuugccgcuggucggcgauccguuagcggcgaucuuauucuggagauagggaaauuaccgcagcauuugacacagagagcccaaaaugcacuggacaaccucgugaugcugcacaauucagaacagggaggccgcgcguacaggcaugccauggaggagcuuccagauacuaucgaaacccugaugcucuuggcucugauugccguauuaacagguggggugacccuauucuuucugaguggccggggacucggcaagacuagcaucgggcuucugugugucauggcauccucuguguugcuguggauggcuagcguugagccccacuggauugccgcauccaucauacucgaguucuuucugauggugcuucucaucccugagcccgaccgucagagaacgccacaggauaaccaacuggccuaugucguaauuggauugcuguucaugaucuuaaccguggcugcgaaugagaugggucuacuggaaacaacuaagaaagaccucggcauugggcacgccgcaguuggaaaccaucaccaugcugccaugcuugauguggaccugcacccugccucagcauggaccuuguacgcugucgccacaaccaucauaacucccaugaugaggcauacaauugagaacacgaccgcgaauaucucucugacugcuauugccaaccaggcagccauccucaugggccuggauaaggguuggccaauaaguaaaauggacaucggggugccucuuuuagcucugggcugcuacucgcaggucaauccgcucacauugaccgcagccgugcugaugcuaguugcgcacuaugcuauuaucggacccggccugcaagccaaggcaacccgcgaagcccagaaacggacagcugccgggauuaugaagaacccaacuguggauggaaucguagcaauagaccucgauccuguggucuacgacgcuaaguuugagaaacagcuuggccagauuaugcuguugauccuguguacgagccaaauccuccugaugcgaaccacaugggccuuaugcgaauccauuacucuugcggccgguccccugaccacacucugggaggggucuccaggaaaguucuggaauaccacuaucgcaguuucaauggcuaacauauuuagaggcagcuaucuagccggugcaggccuggcuuucuccuugaugaaaagucuagggggaggcaggcgcgggacgggagcccagggcgagacacucggugaaaaguggaaacggcagcuuaaucagcugucuaagagcgaguucaacaccuacaagagaucagggauuauggaaguggaccguuccgaggccaaagaaggauugaagaggggcgagacuaccaaacacgcggucagucgggguacagcuaagcugcgcugguuuguggagcgaaaucucguaaaaccugaaggcaaggugaucgauuuaggguguggaagaggcggguggagcuauuacugcgcaggacugaagaaaguuacugaggugaagggcuauaccaaaggugggcccggacaugaagaaccgauuccaauggccacauacggcuggaaccuugucaagcugcacucuggcaaagacguguucuuuaucccucccgaaaagugugauacgcuacucugcgacauaggggaguccucaccaaaucccaccaucgaggaaggaaggacucugcgggucuugaaaaugguggagccuuggcugcgcgguaaccaauucuguauuaagauccucaauccguacaugcccagcguuguagaaacacuugagcagaugcagagaaagcauggcgggaugcuggugaggaacccauuaucgcgaaauucuacccacgagauguauugggucaguugcggaacuggcaacauuguguccgcuguuaauaugacaagccggaugcuguugaaccguuuuaccauggcccacagaaaaccuacguacgaacgcgauguggaccucggugcagggaccaggcaugucgccguggagcccgaaguagcuaaccuggauaucauuggacagcggaucgagaauauaaagcacgaacauaaaucaacauggcacuaugacgaggauaacccuuacaagacuugggcguaucauggcuccuacgaggugaaaccaucuggcagcgccaguuccaugguuaauggggucgugaagcuacuuaccaagcccugggacgugauuccuauggucacacaaaucgcaaugacugauaccacaccauucggacagcagagaguuuuuaaagaaaagguggacacccgcacucccaaagcuaagagggguacggcccaaaucauggagguaacagcaaaauggcuguggggcuuccucagccgaaacaagaagccgcggauuuguaccagagaagaguuuacuaggaaagugcgcucuaaugccgcuauaggggccgucuucguggacgaaaaccaguggaacucagcgaaggaggcaguugaggaugaacguuuuugggaccuggugcaccgggagagagaauugcacaaacagggaaagugcgcaaccugcgucuauaacaugaugggcaaaagggagaagaagcugggugaguucgggaaagcuaagggaagucgcgccaucugguacauguggcucggcgcacgauuucuugaguucgaggcucugggcuucaugaaugaagaucauugguuuucccgggagaacagcuuaucugggguggaaggagagggucugcacaaauugggcuacauucucagagacaucucgaagauuccugggggaaauauguaugccgaugacacagcuggcugggauacgaggaucaccgaggacgaucugcagaacgaagcccgcauaacugacaucauggagccagaacaugcacuacuugcgaaaucaauuuucaagcugacauaccaaaauaaaguaguuagagugcagcggcccgccaagaacgguaccgucauggaugugaucagcaggcgugaccagcgaggguccggacaggugggcacuuauggccucaauacauuuaccaacauggaggcucaacugauucgccagauggaaagugaggggaucuucucuccuagcgaguuggaaacaccaaacuuagccgagagaguccuggauuggcucgaaaaguacggaguugagcggcuuaaaaggauggcaauauccggugacgacugugugguaaagcccauugaugaccgcuuugcuacugcccugaccgcacuaaaugauaugggcaaagugagaaaggacaucccgcagugggaaccuucaaaaggguggaacgauuggcagcaaguccccuucugcagucaccacuuucaucagcugaucaugaaggacggacgggagauugugguuccauguaggaaucaggaugagcucgugggccgagcccgugucucucagggugcgggguggagcuugagagaaacggcuugccugggaaaguccuaugcccaaauguggcagcuuauguacuuccaccgccgggaccugaggcucgcagccaacgcuauauguucagccgugccuguagauuggauccccaccagcagaacaacuuggucuauucaugcacaccaucaguggaugaccacagaggacauguuauccguuuggaaucgcguguggaucgaagagaacccauggauggaagauaaaacucacauuaguagcuggggcgacguccccuaucugggcaagcgggaggaccaauggugcgggucguugaucggacugaccgcuagggccacgugggcgacaaaugugcagguugcuauaaaccaggugcgaagacucaucgguaaugagaacuaccuugauuacaugaccuccaugaaacgguuuaagaaugaaucugacccugagggcgcccugugguga

SEQ ID NO: 13661 - RNA, 9879 nt, Artificial Sequence
  derived and/or modified CDS sequence (opt3) from DENV-1__FJ461320__SS-prME
agcgugaccaugcugcucaugcuuaugcccaccgcccuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguugacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggcauccuucaucgagguaaagaccuguauuuggccaaaaucccacacucuauggucaaacggaguccuggaaagcgagaugaucauacccaagaucuacggcgguccuauuucucaacauaauuaucgaccaggcuacuucacacagaccgcggggccguggcaccucggaaaacuggagcuugauuuugacuugugcgaaggcacuacagugguggucgaugagcacugcgggaacagaggacccucccugaggaccacgacuguuaccggcaagaucauucaugaaugguguugccgcaguuguacauuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugguggaagagguuaugaggucgcgcuggucccgaaagaugcucaugaccgggacucuggcuguguuccuacugcucaucaugggacagcugacauggaacgaucuuauccgguugugcauuauggucggcgccaaugcaucugaccguauggggaugggaaccacauaucuggcuuuaauggccacuuuuaaaaucagaccuauguucgcagugggccuccuguuuaggcgccuuaccagccgggagguucugcuacucacgauuggucugucauugguggccagugucgaacugccaaacuccuuagaggaacucggggauggacuggcuaugggcauaaugauccuuaagcuguugacagacuuccaaucucaccagcucugggcgacccugcuaagccugacuuuuauuaaaaccacacuuucccuccauuacgccuggaagacuauggcaaugguacugucaaucgugagcuuguucccccuguguuuaaguaccacgucucagaagacaaccuggcucccgguucugcuuggcucccuggggugcaaaccuuugacuauguuucucauuacagagaauaagaucuggggaagaaaaagcuggccacugaacgaagguauaauggcugugggcgucgugucgauccuacugucaucucuucucaagaacgauguaccccuggccgggccuuugauugccggaggcauguuaaucgcuuguuaugugauuagugguuccagcgcagaccugucucucgagaaagccgcggaggucagcugggaagaggaagcugagcacuccggggccucacauaauauccugguugaagugcaggaugacggaaccaugaagauaaaagaugaggagagggacgauacucuuacaauucuguugaaggcaacccuacuggccgugaguggcgucuacccccucagcaucccagcuacgcuguucgugugguauuuuuggcaaaagaaaaagcagcgaucuggcguucuuugggacacuccuucacccccagaaguagagcgcgcaguguuagaugacgggaucuaccggauuaugcagagaggacugcucgguaggagccaggucggcguggggguuuuccaagaaaacguguuccacaccauguggcacgucacacguggagccguguugauguaucagggcaaacgccuggagccgaguugggcgagcguaaagaaagaccucauauccuacggugggggauggcggcugcagggcucuuggaauaccggcgaggaaguccaggugaucgcuguugagccugggaagaaccccaagaaugugcaaacagccccaggaacuuuuaaaacccccgaaggugaggucggcgcaauugcccuugauuucaagccugggacgucgggaagcccaaucgugaacagagaaggcaaaauuguuggucuguacgggaauggaguggucacaacuucaggcaccuauguguccgcuaucgcccaggcaaaggcuagucaggagggccccuugccugagauagaagacgagguauuuaggaaacgaaaccuaacaaucauggaucugcauccggggucuggaaagacccggcgcuaccucccagccauugugagagaagcgaucaagaggaaauuacggacucugauucuugcccccacccgaguugucgcaagcgagauggcugaagcccugaaggguaugccuaucagauaucaaacaacggcugugaaauccgagcacacuggcaaggagauaguggaccucaugugccaugcaaccuucacaaugcgcuugcugucaccagucaggguacccaauuacaacaugauuaucauggaugaagcccacuuuaccgacccuucuagcaucgccgcucguggguauauuaguacucgggugggaaugggcgaggcggcagccaucuucaugacagcuaccccgcccgguuccguugaagccuuuccacagagcaaugcagugauacaggaugaggaaagagacauuccugagaggucuuggaacucaggguacgaguggaucacggauuuccccggaaaaacugucugguuugugccauccauuaagaguggcaaugacaucgccaacugucuccgcaagaauggcaaacgaguuauacagcugagcagaaagacauucgauaccgaauaucagaaaaccaagaacaacgacugggacuacguggucacuacagauauuucggagaugggggcuaauuuucgggcggacagggugaucgauccucgccguugccuuaaacccguaauccuaaaggacggaccagaaagagugauucuggccgguccgaugccuguuaccgucgcaucugcugcccagcggaggggccgcaucgggcgaaaccauaauaaggagggagaucaguacauuuauaugggccagcccuugaacaaugacgaggaucacgcacacuggacagaagccaaaauguuacuggacaacauaaauacuccagaggguaucauucccgcucucuucgaaccugagagagaaaaguccgccgcgaucgauggggaguaccggcugaggggcgaggcacgcaaaacguucguggaacuuaugagaaggggagaccugccaguguggcucagcuauaaggucgccucagagggcuuucaauacagugaucggcguuggugcuucgacggggaacgcaacaaucagguuuuggaggaaaacauggauguggagaucuggaccaaagagggagaacgaaagaaacugagacccagguggcuagacgcucggacauauucugacccucuggcccuccgcgaguuuaaggaguucgcugcagguagaagguccguaagcggcgaucuuauucuggagauagggaaguuaccgcagcauuugacucagcgggcccaaaaugcucuggacaaccucgugaugcugcacaauucagaacagggaggccgagccuacagacaugcaauggaggagcuuccagauaccaucgaaacacugaugcucuuggcgcugauugccgucuuaaccgguggggugacucuauuuuuccugaguggccgcggacucggcaaaacgagcaucgggcuucuguguguuauggcuuccucuguguugcuguggauggccagcgucgagccccacuggauugcagcuuccaucauacucgaauuuuuccugaugguacuucucaucccugagcccgacaggcagcggaccccacaggauaaccaacuggccuaugugguuauuggauugcuguuuaugaucuuaacaguggcagccaaugagaugggucuacuggaaacuaccaagaaagaccucggcauugggcacgucgcuguggagaaccaucaccaugcgacaaugcuugaugucgaccugcacccugccucagcauggaccuuguacgcuguggccacuacaaucauaacgcccaugaugcgucauaccauugaaaacacuacagccaauaucucucugaccgcaauugcuaaccaggccgcgauccucaugggacuggauaagggcuggccaauaaguaaaauggacaucgguguuccucuuuuagcucuggggugcuacagccaggugaauccgcucaccuugacagccgcaguacugaugcuaguggcccacuaugcuauuaucggccccggacugcaagcaaaggccacuagagaggcgcagaagaggacggcugccggcauuaugaaaaacccaaccgucgaugggaucguugcaauagaccucgauccuguggucuacgacgccaaguucgaaaaacagcuuggacagauuaugcuguugauccuguguacaagccaaauccuccugaugcgcacuaccugggcuuuaugcgaguccauuacacuugccaccggcccccugacuacgcucugggaggguucuccagggaaguuuuggaauacaaccaucgcagugucaauggcuaacauauuccggggaagcuaucuagccggcgcgggucuggccuuuuccuugaugaaaagucugggcgggggacgaagaggcacuggggcacagggagaaacccucggcgagaaguggaagaggcagcuuaaucagcugucuaaaagcgaguucaacauuuacaagcgcucagguaucauggagguagaccgguccgaagcuaaagagggguugaagagaggagagacaacucgucacgccgugaguaggggcaccgcaaaacugcggugguucguugaacgcaaucucgugaagccugaggguaaggucauugauuuaggcugugggcgaggaggcuggagcuauuacugcgcugggcugaaaaaggugacagaagucaaaggauauacgaagggcggucccgggcaugaggaaccgaucccaauggccaccuacggauggaaccuugugaaacugcacucuggcaaggacguauuuuucacuccucccgagaaaugugauacacuacucugcgacauaggcgaguccucaccaaaucccaccaucgaagaggggagaacucugaggguauugaagaugguggaaccuuggcugcggggaaaccaauuuuguauuaagauccucaauccguacaugcccagcgucguggagacacuugagcagaugcagcgcaaacaugguggcaugcugguuagaaacccauuaucgagaaauucuacccacgaaauguauugggugaguugcgggacgggaaacauugucuccgccgugaauaugaccagccgaaugcuguugaaccgguucacaauggcgcaccguaagccuacuuacgagagagauguagaccucggcgcugguacccgccauguggcaguugaacccgaggucgccaaccuggauaucauugggcagaggaucgaaaauauaaaacacgagcauaagucaacauggcacuaugacgaggauaacccuuacaaaacuugggcuuaucauggauccuacgaagugaagccaucuggcagcgccaguuccauggugaauggcgucguuaagcuacuuaccaaacccugggacgugauuccuaugguaacacaaaucgcaaugaccgauacuacgccauuugggcagcagcggguguucaaggagaaagucgacacaagaacccccaaggccaaacgcggaacugcucaaaucauggaagugaccgcgagguggcugugggguuuucucagccgaaacaagaagccgcggauuuguacaagagaggaguucacgaggaaaguucgcucuaaugccgcaauaggcgcuguguuugucgacgagaaccaguggaacucagccaaggaggcaguggaagaugagcguuucugggaccugguacagaaagaacgggaguugcacaagcaggggaaaugcgcaaccugcguuuauaacaugaugggaaagagagaaaagaaacugggcgaguuugguaaggcuaaagggaguagggccaucugguacauguggcucggagcgcgcuuccuugaguuugaagcacugggcuucaugaaugaggaucacugguucucccgagaaaacagcuuaucuggcguggagggggagggacugcauaaguuggguuacauucuccgggacaucucgaaaauuccuggcgggaauauguaugccgaugacacugcuggaugggauacaagaaucaccgaagacgaucugcaaaacgaggccaagauaacugacaucauggaaccagagcacgcacuacuugcuacaucaauuuuuaaacugaccuaccagaauaaggucgugagggugcagcgccccgccaagaacggcacagucauggauguuaucagcagacgggaccagagggguuccgggcaagugggaacuuauggccucaauaccuucacgaacauggaagcucagcugauucgucagauggagagugagggcaucuuuuugccuucugaauuagagaccccaaaccuggccgaacgaguacucgauuggcuugagaaauacgggguggaacgccugaagagaauggcaauaagcggagacgacugugucgugaaacccauugaugaccgguucgcgacagcccuaacugcucugaaugauauggguaagguuaggaaagacaucccgcagugggagccuuccaagggcuggaacgauuggcaacaggugcccuuuugcucacaucacuuccaccagcucaucaugaaggacgggcgcgagauugucgugccauguagaaaucaggaugaauugguaggacgggccaggguuagucaaggcgcagguuggucucugcgagagaccgcuugccuugggaaaagcuaugcccagauguggcagcugauguacuuucaucguagagaccuccgcuuagcagccaacgcgauauguuccgcugugccugucgauugggugcccacaucacggacuaccuggagcauccacgcccaucaccaauggaugacgacagaagacaugcugucuguuuggaauaggguguggauugaggaaaacccauggauggaggauaagacccaugucuccaguuggggagacgugcccuauuugggcaaaagagaggaccaguggugcggcagccugaucgggcucacugcacgcgccacaugggcuucgaauauucagguagccaucaaccaggugcggaggcuuauaggaaaugaaaacuaccuggauuacaugaccuccaugaagcgauucaaaaaugagggugacccugaaggcgcacuaugguga

SEQ ID NO: 13662 - RNA, 9879 nt, Artificial Sequence
  derived and/or modified CDS sequence (opt3) from DENV-1__FJ410225__SS-prME
agcgugaccaugcugcucaugcuuaugcccaccgcccuggcuuuccacuugacuacgcggggaggggaaccucauaugaucgucuccaagcaggaaaggggaaaaucuuuacuguuuaagaccucagccgguguuaauaugugcacacuaauugccauggaccucggcgaacugugugaagauacuaugaccuacaaaugcccacggauaacagaaaccgaaccggacgauguggacuguuggugcaaugcgacugauacauggguaaccuaugggacguguagucaaacuggagaacaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguugacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccauugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaagaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccaggcggccgggccguggcaucucggaaaacuggagcuugauuuugacuugugcgaaggcacuacaguagucguggaugagcacugcgggaacagaggacccucccugaggaccacgacugugaccggcaagaucauacacgaaugguguugccgcaguuguacauuaccuccacuccgguucagaggugaggacgggugcugguauggaauggagauuaggcccgucaaagaaaaggaggaaaaucugguuaagagcauggugucugcuggcuccggugagguagacucauuuagucuuggccuguuguguaucagcaucaugauugaagaggugaugcgcucgcgauggucccggcguaugcucaugaccgggacucuggccgucuucuuucuacugaucaugggacagcucacauggaacgaucugauuagacuuugcauaauggugggcgcaaaugcuucugacaggauggggaugggaaccacauacuuggcccugauggcaacuuucaaaaugcgcccuauguuugccguuggcuuacucuuccggagacugaccagcagggaggugcuucugcuaacgaucggucucucacuggucgcuaguguggaauugccaaacucccuggaggaauuaggggauggacucgcgaugggcauuaugauccugaaacuucugacagacuuucaaucucaucaguugugggccacccuccugagccuaacuuucauuaaaaccacauuuucccugcacuaugcauggaagacuauggcuaugguucuuucaaucgugagccucuucccccuguguuugaguaccacgucucagaaaacaaccuggcugccggucuuacucggcucccuggggugcaagccucuuacuauguuucugauagccgagaauaagaucuggggacgacgcagcuggccauugaacgaagguauuauggccguaggcaucgugucgauucuccugucaucucuacugaaaaacgauguuccccuugcugggccucucaucgcaggaggcaugcugauagccuguuacgugauuagugguuccagcgcggacuugucuuuagagaaggcugccgagaucagcugggaagaggaagcagagcauuccggggccucacacaauauccuggucgaagugcaggaugacggaacaaugaaaauuaaggaugaggagcgggacgauacccucacuauacugcuuaaagcuacacuguuggcaguaaguggcguguauccccuaagcaucccagccacccuguucgucugguacuucuggcaaaagaaaaagcagagaucuggcguucucugggacacgccuucacccccagaaguggagagggcggugcuggaugacgggauuuaucguaucaugcagcgcggacuuuuaggucggagccaggucggcguggggguuuuucaagaaaacguauuccauacuauguggcacgugaccagaggagcuguccugauguaccagggcaagaggcucgagccgaguugggccagcgugaaaaaggacuugauuuccuacggugggggauggcgacugcagggcucuuggaauacaggcgaggaaguucaggugaucgcagucgagccugggaaaaaccccaagaaugugcaaaccgccccaggaacauuuaaaacucccgaaggugagguaggcgcuauagcccucgauuucaagccugggaccucgggaagcccaaucgucaaccgggaaggcaagauugugggucuguaugggaauggaguugugacgacaucaggcacuuacgucuccgcaaucgcucaggccaaagcgagucaggagggcccccuuccugagauugaagacgagguguuucgcaagagaaaccugaccaucauggauuugcacccggggucuggaaaaacaaggcgguaucuaccagccauaguucgagaagcaauuaagagaaaacugcgcacccucaucuuagcucccacuaggguggucgccagcgagauggcugaagcacugaaggguaugccuauccguuaccaaaccacagccgugaaguccgagcauacgggcaaagagauuguagaccuuaugugccacgccacuuucaccaugcggcugcucucaccagcuagagugcccaauuauaacaugaucauaauggaugaagcgcauuuuacagacccuucuagcauugcagccaggggguacaucaguacccgcguuggaaugggcgaggcugccgcaauuuucaugacugccacaccgcccgguuccgucgaggcuuuuccacagagcaaugcggugauccaggaugaggaacgagacauaccugagagaucuuggaacucaggguaugaguggauuaccgauuuccccggaaagacggugugguuugucccauccaucaaaaguggcaaugacaucgccaacuguuugcggaagaauggcaaaaggguaauucagcugagccgcaagacuuucgauacagaauaccaaaagaccaaaaacaacgacugggacuacgugguuaccacugauaucucggagaugggggcaaauuuccgugcugacagagugauugauccucggaggugccucaagcccgucauacugaaagacggaccagaacgcgugauccuugccgguccgaugccuguuacaguggcaucugccgcucagcgaagaggccggauugggaggaaccacaauaaggagggagaucaguauaucuacaugggccagccccuaaacaaugacgaggaucaugcccacuggaccgaagcgaaaaugcuguuggacaacaucaauacaccagaggguauuauacccgcauuauuugaaccugagcgcgaaaaguccgccgcuaucgauggggaguauagacugaggggcgaggcccggaagacuuucgucgaacucaugcgucgcggagaccugccaguguggcuuagcuacaaaguagcuucagagggcuuucaauauagugaucgaagauggugcuucgacggggaaaggaacaaucaggugcuggaggaaaacauggauguugagauuuggacgaaggagggagaacggaaaaagcuccgccccagaugguuggacgcaaggaccuacucugacccucuggcccuacgggaguuuaaagaguucgcugccggucgaagauccgucagcggcgaucugauccucgagauugggaaacuuccgcagcaccugacacagcgcgcacaaaaugcguuagacaacuuggugaugcugcauaauucagaacagggaggcagggccuaucggcacgcuauggaggagcucccagauacuaucgaaacccugaugcuucuggcccucauagcaguguugacagguggggucacccuguuuuucuuaaguggccguggacuaggcaaaacuagcaucgggcugcucuguguuauggcuuccucugugcuucuguggauggccagcguagagccccauuggauugcagccuccaucauuuuggaauuuuuccugauggugcuccugaucccugagcccgacagacagaggacgccacaggauaaccaacuugcuuacgucgugauaggacuccuguuuaugauuuugaccguugcggccaaugagaugggucuguuagaaacaacuaagaaggaccuaggcaucgggcacguggcagucgagaaccaccaucacgcugccaugcuggauguagaccuccauccugccucagcauggacccuuuacgcuguggccacaaccauuaucacucccaugaugcgccacacaauagaaaacacgaccgcgaauaucucucugacugcuauugccaaccaggcagccaucuugaugggacuggauaaaggcuggccaauuaguaagauggacaucgguguuccucuccuggcucuugggugcuauagccaggugaauccguuaacacugaccgcagccguccucauguugguggcgcauuacgcuauaauuggccccggacugcaagccaaagcaacccgggaggcccagaagcgaacagcugccggcaucaugaaaaacccaacugucgaugggaucguggcaauugaccuagauccuguuguguaugacgcuaaguucgaaaagcagcugggacagaucaugcuccuuauacuguguacgagccaaauuuugcugaugagaaccacaugggcccucugcgaguccaucacucuggcgaccggccccuuaacaacccuuugggaggguucuccagggaaauuuuggaauacuacgauugccguaucaauggcaaacaucuucaggggaagcuaccuggcuggcgccggucucgcauucucccuaaugaagagucugggcgggggacgccggggcacaggggcucagggagaaaccuugggcgagaaauggaagagacagcugaaucagcucucuaaaagcgaauuuaacacuuauaagcguucagguauaauggagguggacagguccgaagccaaggaggggcuuaaacggggagagaccacaaagcacgccgucagucgcggcacugcgaaacugcgaugguucguugaaagaaauuuggugaagccugaggguaaagucaucgaucugggcugugggaggggaggcuggagcuacuauugcgcugggcucaagaaggugaccgaaguaaaaggauacacaaagggcggucccgggcacgaggaaccgauuccaauggcaacguacggauggaacuuagugaaacugcauucuggcaaggacguauuuuucaucccucccgagaaaugugauacccuucugugcgacauuggcgaguccucaccaaaucccacuaucgaagaggggcggacacuacgcgugcucaagauggucgaaccuuggcugagaggaaaccaauuuuguauuaaaaucuugaauccguauaugcccagcguggucgagacccuggagcagaugcagaggaagcacgguggcaugcucgugcgaaacccacuuucgagaaauucuacucaugaaauguacuggguuaguugcgggacaggaaacauaguauccgccgugaauaugaccagccguaugcuguuaaacagauucacgauggcucaccgcaagccuaccuaugagagggaugucgaccugggcgccgguacacggcacguggcaguugaacccgagguggccaacuuggauauuaucgggcagagaaucgaaaauauuaaacaugagcacaagucaacuuggcauuacgacgaggauaacccuuauaaaaccugggcuuaccacggauccuaugaagucaagccaucuggcagcgcgaguuccauggugaauggcguagugaaacuccugacaaagcccugggacguuauaccuauggucacucaaaucgccaugaccgauacaaccccauuugggcagcagcgcguguucaaggagaaaguggacacuaggacgcccaaggcaaaacgaggaacagcucaaauuauggaagucaccgccaaguggcuaugggguuuucuuagccggaacaaaaagccgagaaucuguacuagggaggaguucacccgcaagguucguucuaaugcagccauuggcgcuguguuuguagacgagaaccaguggaacucagccaaagaggcgguggaagaugagcgguucugggaccugguccauagagaaagggagcuccacaagcaggggaaaugcgcaacaugcguguacaacaugaugggaaagcgcgagaagaagcugggcgaguuugguaaggccaaagggagucgagcuaucugguacaugugguugggagcccgguuccuggaguucgaagcacucggcuuuaugaaugaggaucacugguucuccagagaaaacagccuuucuggcguugagggggagggacugcauaaguuagguuauauacugagggacaucucgaaaauuccuggcgggaauauguacgcugaugacacggccggaugggauacccgcaucacugaagacgauuugcagaacgaggcuagaauuacagacaucauggaaccagagcacgcccuccuggcaaagucaauauuuaaacuaaccuaucaaaauaaggugguccgggugcagaggcccgcgaaaaacggcacuguaauggauguuauuagccgucgagaccagcgcgguuccggacaggugggaacauacggccuuaauaccuucacaaacauggaagcccaacugaucagacagauggagagugagggcaucuuuucuccuagcgaacucgagacuccaaaccuggcugaacgggucuuggauugguuagagaaguaugggguggaaaggcugaagcgcauggccauuuccggagacgacuguguggucaaacccauagaugacagauucgcaaccgcucucacggcccuuaaugauauggguaagguucggaaagacaucccgcagugggagccuucaaagggcuggaacgauuggcagcaagugcccuuuugcagucaucacuuccaccagcugauuaugaaagacgggagggagaucguagugccaugucgaaaucaggaugagcuagucggacgugcaagagugucucagggcgccgguuggagccugcgcgagaccgcgugccucgggaaguccuacgcucaaauguggcaguugauguauuuucaucggagggaccugagacuugccgcaaacgccauuuguucagcuguuccuguggauuggauccccacaagccgcacuaccuggucuauacacgcccaucaccaguggaugacaacugaagacaugcuguccgucuggaaucggguguggaucgaggaaaacccauggauggaggauaagacccauauuaguagcuggggagacguacccuaccucggcaaaagggaggaccaauggugcggcucguuaaucgggcugacggcacgagcuacaugggccaccaauauucagguugcgaucaaccaggugagacgguugauuggaaaugaaaacuaccuggauuauaugacuuccaugaagagguucaaaaaugagucugacccugaaggugcucucugguga

SEQ ID NO: 13663 - RNA, 9879 nt, Artificial Sequence
  derived and/or modified CDS sequence (opt3) from DENV-1__FJ410226__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagauaagccugucaacauagaggccgaaccacccuucggcgaguccuauauugugaucggugcuggggagaaagccuugaagcugucaugguuuaagaaaggcaguagcaucggaaagauguucgaagcaaccgccagaggcgcuaggcggauggccauucucggggacacugcaugggauuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgacucaggaugcgucguuaacuggaaaggccgcgagcugaagugugguagugggaucuuugugacaaaugaagugcacacuuggaccgagcaauauaaguuccaggcagacagcccgaaaagacuuuccgccgcuaucggaaaggccugggaagagggcguaugcgguauuaggucugcaacgcgguuggagaacauaauguggaaacagaucucgaacgaacugaaucauauucuccuggagaacgauaugaaguuuacagucgugguuggcgacguggcugggaucuuagcccagggaaaaaagaugauucgcccucaacccauggaauacaaauauagcuggaaguccuggggcaaggcgaaaaucauaggggccgauguccagaauaccacuuucaucauugacggaccaaacaccccugagugucccgaugaccagagagcuuggaauaucugggaaguggaggauuacggcuuugguauuuucacaacuaacaucuggcugaagcuuagggacucauauacccagguuugcgaucaccguuugaugagugcagccauaaaagacucuaaggcugugcacgccgauaugggguacuggauugagagcgaaaaaaaugagacauggaagcucgcacgggcguccuucaucgaaguaaagacguguauuuggccaaaaucacauacccuguggagcaacggaguccuagagucugaaaugaucauacccaagaucuauggcgguccuauuucccaacacaauuaccgaccaggcuacuuuacucagacagccgggccguggcaucugggaaaacucgagcuggacuucgaucuuugcgagggcaccacugugguggucgacgaacacugcgggaacagaggacccaguuugaggacaaccacgguuacuggcaagaucauucacgagugguguugccgcagcuguacccugccuccauuacgguuuaaaggugaagacgggugcugguauggaauggagaucagacccgugaaggagaaggaagagaaucucguaaaaucuaugguguccgcuggcucaggugaagucgauaguuucagccugggccuucuguguauaucgauuaugaucgaggaagugaugaggucccgcuggucucgaaagauguugaugacagggacccucgccguuuuuuuccugcuaaucaugggacagcugacuuggaacgaccucauucggcugugcaucauggugggcgcaaaugcuagcgaucguauggggaugggaacaaccuaccuugccuugauggcaacauuuaaaaugagaccuauguucgccgucggccuguuauuuaggcgccucacuucacgggaggugcugcuucugaccauuggucuaagucucguugcuuccguggagcugccaaacucuuuggaagagcugggggacggauuagcgaugggcauaaugauccucaagcugcuuacggauuuccaaagccaucagcugugggccacauugcucucccugaccuuuauuaaaacuaccuucucacuacacuaugcauggaagacaauggcuaugguccugagcaucguaagucuuuuuccccucuguaugucuacuaccucccagaagacgacauggcugccgguguugcugggcagcuuagggugcaaaccucucaccauguuccugauugccgaaaauaagaucuggggaagaaaaucguggccacuuaacgaggguauaauggccguuggcaucgugucaauucuguugucuagucuccugaagaacgacgucccccuagcugggccucugaucgcaggaggcaugcuuauugccuguuacgugaucuccgguagcucugcggaucucagccuggaaaaagcugccgagguauccugggaggaagaggcagaacauucaggggccagucacaauauauugguggagguccaggacgauggaacuaugaagauuaaagacgaagagagggaugacacauuaaccauccugcucaaggcuacucugcuugcaguuagcggcguguauccccugucuaucccagccacauuguucgugugguacuuuuggcaaaagaaaaagcagcgauccggcguccuaugggauaccccuucacccccagagguggaacgcgcgguucuggacgacgggauuuaucggauaaugcagagaggacuccuggguaggagucagguaggcgugggggucuuccaagagaacguguuucauacgauguggcacguuacucguggagcugugcuuauguaccagggcaaacgcuuagaaccgagcugggccuccgucaagaaagaucugaucucuuacggugggggauggcggcuccagggcucguggaauaccggcgaggaggugcagguaauugcagucgaaccugggaagaaccccaagaaugugcaaacagccccaggaaccuucaaaacaagcgagggugaaguuggcgcuaucgccuuggacuuuaagcccgggacuucaggauccccuauugugaacagagagggcaaaaucgucggucuguaugggaauggagugguuaccacgaguggcacauacgugucugcaauagcucaggccaaggcgagccaggaaggcccacuccccgagaucgaggaugaagucuucaggaaacgaaaccugacuauuauggaccuucacccuggguccggaaagacccggcgcuaucugccggccaucgugagagaggcaauuaagaggaaauugcggacacuaauccuggcuccaacccgaguaguggccucagaaauggcugaggcacucaaggguaugcccauaagauaccaaacuaccgccguuaaaucugaacauacaggcaaggagauugucgauuuaaugugccacgccacguuuacuaugcgccugcuuagcccugugagggugccaaauuauaacaugaucaucauggacgaggcucauuucaccgaucccaguuccauugcggcacguggguacaucagcacacgggucggaaugggcgaagccgcugccauauuuaugaccgcaacuccuccggguucuguagaggccuucccccagucaaaugcugugauucaggacgaagagagagauaucccagaaagguccuggaacaguggguaugaguggauuacagacuuuccuggaaaaaccguuugguucgugcccagcaucaagucgggcaaugauauagcgaacugucugcgcaagaauggcaaacgagucauucagcucucuagaaagacguucgacacugaguaccaaaaaacaaagaacaacgacugggauuacgugguuaccaccgacaucuccgaaaugggggccaauuuucgggcagauagggugaucgacccacgccguugcuugaaaccugucauucugaaggauggacccgagagagugauccucgcugguccaaugccgguaacuguggccagcgcagcccagcggaggggccgcauugggcgaaaccacaauaaggaaggagaccaguauguuuacaugggccagccucugaacaaugaugaggaccaugcucacuggacagaggccaaaaugcuucuagauaacauaaauacccccgaagguaucauuccagcgcuguucgagcccgaaagagagaagucagcagccaucgacggggaauaucgguugaggggcgaggcucgcaaaacauuugucgaguuaaugagaaggggagaucugccuguguggcucaguuacaagguggccucugaaggcuuccaauauuccgaccggcguuggugcuuugauggggagcgcaacaaucagguccuggaagagaacauggacguugaaaucuggacuaaagagggagagcgaaagaaacuuagaccaagguggcuggacgcucggacguacagcgauccccucgcauugcgcgaauucaaggaguuugccgcugguagaaggucagugaguggcgaccugauucuagaaauagggaagcugccucagcaccucacccagcgggcccaaaaugcacuugauaaccugguaauguuacauaauagcgagcagggaggccgagcguauagacacgccauggaagaguugccggacacaaucgagacucugaugcuccuggcucuuauugccgugcugaccgguggggucacacucuucuuuuuguccggccgcggacugggcaaaaccucuaucggguuacuaugugugauggcaagcuccguucugcucuggauggcuucaguggaaccacauuggauugccgcaucuaucauacuugaguucuuucugauggucuugcugauccccgaaccugauaggcagcggacuccccaggacaaccaacucgccuacguagugauuggacugcuuuucaugauccucacgguugcugcgaaugagaugggucuguuggagaccacaaagaaagaucugggcauugggcacguggccgucgaaaaccaccaucacgcagcuauguuagacguggaucuacauccagccagugccuggacucuguacgcagucgcuaccacaaucauaaccccuaugaugcgucacacuauugagaacacaacggccaauaucucgcucaccgcgauugcuaaccaggccgcaauccuuaugggacuggacaagggcuggcccauaagcaaaauggauaucggugugccauugcuggcccucgggugcuauucccagguuaauccucugacucuuacagcugcaguguuaaugcugguagcccauuacgcgauuaucggcccgggacuccaagcuaaggccaccagagaagcacagaagaggaccgccgcuggcauuaugaaaaaccccacaguggacgggaucgucgccauagauuuggacccaguuguguaugacgcaaaguuugagaaacagcugggacagauuaugcuacugauccucuguacuucucaaauccuucugaugcgcacgaccugggcuuugugcgaaucaauuacacuggccacuggcccucucaccacacugugggaggguagccccgggaaguucuggaauaccacuaucgcggucuccauggccaacauauuccggggaaguuacuuagcaggcgcuggucuugccuuuucucugaugaaaagccucggcgggggacgaagaggcacgggggcacagggagagacacuaggcgaaaaguggaagaggcagcugaaucaguugucaaaauccgaguucaacaccuauaagcgcagugguauuauggaaguggaucggagcgaggcuaaagaagggcugaagagaggagagacuaccaaacacgccguaucucguggcacagccaagcucaggugguuuguggagcggaaucuuguuaagccagaagguaaagugaucgaccugggcugugggcgcggaggcugguccuacuauugcgcgggguugaagaaagucacugaggugaagggauacaccaaaggcgguccugggcacgaagagcccauuccgauggcuacauacggauggaaccuggucaagcuccauucaggcaaagauguguucuuuaucccaccugaaaagugugacacguuacugugcgauauaggcgagagcucgcccaauccaaccaucgaggaagggcgaacucuuagaguucugaagaugguagagcccuggcuaaggggaaaccaauucuguauuaaaauccucaauccuuauaugccgucuguggucgaaacacuggagcagaugcagcggaagcacgguggcauguuggugcgcaacccccugaguagaaauuccacccaugagauguacuggguuagcugcgggacuggaaacauugugucagcagucaauaugacauccaggaugcuccuuaaccgauuuaccauggcccaccggaaaccaacguaugaacgugacguggaucugggcgcugguaccagacacguagccguggagccugaaguugcaaacuuagacaucauugggcagcgcaucgagaauauaaagcaugaacacaaaucuacauggcauuacgaugaggacaaccccuauaagacuugggccuaccacggaagcuaugaggucaagccuaguggcuccgcuagcucuauggugaauggcguggucaaacuguugaccaagccaugggauguuauucccauggugacacaaaucgcgaugacugacaccacaccuuucgggcagcagaggguauuuaaagaaaagguggacacccggacuccaaaagccaagagaggaacggcacaaaucauggaggucacagcuaaguggcucugggguuuccugucacgcaacaaaaagcccaggauuuguacccgagaagaguuuacucggaaagugagaaguaaugccgcaauaggcgccguuuucguggaugaaaaccaguggaauuccgcuaaggaggccgucgaggacgaaagguuuugggaucuagugcaucgcgagcgugaacuucacaaacaggggaagugcgcgaccugcguauacaacaugaugggaaagcgggagaaaaagcugggcgaauucgguaaagcaaaggggagcagagccaucugguacauguggcucggagcuagguuccuggaguuugaggccuugggcuucaugaaugaagaccacugguuuucucgcgagaacucgcugucaggcguugaaggggagggacuccauaaacuugguuauauucugcgagauaucagcaagauuccgggcgggaauauguacgcagacgauacagcuggaugggacacgcggaucaccgaggaugacuuacagaacgaagccaaaauaacugauaucauggagccugaacacgcucuguuggccaaguccauuuucaagcucacauaucaaaauaaaguggucagagugcagaggccagcaaagaacggcaccgugauggacgucaucagucgcagagaucagcgggguucugggcagguuggaacuuacggccugaauacauuuaccaacauggaggcgcaacuaauuaggcagauggaaagcgagggcaucuucucccccucagagcuugaaacaccuaaccuggccgggcgugugcucgacuggcuggagaaacauggaguagaacgauugaagcgcauggcuauaaguggugacgauuguguggucaaaccaauugacgauagauuugccacugcauuaaccgcucugaaugacaugggcaaggugcggaaggauaucccccagugggagccgucuaaaggguggaacgacuggcagcaaguuccuuucugcagccaccacuuucaucagcucaucaugaaggauggaagggaaauugugguccccugucgcaaucaggacgagcuugugggcagagcccggguaucccagggugcaggguggucacugagggagacggccugccuaggaaaaagcuaugcgcaaauguggcagcugauguacuuccaccgacgugaucucagauuggcugccaacgcaauauguucugccguuccaguggacugggucccuaccucccgcacaacuuggaguauccaugcucaccaucaguggaugaccacagaagauaugcugagcguguggaaucggguuuggauugaggaaaaccccuggauggaggacaagacucacaucucguccuggggcgacgugccauaucuuggcaaaagggaagaucaauggugcgggucucugauuggacucaccgccagagcaacgugggcuacaaauauccaggucgccauaaaccaggugcgccgguuaaucgguaaugagaacuaccuggacuacaugaccucaaugaagagguuuaagaaugagagcgaucccgaaggcgcguugugguga

SEQ ID NO: 13664 - RNA, 9879 nt, Artificial Sequence
  derived and/or modified CDS sequence (opt3) from DENV-1__FJ410227__SS-prME
agcgugaccaugcugcuaaugcuuaugcccacagcacuggcuuuccacuugacuacgcgaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucuacgacacgguuggaaaacaucauguggaagcagauuucgaacgagcugaaucauauccuccuggaaaacgacaugaaauuuaccguagucgugggcgauguugcagggauuuuagcucagggaaagaaaaugauccgcccucagcccauggaguacaaguauagcuggaaguccuggggcaaagccaagauaaucggggcggacgugcaaaauacuaccuucauuaucgauggaccaaacacaccugaaugucccgacgaucagagagccuggaauauuugggaggucgaggacuacggcuuugguaucuucacuaccaacauauggcugaaacuuagggauucauauacacaggugugcgaccaccguuugaugagugcugcaauuaaggauucuaaagccguucacgcugacaugggguacuggaucgaaagcgagaagaaugaaacguggaagcucgcccgggcauccuucauugaggugaaaaccuguaucuggccaaagucacauacucuguggagcaacggaguacuagaaucugagaugauaauccccaaaauuuauggcgguccuaucucccagcacaauuaccgaccaggcuacuuuacacaaaccgcggggccguggcaucugggaaagcucgagcuggauuucgaccuuugcgaaggcacuacagucgugguggaugagcacugcgggaacagaggacccaguuugaggaccacgacugucaccggcaaaauuauccacgaaugguguugccgcagcuguacacugccuccauuacgguuuaagggugaggacgggugcugguauggaauggagauaagacccguuaaggaaaaagaggaaaaucucgugaagucuaugguauccgccggcucaggugagguggacaguuucagccugggccuucuguguauuucgaucaugaucgaagaggucaugaggucccgcuggucucgaaaaauguugaugaccgggacucucgcuguguuuuuccugcuaauuaugggacagcugacauggaacgaucucauccggcugugcauuaugguuggcgccaaugcaagcgaccguauggggaugggaaccacauaccuugcuuugauggccacuuuuaagaugagaccuauguucgcagugggccuguuauuuaggcgccucaccucacgggagguccugcuucugacgauaggucuaagucucguggccuccguugaacugccaaacucuuuggaggaacugggggauggauuagcuaugggcaucaugauucucaaacugcuuacagacuuccagagccaucaacugugggcgaccuugcucucccugacuuuuaucaagaccacauucucacuacacuaugccuggaagacuauggcaauggugcugagcauugucagucuuuuuccccucugucugucuaccacgucccagaaaacaaccugguugccgguacuguuaggcagccucgggugcaagccucugacuauguuccuuaucgcugagaauaaaauauggggaagaaagucguggccacugaacgaagguaucauggccgugggcauuguuucaaucuugcucucuagucugcucaagaaugaugugccccuggccgggccucuuauugcuggaggcaugcucaucgcauguuacgucauauccgguagcucugccgaccugagcuuggagaaggcggcugagguguccugggaagaggaagccgagcauucaggggcaagucacaauauuuuaguagaagugcaggaugacggaacaaugaaaaucaaggaugaggagagggacgauacccugacuauccuccugaaggccacacuucuggcugucagcggcguuuaucccuugucuauuccagcaacccuauucgugugguacuuuuggcagaaaaagaaacaacgauccggcgugcugugggacacgccuucacccccagaagucgagcgcgccgugcucgaugacgggauauaucggaucaugcagagaggacugcuugguaggagucagguuggcguagggguguuccaggaaaacgucuuucauacuauguggcacgugacccguggagcgguuuuaauguaccaaggcaagcgccuggagccgagcugggcuuccgugaaaaaggaccucauuucuuacggugggggauggcgguugcagggcucguggaauacaggcgaggaaguccaggugaucgccguagagccugggaagaaccccaaaaauguccagaccgcaccaggaacauucaagacuagcgaaggugaggugggcgccauugcucuggauuuuaaacccgggaccucaggauccccuaucguuaacagagaaggcaagauagugggucucuaugggaauggagucgugacgacaaguggcacuuacguuucugccaucgcacaagcuaaagccagccaggagggcccacugcccgagauugaagacgagguguucaggaagcgaaaccuuaccaucauggaucugcacccuggguccggaaagacacggcgcuauuugccggcgauugucagagaagccaucaaaaggaagcuacggacccugauacucgcaccaacucgagugguagcuucagagauggccgaggcuuuaaaagguaugcccauuagauaccagaccacagcagugaagucugagcauacgggcaaagagaucguugaccugaugugccacgccacuuuuaccaugcgccuucugagcccugucagggugccaaauuauaacaugaucauuauggaugaagcccauuucacagaccccaguuccaucgcugcgcguggguacauaagcacccgggugggaaugggcgaggcagccgcuauuuuuaugacugccacaccuccggguucugucgaagcauucccccaaucaaaugccguaauccaggaugaggaaagagacauuccagagagguccuggaacaguggguaugaguggaucaccgauuuuccuggaaagacggugugguucguucccagcauaaagucgggcaaugacauugcuaacugucuccgcaaaaauggcaagcgagugauccaguugucuagaaaaacuuucgauacagaauaccagaagaccaaaaacaacgacugggacuacgucgugaccacugauaucuccgagaugggggcgaauuuucgggccgacaggguuauugauccacgccguugccugaagccugugauccucaaggacggacccgaaagagucauucuggcagguccaaugccggugacaguagcuagcgccgcacaacggaggggccgcauagggcgaaaccacaauaaagagggagaucaguauaucuacaugggccagccucuuaacaaugacgaggaucaugcccacuggaccgaagcuaagaugcuacuggacaacauuaauacacccgaggguaucaucccagccuuguucgaacccgagagagaaaaaucagcggcaauugauggggaguaucgguuaaggggcgaggcccgcaagacuuuuguggaacugaugagaaggggagaccucccuguuuggcugaguuacaaagucgcuucugagggcuuccaguauuccgaucggcguuggugcuuugacggggaacgcaacaaucaagugcuugaggaaaacauggauguggagauauggacgaaggagggagaaagaaagaagcugagaccaagguggcucgacgcccggaccuacagcgaccccuuggcucugcgcgaguucaaggaauuugcagccgguagaaggucagucaguggcgaucuaauccuggagauugggaaacucccucagcaccuuacacagcgggcucagaaugcccuggacaacuuaguuauguugcauaauagcgaacaaggaggccgagcauauagacacgcgauggaggagcugccggauacuaucgaaacccucaugcugcuugcccugauugcugugcucacaggugggguaaccuuguucuuucuguccggccgcggauuaggcaagacuucuaucgggcuacugugugugauggccagcuccguccuccuuuggauggcaucaguggagccacauuggauagcugccucuaucauucuggaguucuuuuugaugguucugcucauccccgagccugacaggcagcggacgccccaggauaaccagcuggcauacguggucauuggacuucucuucaugauccugaccguagccgcuaaugagauggguuugcuggaaacaacuaaaaaggacuuaggcauagggcacguggcggccgagaaccaccaucacgcagcuaugcuagauguugaccugcauccagccagugccuggacccucuacgcaguggcuacaaccauuaucacuccuaugaugcgucacacaauugaaaacacgaccgccaauaucucgcuuacugcgauagcuaaccaagccgcaauccugaugggauuggauaaaggcuggcccauuagcaagauggacaucggugucccacugcucgcccuggggugcuauucccaggugaauccucuuacauuaaccgcugcaguccugaugcucguggcccauuacgcgauuaucggcccgggauugcaggcuaaggccaccagagaggcacagaaaaggacagccgcuggcauaaugaagaaccccacuguugaugggauuguggccaucgaccuggauccaguaguguaugacgcaaaauuugaaaagcagcuaggacagaucaugcugcucauucuuuguacgucucagauccuguugaugcgcaccacaugggcucugugcgagucaauaacucucgccaccggcccucugacaaccuuaugggaggguagccccgggaaauucuggaauacuacgauugcggucuccauggccaacaucuuccggggaaguuaccuugcaggcgcuggucuggccuuuucucucaugaaaagccuaggcgggggacgaagaggcacaggggcacaaggagaaacccugggcgagaaguggaaaaggcaguugaaucagcugucaaaguccgaguucaacacuuauaaacgcagugguauuauggagguugaccggagcgaagcuaaggaggggcucaaaagaggagagaccacaaagcacgccgugucucguggcacugccaaacuuaggugguuugucgaacggaaucuggugaaaccagaggguaagguaaucgauuugggcugugggcgcggaggcugguccuacuauugcgcggggcugaaaaaggugaccgaaguuaaaggauacacaaagggcgguccugggcacgaggaacccauaccgauggcuacguacggauggaaccucgugaaauuacauucaggcaaggacgucuucuuuaucccaccugagaagugugauacccugcuuugcgacauuggcgagagcucgcccaauccaacuaucgaagaggggcgaacacugagagugcuaaaaauggucgaacccuggcucaggggaaaccaguucuguauuaagauccugaauccuuauaugccgucugugguugagaccuuggagcaaaugcagcggaaacacgguggcaugcugguacgcaacccccucaguagaaauuccacucaugaaauguacugggugagcugcgggacaggaaacauugucucagcagugaauaugaccuccaggaugcuucugaaccgauuuacgauggcccaccggaagccaaccuaugagcgugauguugacuuaggcgcugguacaagacacguggccgucgaaccugagguggcaaaccuggauaucauagggcagcgcauugaaaauaucaaacaugagcacaagucuacuuggcauuacgacgaggauaaccccuauaagaccugggccuaccacggaagcuaugaaguaaaaccuaguggcuccgcuagcucuauggugaauggcguugucaaguugcucacaaaaccaugggacgugauccccauggugacucagauugcgaugaccgauacaaccccuuucgggcaacagagggucuuuaaggagaaaguugacacucggacgccaaaggccaagagaggaacagcacagauaauggaagugaccgcuaaauggcugugggguuuccuaucacgcaacaagaaacccaggaucuguacucgagaggaauuuacccggaagguaagaaguaaugccgcaauuggcgccguguucgucgacgagaaccaauggaacuccgcuaaagaggccguggaagaugagagguuuugggaccuuguucaucgcgaacgugagcugcacaagcaggggaagugcgcgacaugcguguacaacaugaugggaaaacgggaaaagaaacucggcgaguucgguaaggcaaaagggagcagagccaucugguacauguggcugggagcuagguucuuggaguuugaagcccugggcuucaugaaugaggaucacugguuuucucgcgaaaacucgcucucaggcgucgagggggagggacuucauaagcuggguuauauuuuacgagacaucagcaaaauaccgggcgggaauauguacgcagaugacacggcuggaugggauacccggaucacugaagacgaucugcagaacgaggccaagauuacagacaucauggaaccugagcacgcuuugcucgccaaguccauuuucaaacugaccuaucagaauaaggugguaagaguucaaaggccagccaaaaacggcacugugauggaugucaucagucgcagagaccagcgggguucuggacaggugggaacauacggccuaaauaccuuuacaaacauggaagcgcagcuuauaaggcaaauggagagcgagggcauuuucucccccucagaacuggagacuccuaaccucgccgggcgugugcuggauugguuggaaaagcauggagucgagcgauuaaaacgcauggcuaucaguggugacgacuguguugugaagccaaucgaugacagauuugccaccgcacugacggcucucaaugauaugggcaagguacggaaagacauuccccagugggaaccgucuaagggguggaacgauuggcaacaggugccuuucugcagccaccacuuucaucaacuuauaaugaaagacggaagggagaucgucgugcccugucgcaaucaggaugagcugguuggcagagcccgggugucccagggugcaggguggucacuaagggaaaccgccugccugggaaagagcuaugcgcagauguggcaacucauguacuuccaccgacgugacuugagacuggcugccaacgcaauuuguucugccgucccaguggauuggguaccuacaucccgcacuaccuggaguauccaugcucaccaucaguggaugacaacugaggacaugcuuagcguuuggaaucggguguggauugaagagaaccccuggauggaagauaaaacccacaucucguccuggggcgacgucccauaucugggcaagagggaggaccaguggugcgggucucucauaggauuaacggccagagcaacaugggcuaccaauauccaaguggccauuaaccagguucgccggcugaucgguaaugagaacuacuuggauuacaugacuucaaugaagagguuuaaaaaugaaagcgaccccgagggcgcgcugugguga

SEQ ID NO: 13665 - RNA, 9879 nt, Artificial Sequence
  derived and/or modified CDS sequence (opt3) from DENV-1__FJ859029__SS-prME
agcgugaccaugcugcucaugcuuaugcccacugcccuggcuuuccacuugacuacgagaggaggggaaccucauaugaucgucuccaagcaggaaaggggaaagucuuuacuguuuaagaccucagcugguguuaacaugugcacucuaauugccauggaccucggcgaguucugugaagauacuaugaccuacaaaugcccgcggauaaccgaagcggaaccggacgauguggacuguuggugcaaugcuaccgauacuuggguaaccuaugggaccuguagucagacgggagaacaccgccgagacaagcguagcguggcccuggcaccccaugucggccuuggucuggagacuagaaccgaaacauggauguccucugagggggccuggaaacagauccagaagguggaaacuugggcuuugaggcacccuggauuuaccguuauugcacucuuccuggcccaugcuaucggcacgucgauuacccagaagggcaucauauuuauccugcucauguuagugacgccaucaauggccaugcggugcgucgggauuggaagccgcgauuucguggagggucugaguggcgcgacuuggguagacguugugcuugagcacggguccugugucacaaccauggcaaaagauaagcccacuuuggacaucgaacugcuaaaaacagaggugaccaacccugccgugcucagaaagcugugcauugaagcuaaaaucucuaauacgaccacagauaguagguguccaacucaaggagaggccacccuugucgaagaacaggacgcaaacuuuguuugccggcgcacauucguggaucgaggcugggguaauggguguggacuguuuggcaagggcuccuugauaacuugcgcuaaguucaaaugcguaaccaagcucgaggggaaaacagugcagcacgaaaaccugaaguacucagucauugugaccguucauacuggagaccagcaccaaguggguaaugagaguacggaacauggcacaaccgccacuaucacaccccaggcgccuagcacagagauucaguuaaccgacuauggggcccugacucucgauuguucuccaagaacaggacuugacuuuaacgaaaugguccuguugacgaugaaagagaaguccuggcuagugcacaaacagugguuccuggaucucccgcugcccuggaccucaggcgcaagcacaagccaagagacauggaauaggaaggaccuucugguaaccuuuaagacagcucacgccaaaaagcaggaaguuguggucuuggguucucaggagggggcuaugcauacugcccucaccggcgcaacggaaauccaaaccuccggaacaacuaccaucuucgccggccaccugaaaugccgguuaaagauggauaaacugacacuaaaggggacuagcuacgugauguguaccggaucguucaagcucgagaaagaagucgcugagacgcagcaugguacagugcugguucagauuaaguaugagggcaccgacgcgccuugcaaaauaccauuuucuacucaggaugaaaagggggugacacaaaacggacgucuuaucaccgcaaaucccauuguaacugacaaagagaagccugucaacaucgaagccgagccacccuucggcgaguccuacauagugauuggugcuggggaaaaggccuugaaacugucaugguuuaagaaaggcaguagcaucggaaagauguucgaggcaaccgcccgcggcgcuagaaggauggccauccucggggauacagcaugggacuuuggauccauugguggcguuuucacgucuguggggaaacugguccaccagaucuuuggaaccgcguauggcgugcuuuucagcgguguaucauggacuaugaagauugggauaggcgugcuguugacauggcucggacugaauagucgguccaccagcuuaucuaugacauguaucgcuguuggccuggucacucuauaccucggggugauggugcaggccgauucaggaugcgucauuaacuggaagggccgagaacugaaaugugguagugggaucuuuguuaccaaugaggugcauacguggacagaacaguacaaguuccaagcagacagcccgaaacgccuuuccgccgcuaucggaaaggccugggaggagggcgugugcgguauuagaucugcaaccagguuggaaaacauaauguggaaacagaucucgaacgagcugaaucacauucuccuggaaaacgacaugaaguuuacuguagucgugggcgauguugcugggaucuuagcccagggcaagaagaugauucggccucagcccauggaguauaaguacagcuggaaauccuggggcaaggcgaaaaucauaggggccgacgugcaaaauaccacauucaucauugauggaccaaacacuccugaaugucccgacgaucagcgcgcuuggaauaucugggaggucgaggacuauggcuuugguauuuucaccacaaacaucuggcugaaacuuagagauucauacacacaggugugcgaccacagguugaugagugcagccauaaaagauucuaaggcuguucaugccgacaugggguauuggauugaaagcgagaagaaugaaaccuggaaacucgcacgugcguccuucaucgaggugaagacuuguauuuggccaaaaucacacacacuguggagcaacggaguacuagaaucugagaugaucauacccaagaucuacggcgguccuauuucccagcauaauuaucggccaggcuacuuuacccaaacugccgggccguggcaccugggaaaacucgagcuggauuucgaccuuugcgaaggcacaaccgucgugguggaugagcacugcgggaaccgaggacccaguuugagaacgacuaccgucacaggcaagaucauucaugaaugguguugcaggagcuguacccugccuccauuacgcuuuaagggugaggacgggugcugguacggaauggagauccggcccguuaaagaaaaggaggaaaaucucgugaaaucuaugguauccgcuggcucaggugagguggacaguuucagccugggccuucuguguauaucgauuaugaucgaagaggucaugagauccagguggucucgcaagauguugaugacugggacacucgccguguuucugcuacugaucaugggacagcucaccuggaacgaucugauucgacuuugcaucaugguuggcgcaaaugcuagcgaccggauggggaugggaacaacuuauuuggcccugauggcaaccuucaaaaugcguccuauguuugccgugggcuuacucuucagaaggcugacgucacgcgagguccuucugcuaacaauuggucucagucugguggcuuccguugaauugccaaacucucuggaggaauuaggggauggacucgcgaugggcauaaugauccugaaacuucugaccgacuuucagagccaccaauugugggccacucuccugucccuaaccuucauuaagacaacuuuuucacugcauuacgcauggaaaaccauggcuauggugcuuagcaucgucagucucuucccccuguguuugucuacgacaucccagaagaccacuuggcugccgguauuacucggcagccuggggugcaaaccucuuacaauguuucugauugccgagaauaagaucuggggacggaaaucguggccauugaacgaagguauaauggccgugggcaucguuucaauucuccugucuagucuacugaagaacgaugugccccuugcugggccucucaucgcaggaggcaugcugauugccuguuaugucaucuccgguagcucugcggacuugagcuuagagaaagcugccgagguguccugggaagaggaagcagagcacucaggggccagucauaauauacugguagaagugcaggaugacggaaccaugaagauuaaggaugaggagagagacgauacucucacaauccugcuuaaagcuacccuguuggcagucagcggcguuuacccccuaucuaucccagccacgcuguucgugugguauuucuggcagaagaaaaagcaaagguccggcgugcucugggacacuccuucacccccagaagucgagcgagcggugcuggaugacgggauuuaccgcauaaugcagcggggacuuuuagguagaagucagguuggcguagggguguuucaggaaaacgucuuccacaccauguggcacgugacaaggggagcuguucugauguaucaaggcaaacgucucgagccgagcugggccuccgugaagaaggacuugaucucuuacggugggggauggcgccugcagggcucguggaauaccggcgaggaaguccaggugauugcaguagagccugggaaaaaccccaagaauguccagacagccccaggaacuuuuaaaaccagcgaaggugaggugggcgcuaucgcccucgauuucaagcccgggacgucaggauccccuauuguuaaccgggaaggcaaaaucgugggucuguacgggaauggagucgugacaacaaguggcaccuauguuucugcaauagcucaagccaaggcgagccaggagggcccacuucccgagaucgaagacgagguguuuagaaagaggaaccugacaauuauggauuugcauccuggguccggaaaaacccgacgguaccuaccggccaucguccgcgaagcaauuaagagaaaacugaggacucucaucuuagcuccaacccgggugguagccucagagauggcugaagcacugaaggguaugcccauacgauaucagacaacggccgugaaaggcgagcacacugggaaggagauuguugaccuuaugugccaugccaccuucacaaugagacugcucucuccuguccgcgugccaaauuacaacaugaucaucauggaugaagcucacuuuaccgaccccagcaguauugcggcaaggggauauaucuccacucgugugggcaugggugaggccgcugccauauucaugacagcaaccccuccggggagcgucgaagccuuuccccaaucuaaugcuguaauucaggaugaggaacgggacaucccagagagaucauggaacuccggauacgaguggauuacggauuucccuggcaagacugugugguuuguucccaguaucaaaagcggcaaugacauagcgaacuguuugaggaagaaugggaaacgcgugauucagcugucgcgaaagacauucgauaccgaauaucagaaaaccaagaacaacgacugggacuacgucgugacuacagauaucucugagaugggagccaauuucagagcagaccggguuaucgauccaaggcgcugccucaagccugugauucugaaagacggucccgaacgugucauccuugcuggcccaaugccggugaccguagccuccgcagcccaaagacgggggaggauuggacgcaaccauaauaaggagggcgaucaguacauauauaugggucagccucuaaacaaugacgaggaucacgcucacuggacagaagccaaaaugcuguuggacaacaucaauacucccgaggggauuaucccagcguuauuugaacccgagcgagaaaagagcgcagccaucgauggcgaguacagacugcggggagaggcuaggaaaacguucguggaacucaugcgcagaggcgaccugccuguuuggcuuucauauaaggucgccagugagggguuucaguacucugauaggcgguggugcuucgacggagaacguaacaaucaagugcuggaggaaaacauggauguggagauuuggaccaaagagggugaacgcaagaagcuccgaccaagaugguuggacgcuaggacauauuccgacccccuggcacuacgggaguuuaaagaguucgccgcuggccgcagaagcgucucaggggaucugauacucgagaucggaaaacuuccucagcaucugacucagagggcccagaaugcauuagacaacuugguuaugcugcacaauagugaacaaggcggucgggcguaccgacaugccauggaggagcucccggauaccauugaaacacugaugcuucuggcucucaucgccguguugaccgggggcguaacucuguuuuucuuaagcggaagaggccuagggaaaacguccauuggacugcucugugugauggcaucuagcgcacuucuguggauggccuccgucgagccacacuggaucgcagccucaauaaucuuggaauuuuuccugauggugcuccugauucccgagccugaccgccagaggacaccccaggauaaccagcuugcuuauguugugaucggucuccuguuuaugauuuugacagucgcggccaaugagaugggccuguuagaaacuaccaagaaagaccuagggaucggacacguagcaguggagaaccaucaccaugcugccaugcuggauguugaccuccacccagccucugcauggacacuuuacgcuguggccaccacuauaauuacaccuaugaugcggcauacgaucgaaaacaccacugcgaauauuagucugacagcuaucgccaaccaagcagccauauugaugggccuggauaaggguuggcccaucucgaagauggacauuggggucccacuccuggcucuuggcugcuacagccaggugaauccuuuaacccugaccgcagccguccucauguugguggcgcacuaugcuaucauuggaccgggccugcaggccaaagcaacacgugaggcccaaaagagaacugcugccgggaucaugaaaaaccccacgguugauggaauaguggcaauugaccuagauccaguaguguacgacgcuaaguucgaaaaacagcugggccagaucaugcuccuuguccuguguaccucccagaucuugcugaugaggacaacuugggcccucugcgagucuauuacccuggcgacagguccuuuaaccacucuuugggaggggucacccggaaaguuuuggaauacgacaaucgccguuagcauggcaaacauauuccgcggcuccuaucuggcuggugccggccucgcauucagucuaaugaagucucuagggggaggccggcgagggaccggagcucaaggcgaaacuuugggugagaaauggaagagacagcugaaucagcucagcaaaucagaauuuaacaccuacaagagguccgggauuauggagguggaccgcagugaagccaaagagggacuuaagcggggcgagacaacuaagcacgccgucagcagagguaccgcgaaacugcguugguucguggaaaggaauuugguaaagccagagggcaaagugaucgaucugggguguggacggggcggguggucuuauuacugcgcuggacucaagaaaguuacagaagugaagggcuauacgaaaggugggccuggacaugaggaacccauuccgauggcaaccuacggcuggaacuuagucaagcugcacuccggcaaggacguguuuuucaucccaccugagaaaugugauacucuucugugcgacauaggggagucaagccccaauccaacaaucgaagagggacgcacccuacgaguccucaagaugguggaacccuggcugagagguaaccaguuuuguauuaaaaucuugaauccuuacaugccgucgguuguagagacucuggagcaaaugcagaggaagcauggcgggaugcucgugcggaacccccuuucucgcaauaguacacacgaaauguauugggucuccugcggaaccggcaacauugugagcgccguuaauaugacgucaagaaugcuguuaaacagguucaccauggcucaccgaaaaccaacauacgagcgggauguggaccugggugccgggacucgucaugucgcaguggaaccugagguagccaacuuggauaucauuggacagagaaucgaaaauauaaagcacgagcauaaguccaccuggcacuaugacgaggauaaccccuacaaaacaugggcuuaucauggcucuuacgaagcgaagccuagcggcagugccuccagcauggugaaugggguugucaaacuccugacuaagccaugggacgugauucccauggugacccagaucgcaaugacagauaccacuccuuuuggacaacagcgcgucuucaaagagaagguugacacgaggacaccaaaggcuaaacgggguaccgcccagaucauggaagugacugcaaaguggcuauggggcuuucuuucuagaaacaaaaagccccgcauuuguaccagggaggaguucacacgaaaaguacggucaaaugccgcuauaggggccguguuugucgacgagaaccaauggaauagugcgaaggaggcaguggaagaugagagauucugggaccugguucacagggaacgcgagcuccacaagcagggaaaaugcgccacgugcguguauaacaugaugggcaagcgugagaagaagcugggugaguuugggaaagcuaagggaucccgggccaucugguacaugugguugggcgcaagauuccuggaguucgaagcucucggcuuuaugaaugaggaucauugguucagcagggaaaacucucuuucgggggucgagggagagggucugcacaaauuaggcuacauucugcgcgacaucucaaagauuccagggggaaauauguaugccgaugacaccgcuggcugggauacucgaaucacagaagacgauuugcagaacgaggccaagauaaccgacaucauggaaccugagcaugcacuccuggcgaaaagcauuuuuaagcuaacuuaccagaauaaagugguacggguucaaagaccagccaagaacgguacagugauggaugucaucuccaggcgcgaccagagagggaguggacaggugggcaccuauggccuuaauacauucacuaacauggaagcucagcugauucggcaaauggagucugaggaaaucuuuagccccuccgagcucgaaaccccuaaccuggccgggaggguguuggauugguuagagaaacacggagucgaacgucugaagcgaauggcaauaucaggugacgacuguguugugaagccaauugaugaccgcuucgcuacggcccucaccgcacuuaaugauaugggcaaaguaagaaaggacaucccccagugggagccgaguaaaggguggaacgauuggcaacaggugccuuuuugcucucaccauuuccaccaacugaucaugaaggacggacgggagauugucgugcccuguaggaaucaggaugagcugguuggccgcgccagagugagccagggugcgggguggucccugcgggagacagcuugccucggaaaaucauacgcccagauguggcaauugauguauuuucauaggcgagaccugcgucuugcagccaacgcuauauguagcgccgucccaguggauuggguaccuacuucuagaaccacaugguccauccacgcacaucaccaguggaugacuaccgaagacaugcugaguguuuggaaucgcguguggauugaggaaaaccccuggauggaggauaagacgcacaucagcucguggggcgacgucccauaccucggcaagcgggaggaccaguggugcggguccuuaauuggacugacagcuagggccaccugggcgacuaauauccaaguggcuauaaaccagguuagacgcuugaucgguaaugaaaacuaucuggauuacaugacaucuaugaaacgguucaagaaugagucagaccccgaaggcgcccucugguga

SEQ ID NO: 13666 - RNA, 9879 nt, Artificial Sequence
  derived and/or modified CDS sequence (opt3) from DENV-1__FJ547065__SS-prME
agcgugaccaugcugcucaugcuuaugcccaccgcacuggcuuuccacuugacuacgcggggaggggaaccucauaugaucgucuccaagcaggaaaggggaaaaucuuuacuguuuaagaccucagccgguguuaacaugugcacgcuaauugccauggaccucggcgaacugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucuuagagccuggaauauuugggaggucgaggacuacggcuucgguaucuuuaccacaaacauaugguugaagcucagggauuccuauacacaggugugcgaccaccgucugaugucagcugcaauuaaagauaguaaggccguucacgcugacaugggguacuggaucgaaucugagaaaaaugaaaccuggaagcuagcccgggcauccuucauugaggugaagacuuguaucuggccaaaaucccauacacuguggucaaacggaguacucgaaagcgagaugauaauccccaagauuuauggcgguccuaucucucagcacaauuaccgaccaggcuacuucacccaagcggccgggccguggcaucugggaaaacuugaguuggauuuugaccugugcgaaggcacuacagucgugguggaugagcacugcgggaacagaggacccuccuuaaggaccacgacugucaccggcaagauuauccacgaaugguguugccgcaguuguacacucccuccacugcgguucagaggugaggacgggugcugguauggaauggagauaaggcccguuaaagaaaaggaggaaaaucuuguaaagagcaugguaucugcuggcuccggugagguggacucauuuagucugggcuugcucuguauuagcaucaugaucgaagaggucaugcgcucgcgauggucccggcguaugcugaugaccgggacucuagccguguucuuucugcucauuaugggacagcugacauggaacgaucuuaucagauugugcauuaugguuggcgcaaaugcuucugacaggauggggaugggaaccacauaccuggccuuaauggcaacuuucaaaaugcgcccuauguuugccgugggccuccuguuccggagacuuaccagcagggagguccugcuacucacgauaggucugucauugguggcuaguguugaacugccaaacuccuuagaggaacucggggauggacuggcgaugggcaucaugauucuuaagcuguugacagacuuucagucucaucaacucugggccacccugcuaagccugacuuucaucaaaaccacauuuucccuucacuaugcauggaagacuauggcuauggugcucucaauugucagccuguuccccuugugucugaguaccacgucucagaaaacaaccugguuaccgguacuccugggcucccuugggugcaagccucugacuauguuuuugaucgccgagaauaagauauggggacgacgcagcuggccacucaacgaagguaucauggccgugggcauuguuucgauccugcuaucaucucugcuuaaaaacgaugugccccucgcugggccucugauugcaggaggcauguugaucgccuguuacgucauaagugguuccagcgcggacuuaucucuggagaaggcugccgaggugagcugggaagaggaagcagagcauuccggggccucacacaauauucucguagaagugcaggaugacggaacaaugaaaaucaaggaugaggagcgggacgauacccugacuauccuucugaaagcuacauugcuagcagucaguggcguuuauccccugagcauuccagccacccucuucgugugguacuucuggcagaagaaaaagcaaagaucuggcgugcugugggacacgccuucacccccagaagucgagagggcggugcuugaugacgggauauaucguaucaugcagcgcggauuacugggucggagccagguuggcguagggguguuucaggaaaacgucuuccauacuauguggcacgugaccagaggagcuguucucauguaccaaggcaagagguuggagccgaguugggccagcgugaaaaaggaccugauuuccuacggugggggauggcgacuccagggcucuuggaauacaggcgaggaaguccaggugaucgcaguagagccugggaaaaaccccaagaauguccagaccgccccaggaacauuuaaaacucccgaaggugaggugggcgcuauugcccuggauuucaagccugggaccucgggaagcccaaucguuaaccgggaaggcaagauagugggucuuuaugggaauggagucgugacgacaucaggcacuuacguuuccgcaaucgcucaagccaaagcgagucaggagggcccccugccugagauugaagacgagguguuucgcaagagaaacuugaccaucauggaucuacacccggggucuggaaaaacaaggcgguaucugccagccauuguccgagaagcaaucaagagaaaacuccgcaccuuaauacuggcucccacuagggugguagccagcgagauggcugaagcacuuaaggguaugccuauucguuaccagaccacagccgugaaguccgagcauacgggcaaagagaucguugaccugaugugccacgccacuuucaccaugcggcucuugucaccagucagagugcccaauuauaacaugaucauuauggaugaagcucauuuuacagacccuucuagcaucgcggcaaggggguacauaaguacccgcgugggaaugggcgaggccgcugccauuuucaugacugcaacaccgcccgguuccgucgaagccuuuccacaaagcaaugcuguaauccaggaugaggaacgagacauuccugagagaucuuggaacucaggguaugaguggaucaccgauuuccccggaaagacggugugguuuguuccauccauaaaaaguggcaaugacauugcgaacugucugcggaagaauggcaaaagggugauccagcucagccgcaagacuuucgauacagaauaccagaagacccguaacaacgacugggacuacgucgugaccacugauaucucggagaugggggccaauuucagagcagaccggguuauugauccuaggcgcugccugaaacccgugauccuuaaggacggaccagaacgagucauucuagcugguccgaugccugugacaguagccucugcagcccaaagacggggcaggauagggcgcaaccacaauaaagagggagaucaguauaucuacaugggccagccccugaacaaugacgaggaucaugcucacuggaccgaagccaagauguuguuagacaacauuaauacaccagaggguaucauccccgcgcuguuugaaccugagagagaaaaauccgcagccauugauggggaguauaggcuccggggcgaggcucguaagacuuucguggaacugaugcgccgaggagaccuuccaguuuggcugagcuacaaggucgccucagagggcuuucaguauagugauagaaaauggugcuucgacggggaaaggaacaaucaagugcucgaggaaaacauggauguggagauauggacgaaggagggagaacggaaaaaguugcgccccagauggcuggacgcuaggaccuacucugacccucuagcacugcgggaguuuaaagaguucgccgcuggucgaagauccgucagcggcgaucucauccuugagauugggaagcugccgcagcacuuaacacagcgcgcccagaaugcauuggacaaccugguuaugcuccauaauucagaacaaggaggcagggcguaucggcacgccauggaggagcugccagauacuaucgaaacccuuaugcugcucgcuuugauugccgugcugacaggugggguaaccuuauuuuuccuaaguggccguggacugggcaaaacuagcaucgggcuccuuugugugauggcauccucuguccuguuguggauggcuagcguggagccccauuggauagccgcauccaucauucuggaauuuuuccucaugguucugcuuaucccugagcccgacagacagaggacgccacaggauaaccagcucgccuacguggucauuggacuguuguuuaugauccugaccguagcugcgaaugagauggguuuacuagaaacaacuaagaaggaccugggcauagggcacguggccguugagaaccaccaucacgcagcuaugcucgauguggaccuucauccugccucagccuggacccuguacgcagucgcuacaaccauuaucacucccaugaugcgccacacaauugaaaacacgaccgccaauaucucuuugacugcgauagcuaaccaagccgcaauccugaugggacucgauaaaggcuggccaauuaguaagauggacaucggugugccucugcuugccuuagggugcuauucgcaggucaauccgcugacacucaccgcugcaguguugaugcugguugcccauuacgcgauuaucggccccggacuacaggcuaaagccacccgggaggcacaaaagcgaacagccgcuggcauaaugaaaaacccaacuguggaugggauuguagccaucgaccuggauccuguggucuaugacgcaaaguucgaaaagcagcucggacagaucaugcuucugauuuuguguacgagccagauccugcucaugagaaccacaugggcucugugcgaguccauaacuuuagccaccggcccccuuacaacccugugggaggguucuccagggaaauuuuggaauacuacgauugcgguuucaauggccaacaucuucaggggaagcuaccucgcaggcgcuggucuagccuucucccugaugaagaguuugggcgggggacgccggggcacaggggcacaaggagaaacccugggcgagaaauggaagagacagcucaaucagcuuucuaaaagcgaauuuaacacuuauaagcguucagguauuauggagguggacagguccgaagcuaaggaggggcugaaacggggagagaccacaaagcacgccgucagucgcggcacugccaaauugcgaugguucguggaaagaaaucugguaaagccugaggguaaagugaucgaucucggcugugggaggggaggcuggagcuacuauugcgcgggguuaaagaagguuaccgaagugaaaggauacacaaagggcggucccgggcacgaggaaccgauaccaauggcuacguacggauggaaccuggucaaacuucauucuggcaaggacguguuuuucaucccucccgagaaaugugauacccugcuaugcgacauuggcgaguccucaccaaaucccacuaucgaagaggggcggacacuccgcguccugaagaugguggaaccuugguugagaggaaaccaguuuuguauuaaaauccugaauccguauaugcccagcguuguagagacccucgagcaaaugcagaggaagcacgguggcaugcuugugcgaaacccacugucgagaaauucuacucaugaaauguacugggucaguugcgggacaggaaacauuguguccgcaguuaauaugaccagccguauguuacugaacagauucacgauggcccaccgcaagccuaccuaugagagggauguggacuugggcgcugguacacggcacgucgccguggaacccgagguagcaaaccucgauaucauagggcagagaauugaaaauaucaaacaugagcacaagucaacuuggcauuacgacgaggauaacccuuauaaaaccugggccuaccacggauccuaugaagugaagccaucuggcagcgcuaguuccaugguuaauggcgucgugaaacugcuaacaaagcccugggacgugaucccuauggucacucagauugcgaugaccgauacaaccccauuugggcaacagcgcguuuucaaggagaaaguggacacuaggacgcccaaggccaaacgaggaacagcacagauaauggaaguaaccgcuaaguggcuuugggguuuucugagccggaacaaaaagccgagaaucuguacuagggaggaguucacccgcaaggugcguucuaaugccgcaauuggcgccgucuuuguggacgagaaccaauggaacucagcuaaagaggccguugaagaugagcgguucugggaccucgugcauagagaaagggagcugcacaagcaggggaaaugcgcgacaugcgucuacaacaugaugggaaagcgcgagaaaaaguugggcgaguuugguaaggcaaaagggagucgagccaucugguacauguggcugggagcucgguuccucgaguucgaagcccuuggcuuuaugaaugaggaucacugguucuccagagaaaacagccugucuggcguggagggggagggauuacauaagcuggguuauauuuugagggacaucucgaaaauaccuggcgggaauauguacgcagaugacacggcuggaugggauacccgcaucacugaagacgaucuccagaacgaggccagaauuacagacaucauggaaccagagcacgcucugcuagccaagucaauuuuuaaacuuaccuaucagaauaagguaguucgggugcaaaggcccgccaaaaauggcacugucauggaugugaucagccgucgagaccagcgcgguuccggacaggugggaacauacggccugaauaccuucacaaacauggaagcgcagcucauaagacaaauggagagugagggcauauuuucuccuagcgaacuggagacuccaaacuuggccgaacgggucuuagauuggcuggagaaguaugggguugaaaggcucaagcgcauggcuaucuccggagacgacugugugguaaaacccaucgaugacagauucgccaccgcacuuacggcucugaaugauauggguaaggugcggaaagacauuccgcagugggagccuucaaagggcuggaacgauuggcagcagguccccuuuugcagucaucacuuccaccaacuaauaaugaaagacgggagggagaucgugguuccaugucgaaaucaggaugaacuggugggacgugccagagucucucagggcgcagguuggagccuccgcgagaccgccugcuuggggaaguccuacgcgcagauguggcaacugauguauuuucaucggagggaccuuagacuggcugccaacgcaauuuguucagccgugccuguagauuggauccccacaagccgcacuaccuggucuauucacgcucaucaccaguggaugacaacugaagacaugcucuccguuuggaaucggguguggaucgaggaaaacccauggauggaggauaagacccauauaaguagcuggggagacguccccuacuuaggcaaaagggaggaccaguggugcggcucgcugaucggguugacggcccgagcaacaugggcuaccaauauucaaguggccaucaaccagguuagacggcugauuggaaaugaaaacuaccucgauuauaugacuuccaugaagagguucaaaaaugagucugacccugaaggugcgcuuugguga

SEQ ID NO: 13667 - RNA, 9879 nt, Artificial Sequence
  derived and/or modified CDS sequence (opt3) from DENV-1__FJ410230__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaacaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugaucggcgccacggaaauucagaccucuggaacaacuaccauauuugcaggccauuuaaaaugccgucugaagauggauaaacuaacacucaaggggauguccuaugugauguguacugggagcuucaaacuggagaaggaacuugccgagacccagcacgguacggucuuggugcagaucaaguacgagggcacagacgcuccuugcaaaauuccauucucgacccaagaugaaaaggggguuacucagaacggacgccugaucacagcgaaucccauagugaccgacaaagagaagccuguaaacauugaagcagagccacccuuuggcgagucuuauaucgucaucggugccggggaaaaagcucucaagcuguccugguucaagaaaggcucaaguauuggaaagauguuugaggccacugcaagaggcgccaggcggauggcuauccuuggggauaccgccugggacuucggaagcauugguggcguguuuacauccguugggaaacuggugcaucagauauucggaacggcauacggcgucuuguuuucuggugugagcuggaccaugaagaucgggauuggcguacuccugacuugguuaggacuaaauucacgaaguacaucccuaagcaugaccuguaucgcggugggccucguuacacuguaccuuggggucauggugcaggcugauucuggaugcgugaucaacuggaaaggccgcgaauugaagugugguucagggauuuucgucacuaaugagguucacaccuggacggaacaauauaaguuucaggccgacaguccgaaaagacugagcgcagccauaggaaaggcuugggaggagggcgugugcgguaucagguccgccacacggcucgaaaacauuauguggaaacagaucucuaacgagcugaaucauauuuuacuggaaaacgacaugaaguucaccgugguagucggcgauguggcagggauccuugcucagggcaaaaagaugauacgcccucaacccauggagcacaaauacucguggaaaagcuggggcaaggccaagaucauuggggcggacguucagaauacuaccuuuaucauugauggaccaaacacaccugaaugucccgacgaucagagagccuggaauaucugggagguggaggacuauggcuucgguauauuuacuaccaacauuugguugaagcucagggauuccuacacacaggucugcgaccaccgucugaugucagcugcaaucaaagauaguaaggccgugcaugcugacaugggguauuggauugaaucugagaaaaaugaaacguggaagcuagcccgggcauccuucaucgagguuaagaccuguauauggccaaaaucccacacucuguggucaaacggagugcucgaaagcgagaugaucauucccaagaucuacggcgguccuauuucucaacauaauuaucgaccaggcuacuucacacagaccgcggggccguggcaccugggaaaacuugaguuggauuuugaccugugcgaaggcacuacaguagucguggaugagcacugcgggaacagaggacccuccuuaaggaccacgacugugaccggcaagaucauacaugaaugguguugccgcaguuguacacucccuccacugcgguucagaggugaggacgggugcugguacggaauggagauuaggcccgucaaagaaaaggaggaaaaucuuguuaagagcauggugucugccggcuccggugagguagacucauuuagucugggcuugcucuguaucagcaucaugauugaagaggugaugcgcucgcgauggucccggaaaaugcugaugaccgggacucuagcugucuucuuucugcucaucaugggacagcugacauggaacgaucuuauucguuugugcauaauggugggcgccaaugcaucugacagaauggggaugggaaccacauaucuggcuuuaauggccacuuucaagaugaggccuauguuugcaguuggccuccuguuccgccggcuuaccagcagagaggugcugcuacucacgaucggucugucauuggucgccaguguggaacugccaaacuccuuagaggaacucggggauggacuggcuaugggcauuaugauccuuaaacuguugacagacuuucaaucucaccagcucugggcgacccugcuaagccugacuuucauuaagaccacauuuucccuucauuacgccuggaaaacuauggcaaugguucucucaaucgugagccuguuccccuugugucugaguaccacgucucagaagacaaccugguuaccgguccuccugggcucccuugggugcaagccucugacuauguuuuugauagcugagaauaaaaucuggggaaggcgaagcuggccacucaacgaagguauuauggccguaggcaucgugucgauucugcuaucaucucugcuuaagaacgauguuccccucgccgggccucugaucgcuggaggcauguugauagcauguuaugugauuagugguuccagcgccgacuuaucucuggagaaagcggcugaggucagcugggaagaggaagccgagcacuccggggcaucacauaauauccucguggaaguacaggaugacggaacaaugaagaucaaagaugaggagcgcgacgauacccugacuauucuucugaaggccacauugcuagcugugaguggcgucuacccccugagcauaccagcaacccucuucguuugguauuucuggcagaaaaagaagcagcggucuggcgugcugugggacacgccuucacccccagaaguggagagagccguccuugaugacgggaucuacaggauuaugcagcguggauuacugggucgcagccaggugggcguugggguauuucaagaaaacguguuccacacuauguggcacgucacccggggagcggugcucauguaucagggcaaaagauuggagccgaguugggcuagcguuaagaaagaccugaucuccuacggugggggauggaggcuccagggcucuuggaauacaggcgaggaagugcaggucauugccguggagccugggaagaaccccaaaaauguacaaaccgcaccaggaacauuuaagacucccgaaggugaggucggcgccaucgcucuggauuucaagccugggaccucgggaagcccaauagugaaccgagaaggcaaaaucguuggucuuuacgggaauggaguggucacgacaucaggcacuuauguguccgccauugcacaggcuaaggccagucaggagggcccccugccugagaucgaagacgagguuuuucggaaacgcaacuugaccauuauggaucuacauccggggucuggaaagacaagaagguaccugccagcgaucgugcgggaagccauaaaacgaaagcucagaaccuuaauucuggcacccacucgcgucguggcuagcgagauggccgaagcucuuaaggguaugccuaucagguaucaaaccacagcaguaaaauccgagcacacgggcaaggagaucguggaccugaugugccaugccacuuucaccaugcgucucuugucaccaguucggguccccaauuacaacaugauuaucauggaugaagcccacuuuacagacccuucuagcauagcugcgagaggguauauuaguaccagggugggaaugggcgaggcagccgcuaucuucaugacugccacaccgcccgguuccguggaagcauuuccacagagcaaugccgucauucaggaugaggaacgcgacaucccugagcgaucuuggaacucaggguacgaguggauaaccgauuuccccggaaaaacgguaugguuugugccauccauuaagaguggcaaugacaucgcuaacugucugaggaaaaauggcaagcggguuauccagcucagcaggaagacuuucgauacagaauaucagaaaaccaagaacaacgacugggacuacguggucaccacugauauuucggagaugggggcgaauuuccgcgccgaccgugugaucgauccuagacggugccugaaacccguuauucuuaaggacggaccagaaagggugauacuagcagguccgaugccugucacaguggcuucugccgcacagcgccgaggcagaaucgggcggaaccauaauaaagagggagaucaguacauuuauaugggccagccccugaacaaugacgaggaucacgcccacuggaccgaagcuaagauguuguuagacaacaucaauacaccagaggguaucauucccgcccuguuugaaccugagagggaaaaguccgcggcaauagauggggaguaccgccucagaggcgaggccaggaaaacuuucguagaacugaugcggcguggagaccuuccaguguggcugagcuauaagguugcuucagagggcuuucaauacagugaucgccgauggugcuucgacggggaaagaaacaaucagguccucgaggaaaacauggauguggagaucuggacgaaagagggagaaaggaagaaauugcggccccgcuggcuggacgccagaaccuauucugacccucuagcucugagggaguuuaaggaguucgcagccggucggcgauccgugagcggcgaucucauucuugagaucgggaaacugccgcagcauuuaacacagagagcucaaaaugccuuggacaaccuggucaugcuccacaauucagaacagggaggccgcgcauacaggcaugcgauggaggagcugccagauacuauugaaacccuuaugcugcucgccuugaucgcuguucugacagguggggugaccuuauuuuuccuaaguggccggggacugggcaagacuagcauagggcuccuuuguguaauguccucuagcgugcuguuguggauggccuccgucgagccccacuggaucgcagcuucaauuauccuggaauuuuuccucauggugcugcuuauuccugagcccgaccgucagagaacgccacaggauaaccaacucgccuauguugugaucggacuguuguuuaugauacugaccgucgcagccaaugagauggguuuacuagaaacaacuaagaaagaccugggcauugggcacguagcuguggagaaccaucaccaugcggccaugcucgauguugaccuucacccugcaucugcuuggacccuguacgccguggccacaaccaucauuacucccaugaugaggcauacaaucgaaaacacgaccgcaaauauaaguuugacugcuaucgccaaccaggcggcuauucugaugggacucgauaagggcuggccaaucucgcgcauggacauuggugucccucugcuugccuuagggugcuacagccaggugaauccgcugacacucaccgcagccgucuugaugcugguggcucacuaugcaaucauaggccccggacuacaagccaaagcgacccgggaggcucagaagcgaacagccgcaggcauuaugaaaaacccaacuguugaugggaucguggccaucgaccuggauccuguaguguacgacgcuaaguucgaaaagcagcucggacagauuaugcuucugaucuuguguacgucccaaauacugcucaugagaaccacaugggcccugugcgagucuauuacuuuagcaaccggcccccuuacaacccugugggaggguucaccagggaaauuuuggaauacuacgaucgcugucagcauggccaacauuuucaggggauccuaucucgcgggcgccggucuagcauucagucugaugaagucuuugggcgggggacgccggggcacaggggcucagggagaaacccugggcgagaaauggaagagacagcucaaucagcuuagcaaaucagaauuuaacacuuacaagcguuccgguaucauggagguugacaggagugaagccaaggaggggcugaaacggggagagaccacaaagcacgcagugagccgcggcacugcuaaauugcgaugguucgucgaaagaaaucuggugaagccugaggguaaaguaauagaucucggcugugggaggggaggcuggucuuauuacugcgccggguuaaagaaggugaccgaaguuaaaggauauacaaagggcggucccgggcaugaggaaccgaucccaauggccacguacggauggaaccuggugaaacuucacuccggcaaggacgucuuuuucauuccucccgagaaaugugauacccugcuaugcgacaucggcgagucaagcccaaaucccacuauugaagaggggcggacacuccgcgugcugaagauggucgaaccuugguugagaggaaaccaauuuuguaucaaaauucugaauccguacaugcccucggugguugagacccucgagcagaugcagaggaagcaugguggcaugcuuguacgaaacccacugucucggaauaguacucacgaaauguauuggguguccugcgggacaggaaacaucgucagcgcggugaauaugaccucacguauguuacugaacagauugacgauggcucaccgcaagccuaccuacgagagggauguugaccucggcgcagguacacggcauguggccgucgaacccgagguggcuaaccuggauauaauugggcagagaaucgaaaauaucaaacacgagcauaaguccacuuggcacuaugacgaggauaacccuuacaaaaccugggccuaucauggaucuuacgaaguaaagccaagcggcagugcauccagcauggugaauggcguugucaaacuacuuacaaagcccugggacgugauuccuauggugacucaaauagccaugaccgauacaaccccauucgggcagcagcgcgucuuuaaggagaaaguugacacuaggacgcccaaggcuaaacgaggaacagcgcaaaucauggaagugaccgccaaguggcugugggguuuccucucucggaacaaaaagccgagaauuuguacuagggaggaauuuacccgcaagguacguucaaaugcagcuaucggcgccguguucgucgacgagaaccaguggaauagugcaaaagaggccguggaagaugagcgguuuugggaccugguucacagagaaagggaguugcacaagcaggggaaaugcgcuacaugcguguauaacaugaugggaaagcgcgagaaaaagcugggcgaguucgguaaggccaaagggucccgagcgauuugguacauguggcucggagcacgguuucuugaguucgaagcccugggcuucaugaaugaggaucauugguuuagcagagaaaacucuuuaucgggcgucgagggggagggacugcacaaguuggguuacauccucagggacauaucaaaaaucccuggcgggaauauguaugcugaugacacggccggaugggauacccgcauuacugaagacgaucugcagaacgaggcaagaaucacagacauuauggaaccagagcaugcucuacuugccaagagcaucuucaaacugaccuaccaaaauaaggugguacggguucagaggcccgcuaaaaacggcacugugauggaugucauaucccgucgagaccagcgcgguaguggacaggugggaacauauggccucaauaccuuuacaaacauggaagcccaacugauuagacagauggagucugagggcaucuucagcccuuccgaauuggagacuccaaacuuagcagaacgggugcuggauuggcucgagaaguacggggucgaaaggcuuaagcgcauggcgaucucaggagacgacuguguugugaaacccauugaugacagauuugccaccgcucugacggcccuaaaugauauggguaagguacggaaagacauaccgcagugggagccuaguaagggcuggaacgauuggcagcaagugcccuucugcucucaccacuuucaucagcugaucaugaaagacgggagggagauugucgugccaugucgaaaucaggaugaacucguuggacgugcaagagugagccagggcgcugguugguccuugcgcgagaccgccugccuggggaagucauaugcacaaauguggcagcuuauguacuuccaccggagggaccugagacucgccgcgaacgcuaucuguagcgccgucccuguggauuggauucccacaucucgcacuaccugguccauccaugcacaccaucaguggaugacaacugaagacauguuaaguguauggaaucggguuuggauagaggaaaacccauggauggaggauaagacccacaucagcucguggggagacgugcccuaucugggcaaaagggaggaccaauggugcggcuccuugauugggcugacggcccgagcuacaugggccaccaauauccaggucgcaauuaaccaggugagacggcucaucggaaaugaaaacuaccuugauuacaugacuucuaugaagagguuuaaaaaugagucagacccugaaggugcucugugguga

SEQ ID NO: 13668 - RNA, 9879 nt, Artificial Sequence
  derived and/or modified CDS sequence (opt3) from DENV-1__FJ410231__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaagcuuugcauugaagccaaaaucucuaauacgaccacagauagcagguguccaacucaaggagaggcuacccugguugaagagcaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauccagacguccggaaccacaacuauuuuugcaggccauuuaaagugccggcugaaaauggauaagcuaacccucaaagggaugagcuaugucauguguacaggaucguucaagcuggagaaggaaguggccgagacucagcacgguaccguucuugugcagauaaaauacgagggcacggacgcuccuugcaagaucccauucucuacacaagaugaaaaagggguaacccagaacggacguuugauuacugcgaaucccaucgucacagacaaggagaaaccugugaacauagaagcagagccacccuuuggcgaguccuauauuguuaucggugccggggaaaaggcucugaagcucucaugguucaaaaagggcaguagcaucggaaaaauguuugaggccaccgcacgcggcgccagaaggauggcuauucugggggauacugccugggacuucggauccaucgguggcguguuuaccucugucgggaagcuugugcaucagauuuucggaacagcauacggcguacuguuuagcggugugucauggacgaugaaaauagggaucggcguuuugcucaccuggcugggauuaaauagucgguccacuagccugucuaugacauguauugcggucggccuagugacccucuaccugggggugaugguccaggcugauucaggaugcguuaucaacuggaagggccgagaacuuaagugugguagugggaucuucgugacaaaugaggugcacacuuggaccgaacaauauaaauuucaggccgacagcccgaagcgcuuguccgcagccauuggaaaagcuugggaggagggcguaugcgguauaagaucugccacgaggcuggaaaacaucauguggcggcagauuucgaacgagcucaaucauauccuguuagaaaacgacaugaaguucacagucgugguuggcgauguggucgggauucuggcacagggaaaaaagaugauccgcccucaacccauggagcacaaauacagcuggaaguccuggggcaaggcuaaaauaaucggggccgacgugcagaauaccacuuuuauuaucgauggaccaaacaccccugaaugucccgacgaucagagagcguggaauauuugggagguugaggacuauggcuucgguaucuuuacaacuaacauauggcuuaaguugagggauucauacacccaggugugcgaccaccgucucaugagugccgcuauuaaagauucuaaggcaguacaugccgacaugggguauuggaucgaaagcgagaaaaaugaaacauggaagcuggcucgggccuccuucauugaggucaagacguguaucuggccaaaaucacacacccuauggagcaacggagugcuggaaucugagaugauaauccccaagauuuacggcgguccuaucucccaacauaauuaucgaccaggcuacuucacucagacagcagggccguggcaccucggaaaacuggagcuugauuuugacuugugcgaaggcaccacuguggucguugaugagcacugcgggaacagaggacccagucugaggacaaccacggugacuggcaagauuauccaugaaugguguugccgcagcuguaccuuaccuccacuccgguucaaaggugaggacgggugcugguacggaauggagauaagacccguaaaggaaaaggaggaaaaucuggugaaaucuauggucuccgcgggcucaggugagguggacaguuuuagccuuggccuguuguguauuucgaucaugaucgaagagguuaugaggucccgcuggucucgaaagaugcucaugacagggacccuggccguguucuuucuacugauuaugggacagcucacuuggaacgaucugauccggagcugcauuauggucggcgcuaaugccucagaccguauggggaugggaacaaccuaucuugcauugauggcuacauucaaaaugagaccuauguuugccgugggccuguuauucaggcgccucacuagucgggagguucugcuucugaccauaggucuaucccucguggcaucugucgaacugccaaacagcuuggaggaacugggggauggauuagccaugggcaucaugauucucaagcugcuuacggacuuucaauccuaccagcugugggcuacauugcucucacugaccuucaucaaaacuaccuuuagccuacacuaugcguggaagacaauggccaugguacugaguauugugucucuucucccccuguguuuguccacuaccagccagaagacgacauggcugccgguuuuacucggcucgcuggggugcaaaccucuuaccauguuccugaucgcagagaauaagauauggggaagaaaaucauggccauugaacgaagguaucauggcugugggcauugucucuauccuccugaguucccuacugaagaacgaugugccccuugccgggccucucauugccggaggcaugcugaucgcuuguuacguaauaagcgguucuagcgcagacuuguccuuagagaaagccgcggaggugucaugggaagaggaagcugagcauaguggggccagccacaauauucuggucgaaguucaggaugacggaacuaugaagaucaaagaugaggagagggacgauacacucaccauccugcuuaaggcaacucuguuggccgugucuggcguguauccccuauccauuccagcuacacuguuugucugguacuucuggcaaaagaaaaagcagcgaucaggcgugcucugggacaccccuagucccccagaaguugagcgcgcaguacuggaugacgggauauaucggaucaugcagagaggacuuuuagguaggagccaggugggcgucgggguguuccaagaaaacguuuuucauacgauguggcacgugacucguggagccguccugauguaccagggcaaacgccucgagccguccugggcgucugugaagaaagacuugauuucguacggugggggauggcggcugcagggcagcuggaauaccggcgaggaaguacaggucaucgcuguggagccugggaagaaccccaagaauguucaaacagccccaggaaccuucaaaacacccgaaggugaggugggcgcaauugcccucgauuuuaagccugggacuucaggauccccaaucgucaacagagaaggcaaaauagugggucuguaugggaauggaguugugaccacgaguggcacauacgucucugcuaucgcccaggcaaaggcuagccaggagggcccccuuccugagauugaagacgagguguucaggaaacgaaaccugacuaucauggauuugcacccgggguccggaaagacccggcgcuaucuaccagccauuguaagagaagcgaucaagaggaaacugcggacacucauauuagcccccacccgagugguugcaucagagauggcugaagcccugaaggguaugccuauuagauaccaaacuaccgcugucaaaucugagcauacaggccgcgagaucguggaccuuaugugccacgcaacguuuacuaugaggcugcucagcccagugcguguccccaauuauaacaugaucauuauggaugaagcccauuucaccgacccuaguuccaucgccgcucggggguacauaagcacaagaguaggaaugggcgaggcggcagccauuuuuaugaccgcuacuccgcccgguucuguggaagccuucccacagucaaaugcaguuauccaggaugaggaaagggacauuccugagcgcuccuggaacaguggguaugaguggaucacagauuuucccggaaagaccgugugguucgucccaagcauaaaaucgggcaaugacauugccaacuguuugcgaaagaauggcaagagagugauccagcugucucggaaaacguuugauacugaauaccaaaagacaaaaaacaacgacugggacuacguugugaccaccgauaucuccgagaugggggcuaauuucagggcggaccgcgucauugauccucguagaugccucaagcccgugauccugaaagacggaccagaacggguaauucuugccgguccgaugccugugacuguugcaagcgcugcccagaggcgcggccgaauagggagaaaccacaauaaggagggagaucaguauaucuacaugggccagccccuaaacaaugacgaggaucaugcacacuggacagaagccaagaugcuguuggacaacauuaauaccccagaggguaucauccccgcuuuauucgaaccugagcgggaaaaaucagccgcgauugauggggaguauaggcugcgcggcgaggcaagaaagacauuugucgaacucaugaggcggggagaccugccaguguggcuuaguuacaaaguggccucugagggcuuccaauauuccgaucgucgcuggugcuuugacggggaacgaaacaaucagguccuggaggaaaacauggauguugagauauggacuaaggagggagaaagaaaaaagcucaggccccggugguuggacgcucgcacguacagcgacccucuggcccuaagagaguucaaagaauuugcugcagguaggcggucagugaguggcgaucugauccucgagauugggaagcuuccgcagcaccugacccagcgagcccaaaaugcuuuagacaacuugguaaugcugcauaauagcgaacagggaggcagagccuaucgccacgcaauggaggagcucccagauacaaucgaaacucugaugcuucuggcgcucauugccguguugaccgguggggucacacuguucuuuuuauccggcaagggacuaggcaaaaccucuaucgggcugcucugugugauggcuagcuccgcccuucuguggauggcaucaguugagccccauuggauagcugccucuaucauuuuggaauucuuucugauggugcuccugaucccugagcccgacaggcagcggacuccacaggauaaccaacuugcauacgucguaauuggacuccuguucaugaucuugacgguggccgcuaaugagaugggucuguuagaaaccacaaagaaagaccuaggcauagggcacguugcgguggagaaccaccaucacgccacuaugcuggaugucgaccuccauccugcaagugcuuggacccuuuacgccguggccacaaccauuaucacucccaugaugcgucacacaauugaaaacacgaccgcaaauaucucgcugacugcuauagccaaccaggcggcuaucuugaugggacuggauaagggcuggccaauuagcaaaauggacaucggugucccucuccuggcccuugggugcuauucccaggugaauccguuaacacugaccgcagccguucucauguugguggcucauuacgcaauuaucggccccggacugcaagccaaggcgaccagagaggcucagaagaggacagccgcaggcauaaugaaaaacccaacuguagaugggauuguggccaucgaccuagauccugucguuuaugacgcuaaguuugaaaaacagcugggacagaucaugcuccuuauucuguguacgucucaaaucuugcugaugcgcaccacaugggcccucugcgagucaauaacucuggcaaccggccccuuaacaacccuuugggaggguagcccagggaaguucuggaauacuacgauugcuguguccauggccaacaucuuucggggaaguuaccuggcgggcgccggucucgcauucucucuaaugaaaagccugggcgggggacgaagaggcacaggggcucagggagaaaccuugggcgagaaguggaagaggcagcugaaucagcucucaaaauccgaauucaacacuuauaagcgcagugguauuauggaggucgaccggagcgaagccaaagaggggcuuagacguggagagaccacaaagcacgcagugucuaggggcacugcuaaacugcggugguuuguagaacgcaauuuggugaagccugaggguaagguuaucgaucugggcugugggcgaggaggcugguccuacuauugcgccgggcucaaaaaggugaccgaagucaaaggauacacaaagggcggucccgggcacgaggaaccgauaccaauggccacguacggauggaacuuagugaaacugcauucaggcaaggacgucuucuuuaucccucccgagaaaugugauacccuucugugcgacauuggcgagagcucgccaaaucccacuaucgaagaggggagaacacuaagggugcucaagaugguugaaccuuggcugcggggaaaccaauucuguauuaagaucuugaauccguauaugcccucuguaguggagacccuggagcagaugcagcgcaaacacgguggcaugcucgucagaaacccacuuaguaggaauuccacucaugaaauguacugggugagcugcgggacaggaaacauuguuucagcggugaauaugaccucccgaaugcuguuaaaccgguuuacgauggcucaccguaagccuaccuaugagagagaugucgaccugggcgcagguacacgccacguggccguagaacccgagguggcuaacuuggauaucauagggcagaggauugaaaauaucaaacaugagcacaagucuacuuggcauuacgacgaggauaacccuuauaaaaccugggccuaccacggaagcuaugaaguuaagccaaguggcuccgcaagcucuauggucaauggcguggugaagcuccugacaaaacccugggacgucaucccuaugguuacucaaauugccaugaccgauacaaccccauucgggcagcagcggguguuuaaggagaaaguagacacuagaacgcccaaggcuaaacgcggaacagcgcaaauaauggaagugaccgccaaguggcuaugggguuuccuuucaaggaacaagaaaccgcgaaucuguacucgggaggaauuuaccagaaaggucaggaguaaugcagcuauuggcgccguguucguugacgagaaccaguggaauuccgcaaaagaggccguggaagaugagcgcuuuugggaccugguccaucgugaacgggagcuccacaagcaggggaaaugcgcuacaugcguguacaacaugaugggaaagagagaaaagaaacugggcgaguucgguaaggccaaagggagcagggcgaucugguacaugugguugggagcacgcuuucuggaguucgaagcccucggcuucaugaaugaggaucacugguuuucucgagaaaacucgcuuucaggcguagagggggagggacugcauaaguuagguuauauucugcgggacaucagcaaaauaccuggcgggaauauguacgcugaugacacggccggaugggauaccagaaucacugaagacgauuugcagaacgaggcaaagauuacagacaucauggaaccagagcacgcucuccuggccaccuccauuuucaaacuaacuuaucaaaauaagguugugaggguccagcgccccgcuagaaacggcacagugauggaugugaucagucggagggaccagcgugguucugggcaggucggaaccuacggccuuaauacauuuacuaacauggaagcccaacugauacgacagauggagagcgagggcauuuucuccccuucagaacucgagaccccaaaccuggcagaacgcguuuuggauugguuagagaagcaugggguggaaagacugaaacggauggcgaucaguggagacgacuguguagugaagcccaucgaugacagguuugccacggcucucucugcccuuaaugauauggguaaaguccgcaaggacauuccgcagugggagccuagcaaaggcuggaacgauuggcagcaagugcccuucugcucccaccacuuucaucagcugauaaugaaggacgggagagagaucguugugccaugucggaaucaggaugaacuagucggaagggcacgagugucacagggcgcugguuggagccugcgugagaccgccugccucgggaagucuuaugcacaaauguggcaguugauguacuuccacagacgcgaccugcggcuugccgcgaacgcuauuuguuccgccguaccuguugauugggugcccacaaguaggacuaccuggagcauccaugcacaccaucaguggaugacaacugaagacaugcugucggucuggaauagaguguggauugaggaaaacccauggauggaggauaaaacccacaucuccucuuggggagacguucccuaucucggcaagcgcgaggaccaauggugcggcucauuaauagggcugacggcccgggcuacaugggccaccaauauccagguggcaauuaaccaggucaggcgauugaucggaaaugaaaacuaccuggauuacaugacuagcaugaaaagauuuaagaaugagagugacccugaaggugcucucugguga

SEQ ID NO: 13669 - RNA, 9879 nt, Artificial Sequence
  derived and/or modified CDS sequence (opt3) from DENV-1__FJ461323__SS-prME
agcgugaccaugcugcucaugcuuaugcccacagcacuggcuuuccacuugacuacgaggggaggggaaccucauaugaucgucuccaagcaggaaaggggaaaaucuuuacuguuuaagaccucagccgguguuaacaugugcacauuaauugccauggaccucggcgagcugugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuuggguucuccggcacccuggauucaccgugauugcucuguuucuggcacaugccaucggcacaucgauuacccagaagggcaucauauucauccucuuaaugcuggucacgccaucaauggcuaugcgcugcguggggauuggaagcagagauuuuguagagggucuuaguggcgccacuuggguugacguggucuuggagcacggguccugugugacaaccauggcgaaggauaaacccacucuggacaucgaauugcucaagacagaggugaccaacccugcaguccugaggaaacuuugcauugaagccaagaucucuaauacgaccacagauagccgguguccaacucaaggagaggcuacccugguugaagaacaggacgccaacuucgugugccgccgaacauuuguagauagaggcugggguaauggguguggauuguucggcaaaggcucccucauaacuugcgcaaaguuuaagugcgugaccaaacuggaggggaagauuguccaguacgaaaacuuaaaauauucagugaucguuacagugcacaccggagaccagcaucaagucgguaaugagaguacugaacacggcacgacagcuaccauuacuccccaggccccuaccacagagauccagcugaccgacuacggggcgcucacucuugauuguagcccaaggacaggacuggacuucaacgaaaugguguugcuaacgaugaaggagaaaucuuggcugguacauaagcagugguuucucgaucugccgcuucccuggaccuccggcgccucaacuagccaagagacauggaaucggcaggaccuguugguuaccuucaaaacagcacacgcuaagaagcaggaaguggucgugcucgguagucaagagggggccaugcacacugcucugaccggcgccacggaaauccagaccucuggaacaacuaccauuuuugcaggccauuuaaaaugccgucugaagauggauaaacuaacacucaaggggauguccuaugucauguguacuggaucguucaaacuggagaaggaaguggccgagacccagcacgguacgguucuugugcagauaaaguacgagggcacagacgcuccuugcaaaaucccauucucgacccaagaugaaaaggggguaacucagaacggacgcuugauuacagcgaaucccaucgucaccgacaaagagaagccugugaacauagaagcagagccacccuuuggcgagucuuauauuguuaucggugccggggaaaaagcucugaagcucuccugguucaagaaaggcucaaguaucggaaagauguuugaggccacugcaagaggcgccaggcggauggcuauucugggggauaccgccugggacuucggaagcaucgguggcguguuuacauccgucgggaaacuugugcaucagauuuucggaacggcauacggcguacuguuuucuggugugagcuggaccaugaagauagggaucggcguuuugcucacuuggcugggauuaaauucacgaaguacaucccugagcaugaccuguauugcggucggccuagugacacucuaccugggggugaugguccaggcugauucuggaugcguuaucaacuggaaaggccgcgaacuuaagugugguucagggaucuucgugacuaaugaggugcacaccuggacggaacaauauaaguuucaggccgacaguccgaaaagauugagcgcagccauuggaaaggcuugggaggagggcguaugcgguauaagguccgccacacggcuggaaaacaucauguggaaacagauuucuaacgagcucaaucauauccuguuagaaaacgacaugaagcugaccgucgugguuggcgauguggcagggauucuuggacagggcaaaaagaugauccgcccucaacccauggaguacaaauauucguggaaaagcugggggaaggcuaaaauaaucggagccgacgcgcagaauacuaccuucauuaucgauggcccaaacacaccugaaugucccgacgaucagagagccuggaauauuugggaggucgaggacuacgguuuugggaucuucacuaccaacauaugguugaagcucagggauuccuauacacaggugugcgaccaccgucugaugucagcugcaauuaaagauaguaaggccguucacgcugacaugggauacuggaucgaaucugagaaaaaugaaacguggaagcuagcccgggcauccuuuauugaggugaagaccuguaucuggccaaaaucccauacucuguggucaaacggcguacucgaaagcgagaugauaauccccaagauuuaugguggcccuaucucucaacacaauuaccgaccaggguacuucacacagaccgcgggaccguggcaucugggcaaacuugaguuggauuucgaccugugcgaagggacuacagucgugguggaugagcacugcggaaacagaggccccuccuuaaggaccacgacugucaccgguaagauuauccacgaaugguguugccgcaguuguacacucccuccacugcgguuuagaggggaggacggaugcugguauggcauggagauaaggcccguuaaagaaaaggaggaaaaucuuguaaagagcaugguaucugccgguuccggcgagguggacucauucagucugggguugcucuguauuagcaucaugaucgaagaggucaugcgcucgcgauggucccggaaaaugcugaugaccggaacucuagcuguguuuuuccugcucauuaugggccagcugacauggaacgaucuuauccguuugugcauuaugguuggggccaaugcaucugacagaaugggaaugggcaccacauaccuggcuuuaauggccacuuuuaagaugaggccuauguucgcagugggucuccuguuucgccggcuuaccagcagagagguccugcuacucacgauagggcugucauugguggccaguguugaacugccaaacuccuuagaggaacucggagauggccuggcuaugggcaucaugauucuuaaacuguugacagacuuccaaucucaucagcucugggcgacccugcuaagccugacuuuuaucaagaccacauucucccuucacuaugccuggaaaacuauggcaauggugcucucaauugucagccuguuucccuugugucugaguaccacgucucagaagacaaccugguuaccgguacuccuggggucccuuggaugcaagccucugacuauguucuugaucgcugagaauaaaauaugggguagaaagagcuggccacucaacgaaggcaucauggccguggggauuguuucgauccugcuaucaucucugcuuaaaaacgaugugccccucgccggaccucugauugcuggcgguauguugaucgcauguuacgucauaaguggguccagcgccgacuuaucucuggagaaggcggcugaggugagcugggaagaggaagccgagcauuccggagcaucacacaauauucucguagaagugcaggaugacggcacaaugaaaaucaaggaugaggagcgagacgauacccugacuauccuucugaaagccacauugcuagcugucaguggcguuuauccccugagcauuccagcaacccucuuugugugguacuucuggcaaaagaagaaacagcgcucuggggugcugugggacacgccuucacccccagaagucgagcgggccgugcuugaugacggaauauauagaaucaugcagagggguuuacugggccguagccagguugggguaggaguguuccaagaaaacgucuuucauacuauguggcacgugacccgcggcgcgguucucauguaccaggguaagcgguuggagccgaguugggcuagcgugaaaaaggaccugauuuccuacgggggaggcuggagacucaggggcucuuggaauacaggggaggaaguccaggugaucgccguagagccuggcaaaaaucccaagaauguccagaccgcaccagguacauucaagacucccgaaggcgaggugggggccauugcucuggauuuuaaaccuggaaccucgggcagcccaaucguuaaccgagaagguaagauaguggggcuuuauggaaauggcgucgugacgacaucaggcacuuacguuuccgccaucgcacaagcuaaagccagucaggaggggccccugccugagauugaagacgagguguuccggaagcgcaacuugaccaucauggaucuacacccgggaucugguaaaacaagaagguaucugccagcgauuguccgggaagccaucaagcgaaagcucagaaccuuaauacuggcacccacucgcgugguagcuagcgagauggccgaagcucuuaaaggcaugccuauuagguaccagaccacagcagugaaguccgagcauacggggaaagagaucguugaccugaugugccacgccacuuuuaccaugcgucucuugucaccaguccgggugcccaauuauaacaugaucauuauggaugaagcccauuucacagacccuucuagcaucgcugcgagaggauacauaaguaccagggugggcaugggugaggcagccgcuauuuuuaugacugccacaccgcccggguccgucgaagcauucccacaaagcaaugccguaauccaggaugaggaacgcgacauuccugagcgaucuuggaacucaggauaugaguggaucaccgauuuucccggcaagacggugugguucguuccauccauaaaaaguggcaaugacauugcuaacugucugagaaagaaugggaagcgggugauccagcucagcaggaaaacuuuugauacagaauaccagaagaccaaaaacaacgacugggacuacgucgugaccacugauaucucggagaugggagcgaauuuccgcgccgaccguguuauugauccuagacggugccugaagcccgugauccuuaaagacgguccagaaagggucauucuagcaggcccgaugccugugacaguagcuucugccgcacaacgccgagggagaauaggacggaaccacaauaaggagggcgaucaguauaucuacaugggucagccccugaacaaugacgaggaucaugcccacuggaccgaagcuaagauguuguuagacaacauuaauacaccagaggggaucauccccgcccuguucgaaccugagagggaaaaauccgcggcaguggauggcgaguaucgccucagaggagaggccaggaagacuuuuguugaacugaugcggcguggcgaccuuccagucuggcugagcuacaaaguggcuucagagggguuccaguauagugaucgccgauggugcuuugacggagaaagaaacaaucaagugcucgaggaaaacauggaugucgagauuuggacgaaggagggugaaaggaaaaaguugcggccccgcuggcuggacgccagaaccuacucugacccucuagcucugagggaguucaaagaauuugcagccggccggcgauccguuagcggggaucucauacuugagaucggaaagcugccgcagcacuuaacacagagagcucagaaugccuuggacaaccuggugaugcuccauaauucagaacaaggcggucgcgcauauaggcacgcgauggaggagcugccagauacuauugaaacccuuaugcugcucgccuugaucgcuguacugacagggggcgugaccuuauucuuucuaaguggacggggccuggggaagacuagcauuggacuccuuugugucauggccuccucugugcuguuguggauggcaagcguugagccccauuggaucgcugccuccauaauccuggaguucuuucucauggugcugcuuauuccugagcccgaccgucagagaacgccacaggauaaccagcucgcauacgucguaaucggucuguuguucaugauucugaccguggccgcuaaugagaugggcuuacuagaaacaacuaaaaaggaccuggggaucggacacguugcgguggagaaccaccaucacgccgcaaugcucgaugucgaccuucauccugcuucagccuggacccuguacgccguggcaacaaccauaauuacucccaugaugaggcacacaaucgaaaacacgaccgcuaauauuucuuugacugccaucgcgaaccaagcugccauacugaugggccucgauaaagguuggccaaucaguaagauggacauuggggucccucugcuugcauuaggcugcuauagccaggugaauccgcugacacucaccgccgcuguuuugaugcugguggcacauuacgccaucauuggacccggccuacaggcgaaagcuacccgcgaggcccaaaagcggacagcagccgggaucaugaagaacccaacuguagauggaauaguggcuauugaccuggauccugucguuuaugacgccaaauuugaaaagcagcucggccagaucaugcuucugaucuuguguacgagccagauucugcucaugcgaaccacaugggcacugugcgaguccaucacuuuagcuaccgguccccuuacaacccugugggaggggucuccaggaaaauucuggaauacuacgauagccgugucaauggcgaacauuuuuagaggcagcuaccucgccggugcaggccuagcuuucucccugaugaagagucuagggggaggcaggcgcgggacaggagcccaaggcgaaacccugggugagaaauggaagcggcagcucaaucagcuuucuaagagcgaguucaacacuuauaaaagaucagggaucauggaggucgaccguuccgaagcaaaggagggacugaaaaggggcgagaccacaaagcacgcugugagucgggguacugccaaauugcgcugguuuguagaacgaaaucuggugaagccugagggcaagguuauugaucucggguguggaagaggcggguggagcuacuauugcgccggacuaaagaaggugaccgaagucaaaggcuacacaaagggugggcccggacacgaggaaccgaucccaauggcgacguacggcuggaaccuggugaaacuucauucuggcaaggacgucuucuuuauaccucccgagaaaugugauacccugcuaugcgacaucggggaguccucaccaaaucccacuauugaagagggaaggacacuccgggugcugaagaugguugaaccuugguugcgcgguaaccaguucuguaucaagauucugaauccguauaugcccagcguaguggagacccucgagcaaaugcagagaaaacacggcgggaugcuugucaggaacccacugucgcgaaauucuacucaugaaauguacugggugaguugcggaacaggcaacaucguuuccgcugugaauaugaccagccggauguuacugaaccguuuuacgauggcacacagaaagccuaccuaugagcgcgaugucgacuuggguacagggacuaggcacguggccguagaacccgagguggcuaaccucgauauuaucggacagcggauagaaaauauuaaacaugagcacaagucaaccuggcauuacgacgaggauaacccuuauaaaacaugggccuaccacggcuccuaugaaguuaagccaucuggcagcgcaaguuccauggucaaugggguggugaagcugcuaacuaaacccugggacgucaucccuaugguuacccagaucgccaugacagauaccacuccauucggacaacagagaguguuuaaggagaaaguagacacgcgcacacccaaggcuaaaagggguaccgcgcagauuauggaagugacugcccgauggcuuuggggcuuccugagccggaacaagaagccgagaauauguaccagggaggaauuuacacgcaaaguccguucuaaugcagcuaucggggccguguucguugacgagaaccaauggaacucagcaaaggaggccguggaagaugagcgguuuugggaccucguccauagagaaagggagcugcacaaacagggaaagugcgcuacgugcguguacaacaugaugggcaaacgcgaaaagaaguugggugaguucgggaaagccaagggaagucgagcgauuugguacauguggcugggcgcacgguuucucgaguucgaagcccuuggcuucaugaaugaggaucacugguuuuccagagaaaacagccugucugggguagagggagaggguuuacauaaacugggcuauaucuugagggacauuucgaagaucccugggggaaauauguacgcugaugacaccgccggcugggauacucgcauaacagaagacgaucuccagaacgaggcaaaaaucaccgacauuauggaaccagagcacgcucugcuagccaaggcuaucuucaaacuuacuuaucagaauaagguugugagaguccaacggcccgccaagaacgguacagugauggaugugauuucaaggcgugaccagcgagggagcggacaggucggcaccuacggccugaauacauuuacuaacauggaagcacagcucauccgccaaauggaguccgaggggauauucaguccuucugaacuggagaccccaaacuuggcggaaagagccuuagauuggcuggagaaauauggaguugaacggcucaagaggauggcuauuagcggugacgacugugugguaaaacccaucgaugaccgcuuugccacggcacuuaccgcucugaaugauaugggcaaggugagaaaagacaucccgcagugggagccuuccaagggguggaacgauuggcagcagguccccuucugcucacaucacuuucaccaacuaauuaugaaggacggacgggagauagugguuccauguaggaaucaggaugaacuggugggccgagcccgugucagucagggugcaggguggucucucagagagacagccugcuugggaaaaagcuacgcgcagauguggcaacugauguauuuccaucgccgggaccuuaggcuggcugccaacgcaaucuguuccgccgugccuguagauuggguucccacuucaagaaccacauggagcauucacgcucaucaccaguggaugacuaccgaagacaugcucucuguguggaaucgcgucuggaucgaggaaaacccauggauggaggauaagacgcauauuuccaguugggaggacgugcccuacuuaggcaaacgggaagaccaguggugcggcagccugaucggguugacagccagggcaaccugggcuacuaauauacaaguugccaucaaccaggugcgaagacugauuggaaaugagaacuaccucgauuauaugacaucgaugaagcgguuuaaaaaugaaaccgacccugagggugcgcuuugguga

SEQ ID NO: 13670 - RNA, 9879 nt, Artificial Sequence
  derived and/or modified CDS sequence (opt3) from DENV-1__FJ461325__SS-prME
agcgugaccaugcugcucaugcuuaugcccaccgcccuggcuuuccacuugacuacgcggggaggggaaccucauaugaucgucuccaagcaggaaaggggaaaaucuuuacuguuuaagaccucagccgguguuaauaugugcacgcuaauugccauggaccucggcgaacugugugaagauacuaugaccuacaaaugcccacggauuacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguauuagcaucaugaucgaagaggucaugcgcucgcgauggucccggcguaugcucaugaccgggacucuggccguguucuuucuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaaaaccacauuuucccugcacuaugcauggaagacuauggcuauggugcuuucaauugucagccucuucccccuguguuugaguaccacgucucagaaaacaaccuggcugccgguauuacucggcucccuggggugcaagccucuuacuauguuucugaucacagagaauaagauauggggacgacgcagcuggccauugaacgaagguaucauggccgugggcauuguuucgauccuccugucaucucuacugaaaaacgaugugccccuugccgggccucucauugcuggaggcaugcugaucgcauguuacgucauaagugguuccagcgccgacuugucuuuagagaaggcggcugaggugagcugggaagaggaagccgagcauuccggggcaucacacaauauucugguagaagugcaggaugacggaaccaugaaaaucaaggaugaggagcgggacgauacucucacaauccugcuuaaagccacccuguuggcugucaguggcguuuauccccuaagcauuccagcaacgcuguucgugugguacuucuggcaaaagaaaaagcagagaucuggcgugcucugggacacuccuucacccccagaagucgagagggccgugcuggaugacgggauauaucguaucaugcagcgcggacuuuuaggucggagccagguuggcguagggguguuucaagaaaacgucuuccauaccauguggcacgugacaagaggagcgguucugauguaccagggcaagaggcucgagccgaguugggcuagcgugaaaaaggacuugauuuccuacggugggggauggcgacugcagggcucuuggaauaccggcgaggaaguccaggugaucgccguagagccugggaaaaaccccaagaauguccaaacagcaccaggaacuuuuaaaacccccgaaggugaggugggcgccauugcucucgauuucaagccugggacgucgggaagcccaaucguuaaccgggaaggcaagauagugggucuguaugggaauggagucgugacaacuucaggcaccuacguuuccgccaucgcacaggcuaaagccagucaggagggcccccuuccugagauugaagacgagguguuucgcaagagaaaccugacaaucauggauuugcacccggggucuggaaaaaccaggcgguaucuaccagcgauuguccgagaagccaucaagagaaaacugcgcacucucauauuagcacccaccagggugguagcuagcgagauggccgaagcucugaaggguaugccuauucguuaccaaacaacggcagugaaguccgagcauacuggcaaagagaucguugaccuuaugugccacgccaccuucacaaugcggcugcucucaccagucagagugcccaauuauaacaugaucauuauggaugaagcccauuuuaccgacccuucuagcaucgcugcgaggggguacauaaguacucgcgugggaaugggcgaggcagccgcuauuuucaugacagccaccccgcccgguuccgucgaagcauuuccacagagcaaugccguaauccaggaugaggaacgagacauuccugagagaucuuggaacucaggguaugaguggaucacggauuuccccggaaagacugugugguuuguuccauccauaaaaaguggcaaugacauugcuaacuguuugcggaagaauggcaaaagggugauccagcugagccgcaagacauucgauaccgaauaccaaaagaccaaaaacaacgacugggacuacgucgugacuacagauaucucggagaugggggcgaauuuccgugccgacagaguuauugauccucggaggugccucaagcccgugauccugaaagacggaccagaacgcgucauucuugcagguccgaugccugugaccguagcuucugccgcacagcgaagaggccggauagggaggaaccacaauaaggagggagaucaguauaucuacaugggccagccccuaaacaaugacgaggaucaugcccacuggacagaagcuaaaaugcuguuggacaacauuaauacuccagaggguaucauccccgccuuauuugaaccugagcgcgaaaaguccgcggcaauugauggggaguauagacugaggggcgaggcccggaagacguucguggaacucaugcgucgcggagaccugccaguuuggcuuagcuacaaagucgcuucagagggcuuucaauauagugaucgaagauggugcuucgacggggaaaggaacaaucaggugcuggaggaaaacauggauguggagauauggaccaaggagggagaacggaaaaagcuccgccccagaugguuggacgccaggacauacucugacccucuggcucuacgggaguuuaaagaguucgcagccggucgaagauccgucagcggcgaucugauccucgagauugggaaacuuccgcagcaccugacucagcgcgcucaaaaugccuuagacaacuugguuaugcugcauaauucagaacagggaggcagggcauaucggcacgcgauggaggagcucccagauaccaucgaaacacugaugcuucuggcccucauugcuguguugaccggugggguaacucuguuuuucuuaaguggccguggacuaggcaaaacgagcaucgggcugcucugugugauggccuccucuguccuucuguggauggcaagcguggagccccauuggauagcugccuccaucauuuuggaauuuuuccugaugguucuccugaucccugagcccgacagacagaggaccccacaggauaaccaacuugcauacguggucauuggacuccuguuuaugaucuugacaguagccgcuaaugagaugggucuguuagaaacuaccaagaaggaccuaggcauagggcacguggcgguugagaaccaccaucacgccgcaaugcuggauguggaccuccauccugcuucagccuggacacuuuacgccgucgcaaccacuauuaucacacccaugaugcgccacacgauugaaaacaccacugcuaauaucucucugacagccauagcgaaccaggcugccaucuugaugggacuggauaaaggcuggccaauuaguaagauggacaucggugugccucuccuggcacuugggugcuauucgcaggucaauccguuaacccugaccgccgcugugcucauguugguugcacauuacgccauuaucggccccggacugcaagcgaaagcuacacgggaggcccagaagcgaacugcagccggcauaaugaaaaacccaacgguggaugggauuguagcuaucgaccuagauccuguggucuaugacgccaaguucgaaaagcagcugggacagaucaugcuccuuauucuguguaccagccaaaucuugcugaugagaacaacuugggcacucugcgaguccauaacccuggcuacaggccccuuaaccacucuuugggaggguucuccagggaaauuuuggaauacgacaauugccguuucaauggcgaacaucuucaggggaagcuaccuggccggcgcaggucucgcuuucucccuaaugaagagucugggcgggggacgccggggcaccggggcccagggagaaacuuugggcgagaaauggaagagacagcugaaucagcucucuaaaagcgaauuuaacaccuauaagcguucagguauuauggagguggacagguccgaagcaaaggaggggcuuaaacggggagagacaacuaagcacgcugucagucgcggcaccgccaaacugcgaugguucguggaaagaaauuugguaaagccugaggguaaagugaucgaucugggcugugggaggggaggcuggagcuacuauugcgccgggcucaagaagguuacagaagugaaaggauacacgaagggcggucccgggcacgaggaaccgauaccaauggcgaccuacggauggaacuuagucaaacugcauucuggcaaggacguguuuuucaucccucccgagaaaugugauacucuucugugcgacauuggcgaguccucaccaaaucccacaaucgaagaggggcggacccuacgcguccucaagaugguggaaccuuggcugagaggaaaccaauuuuguauuaaaaucuugaauccguauaugcccagcguuguagagacucuggagcagaugcagaggaagcacgguggcaugcucgugcgaaacccacuuucgagaaauucuacacaugaaauguacugggucaguugcgggaccggaaacauuguguccgcuguuaauaugacgagccguaugcuguuaaacagauucaccauggcacaccgcaagccuacauaugagagggauguggaccugggcgccgguacucggcacgucgcuguggaacccgagguagccaacuuggauaucauagggcagagaauugaaaauaucaaacaugagcacaagucaaccuggcauuacgacgaggauaacccuuauaaaacaugggcauaccacggauccuaugaagugaagccaucuggcagcgccaguuccaugguuaauggcgucgugaaacuccugacuaagcccugggacgugaucccuauggucacccaaauugcuaugacagauaccacuccauuugggcagcagcgcguuuucaaggagaaaguggacacgaggacacccaaggcgaaacgaggaaccgcccaaauaauggaaguaacugcaaaguggcuaugggguuuucuuagccggaacaaaaagccgagaaucuguaccagggaggaguucacacgcaaggugcguucuaaugcugccauuggcgcagucuuuguggacgagaaccaguggaacucagccaaagaggcuguugaagaugagcgguucugggaccuggugcauagagaaagggagcuccacaagcaggggaaaugcgccacgugcgucuacaacaugaugggaaagcgcgagaagaagcugggcgaguuugguaaggcgaaagggagucgagcaaucugguacaugugguugggagcccgguuccuggaguucgaagcucucggcuuuaugaaugaggaucacugguucuccagagaaaacagccuuucuggcguggagggggagggacugcauaaguuagguuauauucugagggacaucucgaaaauaccuggcgggaauauguacgccgaugacaccgcaggaugggauacucgcaucacagaagacgauuugcagaacgaggcuagaauuaccgacaucauggaaccagagcacgcccuccuggcuaagucaauuuuuaaacuaacuuaucaaaauaagguaguucgggugcagaggcccgccaaaaacggcacagucauggaugugaucagccgucgagaccagcgcgguuccggacaggugggaaccuacggccuuaauacauucacuaacauggaagcacaacugauaagacagauggagagugagggcauauuuucuccuagcgaacucgagaccccaaaccuggcggaacgggucuuggauugguuagagaaguaugggguugaaaggcugaagcgcauggccaucuccggagacgacugugugguaaaacccaucgaugacagauucgcuacggcccucaccgcacuuaaugauauggguaaggugcggaaagacauuccgcagugggagccuucaaagggcuggaacgauuggcagcaaguccccuuuugcagucaucacuuccaccagcugauaaugaaagacgggagggagaucgugguuccaugucgaaaucaggaugagcuagugggacgugcuagagucucucagggcgccgguuggagccugcgcgagacagcaugccucgggaaguccuacgcccaaauguggcaguugauguauuuucaucggagggaccugagacuugcggcuaacgccauuuguucagcagugccuguagauuggauccccacuagccgcaccacauggucuauucacgcccaucaccaguggaugacuaccgaagacaugcuguccguuuggaaucggguguggaucgaggaaaacccauggauggaggauaagacgcauauaaguagcuggggagacguccccuaccucggcaaaagggaggaccaauggugcggcucguuaaucgggcugacagcucgagccaccugggcaacuaauauucagguggcuaucaaccagguuagacgguugauuggaaaugaaaacuaccuggauuauaugacauccaugaagagguucaaaaaugagucugacccugaaggugcccucugguga

SEQ ID NO: 13671 - RNA, 9879 nt, Artificial Sequence
  derived and/or modified CDS sequence (opt3) from DENV-1__FJ410232__SS-prME
agcgugaccaugcugcucaugcuuaugcccaccgcccuggcuuuccacuugacuacgagaggaggggaaccucauaugaucgucuccaagcaggaaaggggaaaaucuuuacuguuuaagaccucagccgguguuaacaugugcacauuaauugccauggaccucggcgagcugugugaagauacuaugaccuacaaaugcccacggaucacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuacagcacuguuucuggcccaugcuauuggcaccucgaucacgcagaagggcauuaucuucauacucuuaaugcuggugacuccaucaauggccaugcgcugcgucgggaucggaagcagagauuuuguggagggucuuaguggcgcgacauggguagacguuguguuggagcacggguccugugucaccacuauggcaaaggauaaacccacacuggacauugaauugcucaagaccgaggugacgaacccugccgugcugaggaaacuuugcaucgaagcuaagauuucuaauaccacaacugauagccgguguccaacccaaggagaggccacacuggucgaagaacaggacgcaaacuucguuugccgccgaacuuuuguggauagaggcugggguaauggguguggauuguucggcaaaggcucccucauaaccugcgcuaaguuuaagugcguaacaaaacuggaggggaagauagugcaguacgaaaacuuaaaauauucagucauugugaccguucacacuggagaccagcaucaaguggguaaugagaguacggaacacggcacaaccgccacuaucacaccccaggcgccuacaaccgagauucagcugacugacuacggggcccucacacuugauuguagcccaaggacgggacuggacuucaacgaaauggucuugcuaaccaugaaggagaaaucuuggcuggugcauaagcagugguuucucgaucugccgcuucccuggacuuccggcgcaucaacaagccaagagaccuggaaucggcaggaccuguugguaacauucaaaacugcucacgccaagaagcaggaaguugugguccucgguagucaagagggggcuaugcacaccgcccugacgggcgcaaccgaaauccagacaucuggaacuaccacaaucuuugccggccauuuaaaaugccgucugaagauggauaaacuaacucucaaggggauguccuaugugauguguaccgguagcuucaaacuggagaaggaagucgcugagacgcagcacgguacagugcuuguucagauuaaguacgagggcaccgacgcgccuugcaaaauaccauucucgacucaagaugaaaagggggugacacagaacggacgcuugaucaccgcaaaucccauuguaacugacaaagagaagccugucaacaucgaagccgagccacccuuuggcgagucuuauauagugauuggugcuggggaaaaagcccugaagcucuccugguucaagaaaggcucaaguaucggaaagauguuugaggcaaccgccagaggcgcuaggcggauggccauccugggggauacagcaugggacuucggaagcauugguggcguuuuuacguccguggggaaacuuguccaucagaucuucggaaccgcguacggcgugcuguuuucugguguaagcuggacuaugaagauugggauaggcguguugcucacauggcugggauuaaauucacgaaguaccucccugagcaugacauguaucgcuguuggccuagucacucucuaccugggggugauggugcaggccgauucuggaugcgucauuaacuggaaaggccgcgaacuuaagugugguucagggaucuucguuaccaaugaggugcacacguggacagaacaauauaaguuucaggcagacaguccgaaaagauugagcgccgcuaucggaaaggccugggaggagggcgugugcgguauuagguccgcaacccggcuggaaaacauaauguggaaacagaucucuaacgagcucaaucauauucuguuagaaaacgacaugaagcugacuguagucgugggcgauguugcugggauccuuggacagggcaaaaagaugauucgcccucaacccauggaguacaaauauucguggaaaagcugggggaaggccaaaaucauaggagcggacgcccagaauaccacauucaucauugauggcccaaacacuccugaaugucccgacgaucagagagcuuggaauaucugggagguggaggacuacgguuuugggauuuucaccacaaacaucugguugaagcucagggauuccuauacgcaggucugcgaccaccgucugaugucagcagccauaaaagauaguaaggcugugcacgccgacaugggauacuggauugaaucugagaaaaaugaaaccuggaagcuagcacgggcgagcuuuaucgagguuaagacuuguauuuggccaaaaucccauacacuguggucaaacggcgugcucgaaagcgagaugaucauacccaagaucuaugguggcccuauuucucaacacaauuaccgaccaggguacuucacccagacugccggaccguggcaucugggcaaacuugaguuggauuucgaccugugcgaagggacaaccguagucguggaugagcacugcggaaacagaggccccuccuuaaggacgacuaccgugacagguaagaucauucacgaaugguguugccgcaguuguacccucccuccacugcgguuuagaggggaggacggaugcugguauggcauggagaucaggcccgucaaagaaaaggaggaaaaucuuguuaagagcauggugucugcugguuccggcgagguagacucauucagucugggguugcucuguauaagcauuaugaucgaagaggugaugcgcucgcgauggucccggaaaaugcugaugacuggaacacuagccgucuuuuuccugcucaucaugggccagcugaccuggaacgaucuuauucguuugugcaucauggugggggcaaaugcuucugacagaaugggaaugggcacaacuuaccuggccuuaauggcaaccuuuaagaugaggccuauguucgccguuggucuccuguuucgccggcuuacgagcagagaggugcugcuacucacaauugggcugucauuggucgcuaguguggaacugccaaacuccuuagaggaacucggagauggccuggcgaugggcauaaugauccuuaaacuguugaccgacuuccaaucucaucagcucugggccacucugcuaagccugaccuuuauuaagacaacuuucucccuucacuaugcauggaaaaccauggcuaugguucucucaaucgugagccuguuucccuugugucugaguacgacaucucagaagaccacuugguuaccgguccuccuggggucccuuggaugcaagccucugacaauguucuugauugccgagaauaaaaucugggguaggaaguccuggccacucaacgaaggcauaauggccguagggaucgugucgauucugcuaucaucucugcuuaaaaacgauguuccccucgcuggaccucugaucgcaggcgguauguugauugccuguuacgugaucaguggguccagcgcggacuuaucucuggagaaggcugccgaggucagcugggaagaggaagcagagcauuccggagccucacacaauauacucguggaaguacaggaugacggcaccaugaaaauuaaggaugaggagcgagacgauacucugacaauccuucugaaagcuaccuugcuagcagugaguggcgucuauccccugagcaucccagccacgcucuuuguuugguacuucuggcaaaagaagaaacagcgcucuggggugcugugggacacuccuucacccccagaaguggagcgggcgguccuugaugacggaauuuauagaauaaugcagagggguuuacugggccguagccagguggggguuggaguauuccaagaaaacguguuucauaccauguggcacgucacacgcggcgcugugcucauguaccaggguaagcgguuggagccgaguugggccagcguuaaaaaggaccugaucuccuacgggggaggcuggagacucaggggcucuuggaauaccggggaggaagugcaggucauugcaguggagccuggcaaaaaucccaagaauguacagacagccccagguacuuucaagacccccgaaggcgaggucggggcuaucgcccuggauuuuaaaccuggaacgucgggcagcccaauugugaaccgagaagguaagaucguugggcuuuauggaaauggcguggucacaacuucaggcaccuacguguccgcaauagcucaagccaaagcgagucaggaggggccccugccugagaucgaagacgagguuuuccggaagcgcaacuugacaauuauggaucuacacccgggaucugguaaaaccagaagguaucugccagccaucgugcgggaagcaauuaagcgaaagcucagaacuuuaauccuggcucccacccgcgucguggccagcgagauggcugaagcacuuaaaggcaugccuauaagguaccagacaacggccguaaaguccgagcauacugggaaagagauuguggaccugaugugccacgccaccuuuacaaugcgucucuugucaccaguucggguccccaauuauaacaugaucaucauggaugaagcucauuucaccgacccuucuagcauugcggcaagaggauacaucaguacuagggugggcaugggugaggccgcugccauauuuaugacagcaaccccgcccggguccguggaagccuucccacaaagcaaugcugucauucaggaugaggaacgcgacaucccugagcgaucuuggaacucaggauaugaguggauuacggauuuucccggcaagacuguaugguucgugccauccaucaaaaguggcaaugacauagcgaacugucugagaaagaaugggaagcggguuauucagcucagcaggaaaacauuugauaccgaauaccagaagaccaaaaacaacgacugggacuacguggucacuacagauaucucggagaugggagccaauuuccgcgcagaccgugugaucgauccuagacggugccugaagcccguuauucuuaaagacgguccagaaagggugauccuagcuggcccgaugccugucaccguggccucugcagcccaacgccgagggagaauuggacggaaccacaauaaggagggcgaucaguauauauacaugggucagccccugaacaaugacgaggaucaugcucacuggacagaagccaagauguuguuagacaacaucaauacuccagaggggauuauccccgcgcuguucgaaccugagagggaaaaauccgcagccguagauggcgaguaucgccucagaggagaggcuaggaagacguuuguggaacugaugcggcguggcgaccuuccaguuuggcugagcuacaaagucgccucagagggguuccaguauagugaucgccgauggugcuuugacggagaaagaaacaaucaagugcucgaggaaaacauggauguggagaucuggaccaaggagggugaaaggaaaaaguugcggccccgcuggcuggacgcuagaacauacucugacccucuagcacugagggaguucaaagaauuugccgcuggccggcgauccgucagcggggaucucauucuugagauaggaaagcugccgcagcacuuaacucagagagcccagaaugcauuggacaaccugguuaugcuccauaauucagaacaaggcggucgcgcguauaggcacgccauggaggagcugccagauaccaucgaaacacuuaugcugcucgcuuugauugccgugcugaccgggggcguaacuuuauucuuucuaaguggacggggccuggggaagacgagcaucggacuccuuugugugauggcauccucuguccuguuguggauggcuagcguggagccccauuggauugccgcauccaucauacuggaguucuuucucaugguucugcuuaucccugagcccgaccgucagagaaccccacaggauaaccagcucgccuacguggucauuggucuguuguucaugauccugacaguagcugcgaaugagaugggcuuacuagaaacuaccaaaaaggaccuggggauuggacacguggccguugagaaccaccaucacgcagcuaugcucgauguggaccuucauccugccucagccuggacacuguacgcagucgcuaccacuaucauaacacccaugaugaggcacacgauugaaaacaccacugccaauaucucuuugacagcgauugcuaaccaagccgcaauccugaugggccucgauaaagguuggccaauaaguaagauggacaucggggugccucugcuugccuuaggcugcuauucgcaggucaauccgcugacccucaccgcugcaguguugaugcugguugcccauuacgcgauuaucggacccggccuacaggcuaaagccacacgcgaggcacaaaagcggacugccgcugggauuaugaagaacccaacgguggauggaaucguagccauagaccuggauccuguggucuaugacgcaaaauuugaaaagcagcucggccagauuaugcuucugaucuuguguaccagccagauccugcucaugcgaacaacuugggcucugugcgaguccauuaccuuagccacagguccccuuaccacucugugggaggggucuccaggaaaauucuggaauacgacaaucgcgguuucaauggccaacauauuuagaggcagcuaccucgcaggagcuggccuagccuucucccugaugaagagucuagggggaggcaggcgcgggaccggagcacaaggcgaaacucugggugagaaauggaagcggcagcucaaucagcuuucuaagagcgaguucaacaccuauaaaagaucagggauuauggagguggaccguuccgaagcuaaggagggacugaaaaggggcgagacaacuaagcacgccgucagucgggguaccgccaaauugcgcugguuuguggaacgaaaucugguaaagccugagggcaaggugaucgaucucggguguggaagaggcggguggagcuacuauugcgcgggacuaaagaagguuacagaagugaaaggcuacacgaagggugggcccggacacgaggaaccgauuccaauggcuaccuacggcuggaaccuggucaaacuucauucuggcaaggacguguucuuuaucccucccgagaaaugugauacucugcuaugcgacauaggggaguccucaccaaaucccacaaucgaagagggaaggacccuccggguccugaagaugguggaaccuugguugcgcgguaaccaguucuguauuaagauccugaauccguauaugcccagcguuguagagacucucgagcaaaugcagagaaaacacggcgggaugcuugugaggaacccacugucgcgaaauucuacacaugaaauguacugggucaguugcggaaccggcaacauuguguccgcaguuaauaugacgagccggauguuacugaaccguuuuaccauggcccacagaaagccuacauaugagcgcgauguggacuuggguacugggaccaggcacgucgcuguggaacccgagguagccaaccucgauaucauuggacagcggaucgaaaauauaaaacaugagcacaagucaacauggcauuacgacgaggauaacccuuauaaaacuugggcauaccacggcuccuaugaagugaagccaucuggcagcgccaguuccaugguuaauggggucgugaagcugcuaaccaaacccugggacgugauuccuauggucacacagaucgcuaugaccgauacuacgccauucggacaacagagaguuuuuaaggagaaaguggacacacgcacccccaaggcgaaaagggguacugcccagaucauggaaguaaccgcacgauggcuuuggggcuuccugagccggaacaagaagccgagaauuuguacaagggaggaauuuacgcgcaaagugcguucuaaugcugccauaggggcagucuucguggacgagaaccaauggaacucagccaaggaggcuguugaagaugagcgguuuugggaccucgugcauagagaaagggagcugcacaaacagggaaagugcgcaaccugcgucuacaacaugaugggcaaacgcgaaaagaaguugggugaguucgggaaagcgaagggaagucgagcaaucugguacauguggcugggcgcccgguuucucgaguucgaagcucuuggcuucaugaaugaggaucacugguuuuccagagaaaacagccugucugggguggagggagaggguuuacauaaacugggcuauauuuugagggacaucucgaagauuccugggggaaauauguacgccgaugacacugcaggcugggauacacgcaucaccgaagacgaucuccagaacgaggcuaaaauaacugacaucauggaaccagagcacgcccugcuagcuaaggccauuuucaaacuuacauaucagaauaagguaguuagagugcaacggcccgcaaagaacgguaccgucauggaugugaucucaaggcgugaccagcgagggagcggacaggugggcacauacggccugaauacuuuuaccaacauggaagcgcagcucauucgccaaauggaguccgaggggaucuucaguccuucugaacuggagacgccaaacuuggccgaaagagcuuuagauuggcuggagaaauauggagucgaacggcucaagaggauggccauaagcggugacgacuguguugugaaacccauugaugaccgcuuugcaaccgcucuuacagcccugaaugauaugggcaagguaagaaaagacaucccgcagugggagccuuccaagggguggaacgauuggcaacaggugcccuucugcucacaucacuuucaccaacuaaucaugaaggacggacgggagauugucgugccauguaggaaucaggaugaacugguuggccgagcacgugugagucagggugccggguggucucucagagagacugcgugcuugggaaaaagcuacgcucagauguggcaacugauguauuuccaucgccgggaccuuaggcuggccgcaaacgccauauguuccgcugucccuguggauuggguacccaccucaagaacaacuuggagcauccacgcccaucaccaguggaugaccacggaagacaugcucucuguuuggaaucgcguguggauugaggaaaacccauggauggaggauaagacacauaucuccaguugggaggacguccccuacuuaggcaaacgggaagaccaguggugcggcagccugauuggguugaccgcaagggcuacuugggccacaaauauccaaguggcgauaaaccagguucgaagacugaucggaaaugagaacuaccucgauuauaugaccucgaugaagcgguuuaaaaaugaauccgacccugagggugcucuuugguga

SEQ ID NO: 13672 - RNA, 9879 nt, Artificial Sequence
  derived and/or modified CDS sequence (opt3) from DENV-1__FJ461327__SS-prME
agcgugaccaugcugcucaugcuuaugcccaccgcacuggcuuuccacuugacuacgcggggaggggaaccucauaugaucgucuccaagcaggaaaggggaaaaucuuuacuguuuaagaccucagccgguguuaacaugugcacgcuaauugccauggaccucggcgaacugugugaagauacuaugaccuacaaaugcccacggauaacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguauuagcaucaugaucgaagaggucaugcgcucgcgauggucccggcguaugcucaugaccgggacucuggccguguucuuucuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaaaaccacauuuucccugcacuaugcauggaagacuauggcuauggugcuuucaauugucagccucuucccccuguguuugaguaccacgucucagaaaacaaccuggcugccgguauuacucggcucccuggggugcaagccucuuacuauguuucugaucgccgagaauaagauauggggacgacgcagcuggccauugaacgaagguaucauggccgugggcauuguuucgauccuccugucaucucuacugaaaaacgaugugccccuugcugggccucucauugcaggaggcaugcugaucgccuguuacgucauaagugguuccagcgcggacuugucuuuagagaaggcugccgaggugagcugggaagaggaagcagagcauuccggggccucacacaauauucugguagaagugcaggaugacggaacaaugaaaaucaaggaugaggagcgggacgauacccucacuauccugcuuaaagcuacacuguuggcagucaguggcguuuauccccuaagcauuccagccacccuguucgugugguacuucuggcaaaagaaaaagcagagaucuggcgugcucugggacacgccuucacccccagaagucgagagggcggugcuggaugacgggauauaucguaucaugcagcgcggacuuuuaggucggagccagguuggcguagggguguuucaagaaaacgucuuccauacuauguggcacgugaccagaggagcuguucugauguaccagggcaagaggcucgagccgaguugggccagcgugaaaaaggacuugauuuccuacggugggggauggcgacugcagggcucuuggaauacaggcgaggaaguccaggugaucgcaguagagccugggaaaaaccccaagaauguccaaaccgccccaggaacauuuaaaacucccgaaggugaggugggcgcuauugcccucgauuucaagccugggaccucgggaagcccaaucguuaaccgggaaggcaagauagugggucuguaugggaauggagucgugacgacaucaggcacuuacguuuccgcaaucgcucaggccaaagcgagucaggagggcccccuuccugagauugaagacgagguguuucgcaagagaaaccugaccaucauggauuugcacccggggucuggaaaaacaaggcgguaucuaccagccauuguccgagaagcaaucaagagaaaacugcgcacccucauauuagcucccacuagggugguagccagcgagauggcugaagcacugaaggguaugccuauucguuaccaaaccacagccgugaaguccgagcauacgggcaaagagaucguugaccuuaugugccacgccacuuucaccaugcggcugcucucaccagucagagugcccaauuauaacaugaucauuauggaugaagcucauuuuacagacccuucuagcaucgcggcaaggggguacauaaguacccgcgugggaaugggcgaggccgcugccauuuucaugacugcaacaccgcccgguuccgucgaagccuuuccacagagcaaugcuguaauccaggaugaggaacgagacauuccugagagaucuuggaacucaggguaugaguggaucaccgauuuccccggaaagacggugugguuuguuccauccauaaaaaguggcaaugacauugcgaacuguuugcggaagaauggcaaaagggugauccagcugagccgcaagacuuucgauacagaauaccaaaagaccaaaaacaacgacugggacuacgucgugaccacugauaucucggagaugggggccaauuuccgugcagacagaguuauugauccucggaggugccucaagcccgugauccugaaagacggaccagaacgcgucauucuugcugguccgaugccugugacaguagccucugcagcccagcgaagaggccggauagggaggaaccacaauaaggagggagaucaguauaucuacaugggccagccccuaaacaaugacgaggaucaugcucacuggaccgaagccaaaaugcuguuggacaacauuaauacaccagaggguaucauccccgcguuauuugaaccugagcgcgaaaaguccgcagccauugauggggaguauagacugaggggcgaggcucggaagacuuucguggaacucaugcgucgcggagaccugccaguuuggcuuagcuacaaagucgccucagagggcuuucaauauagugaucgaagauggugcuucgacggggaaaggaacaaucaggugcuggaggaaaacauggauguggagauauggacgaaggagggagaacggaaaaagcuccgccccagaugguuggacgcuaggaccuacucugacccucuggcacuacgggaguuuaaagaguucgccgcuggucgaagauccgucagcggcgaucugauccucgagauugggaaacuuccgcagcaccugacacagcgcgcccaaaaugcauuagacaacuugguuaugcugcauaauucagaacagggaggcagggcguaucggcacgccauggaggagcucccagauacuaucgaaacccugaugcuucuggcucucauugccguguugacaggugggguaacccuguuuuucuuaaguggccguggacuaggcaaaacuagcaucgggcugcucugugugauggcauccucuguccuucuguggauggcuagcguggagccccauuggauagccgcauccaucauuuuggaauuuuuccugaugguucuccugaucccugagcccgacagacagaggacgccacaggauaaccaacuugccuacguggucauuggacuccuguuuaugaucuugaccguagcugcgaaugagaugggucuguuagaaacaacuaagaaggaccuaggcauagggcacguggccguugagaaccaccaucacgcagcuaugcuggauguggaccuccauccugccucagccuggacccuuuacgcagucgcuacaaccauuaucacucccaugaugcgccacacaauugaaaacacgaccgccaauaucucucugacugcgauagcuaaccaggccgcaaucuugaugggacuggauaaaggcuggccaauuaguaagauggacaugggugugccucuccuggcccuugggugcuauucgcaggucaauccguuaacacugaccgcugcagugcucauguugguugcccauuacgcgaucauuggccccggacugcaagcuaaagccacccgggaggcacagaagcgaacagccgcuggcaucaugaaaaacccaacuguggaugggauaguagccauugaccuagauccuguggucuaugacgcaaaguucgaaaagcagcugggacagaucaugcuccuuauccuguguacgagccaaauuuugcugaugagaaccacaugggcucucugcgaguccaucacucuggccaccggccccuuaacaacccuuugggaggguucuccagggaaauuuuggaauacuacgauagcgguuucaauggccaacauuuucaggggaagcuaccuggcaggcgcuggucucgccuucucccuaaugaagagucugggcgggggacgccggggcacaggggcacagggagaaaccuugggcgagaaauggaagagacagcugaaucagcucucuaaaagcgaauuuaacacuuauaagcguucagguaucauggagguggacagguccgaagcuaaggaggggcuuaaacggggagagaccacaaagcacgccgucagucgcggcacugccaaacugcgaugguucguggaaagaaauuugguaaagccugaggguaaagugauugaucugggcugugggaggggaggcuggagcuacuauugcgcggggcucaagaagguuaccgaagugaaaggauacacaaagggcggucccgggcacgaggaaccgaucccaauggcuacguacggauggaacuuagucaaacugcauucuggcaaggacguguuuuucauaccucccgagaaaugugauacccuucugugcgacaucggcgaguccucaccaaaucccacuauugaagaggggcggacacuacgcguccucaagaugguggaaccuuggcugagaggaaaccaauuuuguaucaaaauuuugaauccguauaugcccagcguuguagagacccuggagcagaugcagaggaagcacgguggcaugcucgugcgaaacccacuuucgagaaauucuacucaugaaauguacugggucaguugcgggacaggaaacaucguguccgcaguuaauaugaccagccguaugcuguuaaacagauucacgauggcccaccgcaagccuaccuaugagagggauguggaccugggcgcugguacacggcacgucgccguggaacccgagguagcaaacuuggauauuaucgggcagagaauagaaaauauuaaacaugagcacaagucaacuuggcauuacgacgaggauaacccuuauaaaaccugggccuaccacggauccuaugaagugaagccaucuggcagcgcuaguuccaugguuaauggcgucgugaaacuccugacaaagcccugggacgugaucccuauggucacucaaaucgcgaugaccgauacaaccccauuugggcagcagcgcguuuucaaggagaaaguggacacuaggacgcccaaggccaaacgaggaacagcacaaauuauggaaguaaccgcuaaguggcuaugggguuuucuuagccggaacaaaaagccgagaauauguacuagggaggaguucacccgcaaggugcguucuaaugccgcaaucggcgccgucuuuguggacgagaaccaguggaacucagcuaaagaggccguugaagaugagcgguucugggaccuggugcauagagaaagggagcuccacaagcaggggaaaugcgcgacaugcgucuacaacaugaugggaaagcgcgagaagaagcugggcgaguuugguaaggcaaaagggagucgagccauuugguacaugugguugggagcucgguuccuggaguucgaagcccucggcuuuaugaaugaggaucacugguucuccagagaaaacagccuuucuggcguggagggggagggacugcauaaguuagguuauauccugagggacauuucgaaaaucccuggcgggaauauguacgcagaugacacggcuggaugggauacccgcauaacugaagacgauuugcagaacgaggccagaaucacagacauuauggaaccagagcacgcucuccuggccaagucaaucuuuaaacuaaccuaucaaaauaagguaguucgggugcagaggcccgccaaaaauggcacugucauggaugugauuagccgucgagaccagcgcgguuccggacaggugggaacauacggccuuaauaccuucacaaacauggaagcgcaacugaucagacagauggagagugagggcauauuuucuccuagcgaacucgagacuccaaaccuggccgaacgggucuuggauugguuagagaaguaugggguugaaaggcugaagcgcauggcuauuuccggagacgacugugugguaaaacccaucgaugacagauucgccaccgcacucacggcucuuaaugauauggguaaggugcggaaagacaucccgcagugggagccuucaaagggcuggaacgauuggcagcaaguccccuuuugcagucaucacuuccaccagcugauuaugaaagacgggagggagauagugguuccaugucgaaaucaggaugagcuagugggacgugccagagucucucagggcgcagguuggagccugcgcgagaccgccugccucgggaaguccuacgcgcaaauguggcaguugauguauuuucaucggagggaccugagacuugcugccaacgcaaucuguucagccgugccuguagauuggauucccacaagccgcacuaccuggucuauccacgcucaucaccaguggaugacaacugaagacaugcuguccguuuggaaucggguguggauugaggaaaacccauggauggaggauaagacccauaucaguagcuggggagacguccccuaccucggcaaaagggaggaccaauggugcggcucguuaauagggcugacggcccgagcaacaugggcuaccaauauccagguggccauuaaccagguuagacgguugaucggaaaugaaaacuaccuggauuauaugacuuccaugaagagguucaaaaaugagucugacccugaaggugcgcucugguga

SEQ ID NO: 13673 - RNA, 9879 nt, Artificial Sequence
  derived and/or modified CDS sequence (opt3) from DENV-1__FJ461328__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuugcaccccaugucggccuggguuuggaaacuagaaccgagacauggauguccucugaaggggccuggaaacagauccagaggguggagacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagacuuuguggagggucuuaguggcgcgacuuggguagauguuguguuggaacacggguccugugucacaaccauggcaaaggacaaacccacucuggauaucgagcuacucaagacagaagugaccaacccugccgugcugaggaaacuuugcauugaggcuaagaucucuaauacgaccacagacagccgguguccaacucaaggagaagccacccuggucgaggagcaggaugcaaacuucguuugccgccgaacauuuguggacagaggcugggguaauggguguggauuguucggcaaaggcucccuccugacuugcgcuaaguuuaagugcguaaccaaauuagaagggaagauagugcaguacgagaaccugaaauauucagucauugugacaguucacaccggagaucagcaucaaguggguaaugaaaguacugagcacggcacgacagccaccaucacuccccaggcgccuaccacagaaauucagcucaccgacuacggggcccuuacucuggacuguagcccaaggacaggauuggauuucaacgagaugguccuacugacgaugaaggagaaaucuuggcucgugcauaagcagugguuucuggaccuuccgcugcccuggaccuccggcgcaucaacuagccaagaaacauggaaucggcaggauuugcucguaaccuucaaaacagcucacgccaagaagcaggagguugugguccuggguagucaagaaggggcuaugcacacugccuuaaccggcgcaacggagauccagaccucuggaacaacuaccaucuuugccggccaucugaaaugccgucuaaagauggacaaacucacacugaaggggauguccuaugugauguguacuggaagcuucaaacuugaaaaggaggucgcugagacccagcacgguacgguguugguucagauuaaguacgaaggcacagaugcgccuugcaaaauaccauucucgacccaagacgagaagggggugacucagaacggacgccugaucacagcaaaucccauuguaaccgauaaagaaaagccugucaacaucgaggccgagccacccuuuggcgaaucuuauauagugauuggugcuggggagaaagcccucaagcuguccugguucaagaaaggcucaaguaucggaaagauguuugaagcaacugccagaggcgcuaggcggauggccauccuuggggacaccgcaugggauuucggaagcauugguggcguuuuuacauccguggggaaacugguccaucagaucuucggaacggcguacggcguguuguuuucugguguaagcuggaccaugaagauugggauaggcgugcuccugacuugguuaggacugaauucacgaaguacaucccuaagcaugaccuguaucgcuguuggccucgucacacuguaccuuggggugauggugcaggccgacucuggaugcgucauuaacuggaaaggccgcgaguugaagugugguucagggaucuucguuacuaaugaagugcacaccuggacggagcaauauaaguuucaggcagauaguccgaaaagacugagcgccgcuaucggaaaggccugggaggaaggcgugugcgguauuagguccgcaacacggcucgagaacauaauguggaaacagaucucuaacgaacugaaucauauuuuacuggagaacgacaugaaguucaccguagucgugggcgacguugcugggauccuugugcagggaaaaaagaugauucgcccucaacccauggaauacaaauauucguggaagagcuggggcaaggccaaaaucauaggggcggauguccagaauuccacuuuuaucauugacggaccaaacaccccugagugucccgaugaccagagagccuggaauaucugggagguggaagauuacggcuucgguauuuuuacaacuaacaucugguugaagcucagggacucauauacccagguuugcgaucaccgucugaugagugcugcaauaaaagacucuaaggccgugcacgcugauaugggguacuggauugagagcgaaaaaaaugagacauggaagcuagcccgggcauccuucaucgaaguaaagacguguauuuggccaaaaucacauacccuguggagcaacggaguccucgagucugagaugaucauacccaagauccacggcgguccuauuucccaacauaauuaucgaccaggcuacuucacucagacagcggggccguggcaccugggaaaacuugaauuggacuuugaucugugcgagggcaccacugugguggucgacgaacacugcgggaacagaggacccaguuuaaggacaaccacgguuacuggcaagaucauucaugagugguguugccgcagcuguacccucccuccacugcgguucagaggugaggaugggugcugguacggaauggaaaucaggcccgugaaagagaaggaagagaaucuuguaaagucuaugguguccgccggcucaggugaagucgacaguuuuagccugggcuugcucuguauaucgauuaugaucgaggaggugaugcgcucccgauggucucggaaaaugcugaugacagggacccuagcuguuuucuuucugcucaucaugggacagcugacuuggaacgaccuuauucguuugugcaucauggugggcgccaaugcaagcgauagaauggggaugggaacaaccuaucuggcuuuaauggccacauucaagaugaggccuauguuugcagucggccuccuguuccgccggcuuacuucaagagaagugcugcuacucaccauuggucugaguuugguugccuccguggagcugccaaacucuuuagaagagcucggggacggacuggcuaugggcauaaugauccuuaaacuguugacggauuuucaaagcuaccagcucugggcgacacugcuaucccugaccuucauuaagacuaccuuuucacuucacuaugccuggaaaacaauggcaaugguccucagcaucguaagucuguuccccuugugucugucuacuaccucccagaagacgacaugguuaccggugcuccugggcagccuugggugcaagccucugaccauguuuuugauugcugaaaauaaaaucuggggaaggaagucguggccacucaacgaggguauaauggccguuggcaucgugucaauucugcuaucuagucugcuuaaaaacgacgucccccucgccgggccucugaucgcuggaggcauguugauugcauguuacgugaucuccgguagcucugccgauuuaagccuggagaaggcggcugaaguauccugggaggaagaggccgaacauucaggggcaagucacaauauacucguggagguccaggacgauggaacuaugaaaauuaaggacgaggaacgagaugacacacugaccauccuucugaaagccacuuugcuagcuguuagcggcguguauccccugucuaucccagcaacacucuucguguggcauuucuggcaaaagaagaaacagcgcuccggcguccugugggauaccccuucacccccagagguggaacgggccguucuugacgaugggauuuacagaauaaugcagaggggauuacugggucguagucagguaggcgugggggucuuucaagagaacguguuccacacgauguggcacguuacucgcggagcggugcucauguaucagggcaagcgguuggagccgagcugggcuuccgucaaaaaggaccugaucucuuacggugggggauggagauuucagggcucguggaauaccggcgaagaggugcagguaauugccgucgaaccugggaaaaaccccaagaaugugcaaacagcaccaggaaccuucaagacacccgagggugaaguuggcgccaucgcucucgacuuuaaaccugggacuagcggaucaccaauugugaacagggagggcaagaucgucggucuguacgggaauggagugguuaccacguccggcacauaugugagugccauagcacaggcuaaagccucucaggagggcccccuuccugaaaucgaggaugaagucuuccgaaagcggaaccugacuauuauggacuugcauccggggagcggaaaaacccgcagauaccuaccagcgaucgugagggaggccauuaagcggaagcugcgaacacucaucuuagcacccaccagaguaguggcuuccgaaauggccgaggcucugaaagguaugccuauacgcuaucaaacuaccgcaguuaagucagagcacacaggcaaagaaauugucgaucuuaugugccaugccacguuuacuaugaggcugcucucuccagugcgugugcccaauuacaacaugaucaucauggacgaggcccacuucaccgauccuagcaguauugcugcgcggggguauaucuccacaagagucggaaugggcgaagcagccgcuauauuuaugaccgccacuccgcccgguagcauggaggcauucccacagucuaaugccguaauucaggacgaagagagggauaucccugagcgcucauggaacuccggguacgaauggauuacagacuuucccggaaagaccgugugguucguuccaaguaucaaagcuggcaaugauauagcgaacuguuugcgaaagaauggcaagagagugauucagcugagccggaaaacguucgacacugaguaucaaaagacaaaaaacaacgauugggacuacgucgugaccaccgacaucucggaaaugggggccaauuuuagggcagaucgcguuaucgacccucguagaugccucaagcccgugauucugaaagauggaccagagcgggucauccuugcugguccgaugccugugacuguagccucugcagcccagaggcgcggccgaauugggagaaaccauaauaaggagggagaccaguacauauauaugggccagccccuaaacaaugaugaagaccacgcucacuggacagaggccaagaugcuguuggauaacaucaauaccccagaagguauuauccccgcguuauucgagccugaacgggagaaauccgcagccaucgacggggaguacaggcugcgcggcgaagcuagaaagacauuuguggagcucaugaggcggggagaucugccaguuuggcuuagcuauaaagucgccucagaaggcuuccaauacagugaccgucgcuggugcuuugauggggagcgaaacaaucaggugcuggaagagaacauggacguggagauuuggacuaaggaaggagagagaaaaaagcucaggccccggugguuggaugcucgcacguauucugacccucuggcacuaagagaauucaaagaguuugccgcugguaggcgguccgucagcggcgaccugauacucgaaaucgggaagcuuccgcagcaucugacccagcgagcccaaaaugcauuagauaacuugguuaugcugcacaauucagagcagggaggcagagcguaccgccaugccauggaggaacucccagacacaauugagacucugaugcuucuggcucucaucgccguguugaccggugggguaacacuguucuuuuuaaguggcaagggacuaggcaaaaccagcauugggcugcucugugugauggcauccucuguccuucuguggauggcuagcguggaaccccacuggaucgccgcauccauaaucuuggaguucuuucugaugguucuccugauuccugagcccgauaggcagcggacuccacaggacaaccaacuugccuauguggucaucggacuccuguucaugauuuugacgguagcugcgaaugaaaugggucuguuagagaccacaaagaaagaucuaggcaucgggcacguggccguugaaaaccaucaccaugcagcuaugcuggacguggaucuccacccugccucagccuggacucuuuacgcagucgcuaccacaauaauuacccccaugaugcgucauacuaucgagaacacaacggccaauauuucucugaccgcgaucgcuaaccaggccgcaauauugaugggacuggacaagggcuggccaaucaguaaaauggauauuggugugccucuccuggcccuugggugcuacucgcaggucaauccguuaacucugacagcugcagugcucauguugguugcccacuaugcgaucauuggccccggacugcaagcuaaggccaccagagaagcacagaagaggaccgccgcuggcaucaugaaaaacccaacaauagacgggauuguggccaucgaucuagacccuguaguguacgaugcaaaguuugagaaacagcugggacagaucaugcuccuuauucuguguacuagccaaaucuugcugaugcgcacgaccugggcucucugcgaguccauaacacuggccacuggccccuuaaccacacuuugggaagguucuccagggaaguucuggaauaccacuauugcggucucaauggccaacaucuuccggggaagcuaucuggcaggcgcuggucucgccuuuucccuaaugaaaagucugggcgggggacgaagaggcacgggggcacagggagagacauugggcgaaaaguggaagaggcagcugaaucagcucucuaaaagcgaguucaacaccuacaagcgcucagguauuauggaaguugaccgguccgaggcuaaagaggggcuuaagagaggagaaacuaccaaacacgccgugagucguggcacagccaagcugaggugguuugucgagcggaauuuggugaagccugaagguaaaguaaucgaccugggcugugggcgcggaggcuggagcuauuacugcgcggggcucaagaaagugacugagguuaagggauauaccaaaggcggucccgggcaugaagagccgauaccaauggcuacauacggauggaacuuagugaagcugcacucuggcaaagaugucuucuuuaucccucccgagaagugugacacgcuucugugcgauauuggcgaauccucaccaaaucccaccaucgaggaagggcgaacucuaagagugcucaagauggucgagccuuggcugaggggaaaccaauucuguauuaaaaucuugaauccguacaugcccagcgugguugagacacuggaacagaugcagcggaagcaugguggcaugcucguacgcaacccacuuucgagaaauucuacccacgagauguauugggugaguugcgggacuggaaacauugucuccgcagugaauaugacaagcaggaugcuguuaaaccgauuuaccauggcccaccggaaaccuacguacgaacgugacguugaucugggcgcugguaccagacauguggccgucgagcccgaaguggcaaacuuggacaucauagggcagcgcauugagaauaucaagcacgagcauaaaucaacauggcacuaugaugaagacaacccuuacaagacuugggccuaucauggauccuacgagguaaagccaucuggcagcgcuaguuccauggugaauggcguugucaaacuccugaccaagcccugggaugugaucccuauggugacacaaauugcgaugacugacaccacaccauucgggcagcagagggucuuuaaagaaaagguugauacccggacucccaaagccaagagaggaacggcacaaauaauggaggugacagcucgcuggcuaugggguuuccuuagcaggaacaagaaaccgcgaaucuguacccgggaagaguuuacuagaaagguaaggucuaaugccgcaauuggcgccguguucgucgacgagaaccaguggaauucagcuaaagaagccguggaggacgaucgcuuuugggaccugguucaccgugaacgggagcuccacaagcaggggaaaugcgcgaccugcguguauaacaugaugggaaagagagaaaagaaacugggcgaguucgguaaggcaaaagggaguagggccaucugguacaugugguugggagcucgcuuccuggaguuugaagcccucggcuucaugaaugaggaucauugguuuucccgagaaaacagccuuucuggcgucgagggggagggacugcacaaguuagguuacauucugcgggacaucucgaaaauaccuggcgggaauauguaugcagaugacacagcuggaugggauacgagaaucaccgaagacgauuugcagaacgaggccaagauuacugacaucauggaaccagagcaugcucuccuggccaaaucaauuuucaagcuaacauaccaaaauaaggugguaaggguucagcgccccgcaaaaaacggcaccgugauggaugucaucagcagacgggaccagagggguuccgggcaggugggaacuuauggccuuaauacauuuaccaacauggaagcgcaacugauacgucagauggagagugagggcauuuuccucccuaacgaacuggagacaccaaauuuggccgggcgaguguuagauuggcuggaaaaguacggagucgagcgccucaaaagaauggcuaucucuggugacgacuguguugugaagcccaucgaugaccgguuugccacugcacuuaccgcucugaacgauaugggcaaaguaaggaaggacauuccgcagugggaaccuagcaagggguggaaugauuggcagcaagugcccuucugcucccaccacuuucaucagcuaauaaugaaagacggacgcgagaucgucgugccauguagaaaccaggaugagcugguuggccgggccagggugucacagggugcaggguggagucuccgagaaacggccugcuugggaaagucuuaugcgcaaauguggcagcugauguacuuccaccguagagaccuucgccuggcugccaaugcaauuuguagcgccgucccuguggauuggguacccaccucccggacaacuuggucaauccaugcucaccaucaguggaugaccacagaggacaugcucagcguuuggaacaggguguggauugaagagaauccauggauggaagauaaaacuagaaucucuuccugggaggacguccccuauuuaggcaagcgcgaggaccaauggugcggcagucugauaggguugaccgcccgggcaacgugggcuacaaacauccagguggccauuaaucagguuaggcgacugaucggaaacgaaaauuacagcgauuacaugaccucgaugaaaagauuuaagaacgaguccgaaccugagggugcgcucugguga

SEQ ID NO: 13674 - RNA, 9879 nt, Artificial Sequence
  derived and/or modified CDS sequence (opt3) from DENV-1__FJ410234__SS-prME
agcgugacaaugcugcucaugcuuaugcccacagcacuggcuuuccacuugacuacgagaggaggggaaccucauaugaucgucuccaagcaggaaaggggaaaaucuuuacuguuuaagacaucagccgguguuaauaugugcacauuaauugccauggaccucggagaacugugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuuggacagggcaaaaagaugauccgcccucaacccauggaguacaaauauucguggaaaagcugggggaaggccaaaauaaucggagcggacgcccagaauacuaccuucauuaucgauggcccaaacacaccugaaugucccgacgaucagagagcuuggaauauuugggagguggaggacuacgguuuugggaucuucacuaccaacauaugguugaagcucagggauuccuauacacaggucugcgaccaccgucugaugucagcagccauuaaagauaguaaggcugugcacgccgacaugggauacuggaucgaaucugagaaaaaugaaacguggaagcuagcacgggcgagcuuuauugagguuaagaccuguaucuggccaaaaucccauacucuguggucaaacggcgugcucgaaagcgagaugauaauccccaagauuuaugguggcccuaucucucaacacaauuaccgaccaggguacuucacacagaccgccggaccguggcaucugggcaaacuugaguuggauuucgaccugugcgaagggacuacaguagucguggaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgucaaagaaaaggaggaaaaucuuguuaagagcauggugucugcugguuccggcgagguagacucauucagucugggguugcucuguauuagcaucaugaucgaagaggugaugcgcucgcgauggucccggaaaaugcugaugaccggaacucuagccgucuuuuuccugcucauuaugggccagcugacauggaacgaucuuauccguuugugcauuauggugggggcaaaugcuucugacagaaugggaaugggcaccacauaccuggccuuaauggcaacuuuuaagaugaggccuauguucgccguuggucuccuguuucgccggcuuaccagcagagaggugcugcuacucacgauagggcugucauuggucgcuaguguggaacugccauccucuuuagaggaacucggagauggccuggcgaugggcaucaugauucuuaaacuguugacagacuuccaaagccaucagcucugggccacccugcuaucccugacuuuuaucaagaccgcauucucacuucacuaugcuuggaaaacaauggccaugguucucagcauugugagucuguuucccuugugucugucuacuaccucccagaagacgacaugguuaccgguccuccuggggagccuuggaugcaagccucugaccauguucuugaucgccgagaacaaaauaugggguaggaagucguggccacucaaugaaggcaucauggcuguagggauugugucaauccugcuaucuagucugcuuaaaaacgauguuccccucgcaggaccucugauugccggcgguauguugaucgcguguuacgugauauccgggagcucugcugacuuaagccuggagaaggccgcagaggucuccugggaagaggaagccgagcauucaggagcuagucacaacauucucguggaaguacaggaugacggcacuaugaaaaucaaggaugaggagcgagacgauacacugaccauccuucugaaagcaacuuugcuagccgugagcggcgucuauccccugucuauuccagcgacacucuuuguuugguacuucuggcaaaagaagaaacagcgcuccggggugcugugggacaccccuucacccccagaaguggagcgggcuguccuugaugacggaauauauagaaucaugcagagggguuuacugggccguagucagguggggguuggaguauuccaagaaaauguguuucauacgauguggcacgucacucgcggcgccgugcucauguaccaggguaagcgguuggagccgagcugggcauccguuaaaaaggaccugauuucuuacgggggaggcuggagacucaggggcucguggaacaccggggaggaagugcaggucaucgccguggagccuggcaaaaaucccaagaacguacagacagcuccagguaccuucaagacacccgaaggcgaggucggggccauugcacuggauuuuaaaccuggaacuagcggcucaccaaucgugaaucgagaagguaagauaguugggcuuuauggaaacggcguggucaccacguccggcacauacgugagugcuaucgcccaagcgaaagccucucaggaggggccccugccugagauugaagacgagguuuuccggaagcgcaauuugacuaucauggaucuacacccgggaagcgguaaaaccagaagguaucugccagcaauugugcgggaagcuaucaagcgaaagcucagaacauuaauacuggcccccacccgcgucguggcuuccgagauggcagaagcccuuaaaggcaugccuauuagguaccagacuaccgccguaaagucagagcauacagggaaagagaucguggaccugaugugccacgcuacguuuacuaugcgucucuugucuccaguucggguccccaacuauaauaugaucauuauggaugaagcgcauuucaccgacccuagcaguaucgcagccagaggauacauauccacaagggugggcaugggugaggcugccgcaauuuuuaugaccgccacuccgcccgggagcguggaggcuuucccacaaucuaacgcggucauccaggaugaggaacgcgacauuccugagcgaucauggaacuccggauaugaguggaucacagauuuucccggcaagaccguaugguucgugccaaguauaaaaagcggcaacgacauugccaauugucugagaaagaacgggaagcggguuauccagcucucgaggaaaacguuugauacugaauaccagaagaccaaaaauaacgacugggacuacguggucaccaccgauaucucugagaugggagcaaacuuccgcgcugaccgugugauugauccuagacggugccugaagcccguuauccuuaaagacgguccagaaagggugauucuagccggcccgaugccugucacuguggcauccgccgcucaacgccgagggagaauaggacggaaucacaacaaggagggcgaucaguauaucuacaugggucagccccugaauaacgacgaggaucaugcccacuggacagaagcgaagauguuguuagacaauauuaacaccccagaggggaucauccccgcacuguucgaaccugagagggagaaaagcgccgcuguagauggcgaguaucgccucagaggagaggccaggaagacauuuguggaacugaugcggcguggcgaccuuccaguuuggcugucauacaaagucgcuagugagggguuccaguauucugaucgccgauggugcuuugacggagaaagaaauaaccaagugcucgaggaaaauauggauguggagauuuggacuaaggagggugaaaggaaaaaguugcggccccgcuggcuggacgcaagaacguacuccgacccucuagcccugagggaguucaaagaauuugcugccggccggcgaagcgucucaggggaucucauacuugagaucggaaagcugccgcagcacuuaacccagagagcacagaacgcguuggacaaucugguuaugcuccauaacagugaacaaggcggucgcgccuauaggcacgcuauggaggagcugccagauacaauugaaacucuuaugcugcucgccuugaucgcagugcugaccgggggcguaacauuauucuuucuaagcggacggggccuggggaagaccuccauuggacuccuuugugugauggcuucuagcguccuguuguggauggccuccguggagccccauuggaucgcagccucaauaauccuggaguucuuucucaugguucugcuuauuccugagcccgaccgucagagaacuccacaggauaaucagcucgcuuacguggucaucggucuguuguucaugauucugacgguagcggccaacgagaugggcuuacuagaaaccaccaaaaaggaccuggggaucggacacguggcaguugagaaucaccaucacgcugccaugcucgauguggaccuucauccugccucugcauggacucuguacgcugucgccaccacaauaauuacccccaugaugaggcacacuaucgaaaacacaacggcgaacauuaguuugaccgcuaucgccaaucaagcagccauacugaugggccucgauaaagguuggccaaucucgaagauggacauuggggugccucugcuugcuuuaggcugcuauagccaggucaacccgcugacucucacagcagccguguugaugcugguugcgcauuacgcuaucauuggacccggccuacaggccaaagcaacccgcgaggcccaaaagcggaccgcugccgggaucaugaagaauccaacaguggauggaauaguagcaauugaccuggauccuguggucuaugacgcuaaauuugaaaagcagcucggccagaucaugcuucugaucuuguguacuucccagauucugcucaugcgaacgaccugggcccugugcgagucuaucacauuagcgacugguccccuuaccacacugugggaggggucaccaggaaaauucuggaacaccacuauagccguuagcauggcaaauauuuuuagaggcuccuaccucgcuggugccggccuagcauucagucugaugaagucucuagggggaggcaggcgcgggacgggagcucaaggcgaaacacugggugagaaauggaagcggcagcucaaccagcuuagcaagucagaguucaauaccuauaaaagauccgggaucauggagguggaccguagugaagccaaggagggacugaaaaggggcgagacuaccaagcacgccgucagccgggguacagcgaaauugcgcugguuuguggaacgaaaccugguaaagccugagggcaaggugauugaucucggguguggaagaggcggguggucuuacuauugcgcuggacuaaagaagguuacugaagugaaaggcuacaccaagggugggcccggacacgaggaaccgaucccaauggcaacauacggcuggaaucuggucaaacuucauuccggcaaggacguguucuuuauaccucccgagaaaugugauacgcugcuaugcgacaucggggagucaagcccaaaccccaccauugaagagggaaggacucuccggguccugaagaugguggaaccuugguugcgcgguaaucaguucuguaucaagauucugaacccguauaugcccucgguuguagagacacucgagcaaaugcagagaaaacacggcgggaugcuugugaggaauccacugucucgaaacaguacccaugaaauguacugggucuccugcggaacuggcaauaucgugagcgccguuaacaugacaucacggauguuacugaaucguuuuaccauggcucacagaaagccuacguaugagcgcgauguggacuuggguaccgggacaaggcacgucgccguggaacccgagguagcaaaccucgauauuaucggacagcggauagaaaacauuaaacaugagcacaaguccacuuggcauuacgacgaggauaauccuuauaaaaccugggccuaccacggcucuuaugaagugaagccaagcggcagugcuuccagcaugguuaacggggucgugaagcugcuaacaaaacccugggacgugaucccuauggucacucagaucgcgaugaccgauacaaccccauucggacaacagagaguuuuuaaggagaaaguggacacucgcacgcccaaggccaaaagggguacagcacagauuauggaaguaaccgcucgauggcuuuggggcuuccugucucggaauaagaagccgagaauauguacuagggaggaauuuacccgcaaagugcguucaaacgccgcaaucggggccgucuucguggacgagaaucaauggaacagugcuaaggaggccguugaagaugagcgguuuugggaccucgugcauagagaaagggagcugcacaaacagggaaagugcgcgacaugcgucuacaauaugaugggcaaacgcgaaaagaaguugggugaguucgggaaagcaaagggaucccgagccauuugguacauguggcugggcgcucgguuucucgaguucgaagcccuuggcuucaugaacgaggaucacugguuuagcagagaaaauucucugucggggguggagggagaggguuuacauaaacugggcuauaucuugagggacauuucaaagaucccugggggaaacauguacgcagaugacacggcuggcugggauacccgcauaacugaagacgaucuccagaaugaggccaaaaucacagacauuauggaaccagagcacgcucugcuagccaaggcaaucuucaaacuuaccuaucagaacaagguaguuagagugcaacggcccgcgaagaaugguacugucauggaugugauuagcaggcgugaccagcgaggguccggacaggugggcacauacggccugaacaccuuuacaaauauggaagcccagcucauccgccaaauggagagugaggggauauucucuccuagcgaacuggagacuccaaacuuggcugaaagagccuuagauuggcuggagaaauauggagucgaacggcucaagaggauggcaauuuccggugacgacuguguugugaaacccaucgaugaccgcuuugcuaccgcccuuacggcacugaacgauaugggcaagguaagaaaagacaucccgcagugggagccuucaaagggguggaaugauuggcaacaggugcccuucugcagucaucacuuucaccaacuaauuaugaaggacggacgggagauagucgugccauguaggaaccaggaugaacugguuggccgagcccgugugucucagggugcgggguggagccucagagagaccgcuugcuugggaaaauccuacgcccagauguggcaacugauguauuuccaucgccgggaccuuaggcuggcagccaaugcuaucuguucagccgucccuguggauuggguacccacaagcagaacuaccuggucuauucacgcacaucaccaguggaugacaacugaagacaugcucuccguuuggaaccgcguguggaucgaggaaaauccauggauggaggauaagacccauauuaguagcugggaggacguccccuacuuaggcaaacgggaagaccaguggugcggcucgcugaucggguugacggcuagggccacaugggcgaccaacauacaaguggcuaucaaucagguucgaagacugauuggaaacgagaauuaccucgauuauaugacuuccaugaagcgguuuaaaaacgaaucugacccugagggugcccuuugguga

SEQ ID NO: 13675 - RNA, 9879 nt, Artificial Sequence
  derived and/or modified CDS sequence (opt3) from DENV-1__FJ410235__SS-prME
agcgugaccaugcugcuaaugcuuaugcccacugcacuggcuuuccacuugacuacgcgaggcggggaaccucauaugaucgucuccaagcaggaaaggggaaaaucuuuacuguuuaagaccucagccgguguuaacaugugcacucuaauugccauggaccucggcgaguucugugaagauacuaugaccuacaaaugcccgcggauaaccgaagcggaaccggacgauguggacuguuggugcaaugcuaccgauacuuggguaaccuaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacgucgauuacccagaagggcaucauauuuauccugcucauguuagugacgccaucaauggccaugcgcugcgucgggauuggaagcagagauuucguggagggucugaguggcgcgacuuggguugacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacaaccaaucccauuguaacugacaaggagaaaccugucaacaucgaagcagagccacccuucggcgaguccuauauagugauuggugccggggaaaaggcuuugaagcugucaugguuuaaaaagggcaguagcaucggaaaaauguucgaggccaccgcaagaggcgccaggcggauggcuauccucggggauacagccugggacuuuggauccauugguggcguuuucacgucuguggggaagcugguccaucagaucuuuggaaccgcauacggcgugcuuuucagcgguguaucauggacuaugaaaauugggauaggcgugcuguugacauggcucggacugaauagucgauccaccagcuuaucuaugacauguaucgcgguuggccuggucacucuauaccucggggugauggugcaggcugauucaggaugcgucauuaacuggaagggccgcgaacugaagugugguagugggaucuuuguuaccaaugaggugcacacguggacagaacaguauaaauuccaagccgacagcccgaagagacuuuccgcagccaucggaaaggcuugggaggagggcgugugcgguauuaggucugccacccgguuggaaaacauaauguggaagcagaucucgaacgagcugaaucauauucuccuggaaaacgacaugaaauuuacuguagucgugggcgauguugcagggaucuuagcucagggaaagaaaaugauucgcccucagcccauggaguacaaguauagcuggaaguccuggggcaaagccaagaucauaggggcggacgugcaaaauaccacauucaucauugauggaccaaacacuccugaaugucccgacgaucagagagccuggaauaucugggaggucgaggacuacggcuuugguauuuucaccacaaacaucuggcugaaacuuagggauucauauacacaggugugcgaccaccguuugaugagugcugcaauaaaggauucuaaagccguucacgcugacaugggguacuggauugaaagcgagaagaaugaaaccuggaagcucgcccgggcauccuucaucgaggugaaaacuuguauuuggccaaagucacauacacuguggagcaacggaguacuagaaucugagaugaucguccccaaaauauauggcgguccuaucucccagcacaauuaccgaccaggcuacuuuacccaaacugcggggccguggcaucugggaaagcucgagcuggauuucgaccuuugcgaaggcacaaccgugguggucgaugagcacugcgggaacagaggacccaguuugaggacgacuaccguuacaggcaaaauuauccacgaaugguguugccgcagcuguacccugccuccauuacgguuuaagggugaggacgggugcugguauggaauggagauuagacccgugaaggaaaaagaggaaaaucucguaaagucuaugguguccgccggcucaggugaggucgacaguuucagccugggccuucuguguaucucgauaaugauugaagaggugaugaggucccgcuggucucgaaaaauguugaugacugggacacucgcuguauuuuuccugcuaaucaugggacagcugaccuggaacgaucucauccggcugugcauuauggugggcgccaaugcaagcgaccguauggggaugggaacaacuuaccuugcuuugauggccaccuuuaagaugagaccuauguucgcagucggccuguuauuuaggcgccucacgucacgggaggugcugcuucugacaaucggucuaagucucguugccuccguggaacugccaaacucuuuggaggaacugggggauggauuagcuaugggcauuaugauacucaaacugcuuaccgacuuccagagccaucaacugugggcgacuuugcucucccugaccuuuaucaagacaacuuucucacuacacuaugccuggaagaccauggcaaugguccugagcauuguaagucuuuuuccccucugucugucuacgacaucccagaaaaccacuugguugccggugcuguuaggcagccucgggugcaagccucugacaauguuccuuaucgcugagaauaaaauuuggggaagaaagucguggccacugaacgaagguaucauggccguuggcauagugucaaucuugcucucuagucugcucaagaacgaugucccccuggccgggccucuuauugcuggaggcaugcucaucgcauguuacgugauuuccgguagcucugccgaccugagcuuggagaaggcggcugagguauccugggaagaggaagccgagcauucaggggcaagucacaauaucuuaguggaaguccaggaugacggaaccaugaaaauaaaggaugaggagagggacgauacucugacaauucuccugaaggccacccuucuggcuguuagcggcguguaucccuugucuaucccagcaacgcuauucgugugguacuuuuggcagaaaaagaaacaacgauccggcguccugugggacacuccuucacccccagaaguggagcgcgccguucucgaugacgggaucuaucggauuaugcagagaggacugcuugguaggagucagguaggcgugggggucuuccaggaaaacguguuucauaccauguggcacguuacacguggagcgguguuaauguaccaaggcaagcgccuggagccgagcugggcuuccgucaaaaaggaccucauaucuuacggugggggauggcgguugcagggcucguggaauaccggcgaggaagugcagguaaucgccgucgagccugggaagaaccccaaaaaugugcagacagcaccaggaacuuucaagaccagcgaaggugagguuggcgccauugcucuggauuuuaaacccgggacgucaggauccccuaucgugaacagagaaggcaagauugucggucucuaugggaauggagugguuacaacaaguggcaccuacgugucugccaucgcacaagcuaaagccagccaggagggcccacugcccgagauagaagacgaggucuucaggaagcgaaaccuuacaaucauggaucugcacccuggguccggaaagacccggcgcuauuugccggcgauugugagagaagccaucaaaaggaagcuacggacucugauucucgcaccaacccgaguaguggcuucagagauggccgaggcuuuaaaagguaugcccaucagauaccagacaacggcaguuaagucugagcauacuggcaaagagauagucgaccugaugugccacgccaccuuuacaaugcgccuucugagcccugugagggugccaaauuauaacaugauuaucauggaugaagcccauuucaccgaccccaguuccaucgcugcgcguggguacauuagcacucgggucggaaugggcgaggcagccgcuaucuuuaugacagccaccccuccggguucuguagaagcauucccccaaucaaaugccauaauucaggaugaggaaagagacaucccagagagguccuggaacaguggguaugaguggauuacggauuuuccuggaaagacugugugguucguucccagcaucaagucgggcaaugacauagcuaacugucuccgcaaaaauggcaagcgagugauucaguugucuagaaaaacauucgauaccgaauaccagaagaccaaaaacaacgacugggacuacgucgugacuacagauaucuccgagaugggggcgaauuuucgggccgacaggguuaucgauccacgccguugccugaagccugugauucucaaggacggacccgaaagagucauccuggcagguccaaugccggugaccguagcuagcgccgcacaacggaggggccgcauugggcgaaaccacaauaaagagggagaucaguauauauacaugggccagccucuuaacaaugacgaggaucaugcccacuggacagaagcuaagaugcuacuggacaacaucaauacucccgaggguauuaucccagccuuguucgaacccgagagagaaaaaucagcggcaaucgauggggaguaucgguuaaggggcgaggcccgcaagacguuuguggaacugaugagaaggggagaccucccuguuuggcugaguuacaaagucgcuucugagggcuuccaguauuccgaucggcguuggugcuuugacggggaacgcaacaaucaagugcuugaggaaaacauggauguggagauuuggaccaaggagggagaaagaaagaaacugagaccaagguggcucgacgcccggacauacagcgaccccuuggcucugcgcgaguucaaggaauuugcagccgguagaaggucagucaguggcgaucuaauacuggagaucgggaaacucccucagcaccuuacucagcgggcucagaaugcccuggacaacuuaguuauguugcauaauagcgaacaaggaggccgagcauauagacacgcgauggaggagcugccggauaccauugaaacacucaugcugcuugcccugaucgcugugcucaccggugggguaacuuuguucuuucuguccggccgcggauuaggcaagacgucuauugggcuacugugugugauggccagcuccguccuccuuuggauggcaucaguggagccacauuggaucgcugccucuauaauccuggaguucuuuuugaugguucugcucauucccgagccugacaggcagcggacaccccaggauaaccagcuggcauacguggucaucggacuucucuucaugauucugacaguagccgcuaaugagauggguuugcuggaaacuaccaaaaaggacuuaggcaucgggcacguggcgguugagaaccaccaucacgccgcaaugcuagauguggaccugcauccagcuagugccuggacacucuacgccgucgcaaccacuauaauuacaccuaugaugcgucacacgaucgaaaacaccacugcuaauauuucgcuuacagccaucgcgaaccaagcugccauacugaugggauuggauaaaggcuggcccaucagcaagauggacauuggugugccacugcucgcacuggggugcuauucccaggucaauccucuuaccuuaaccgccgcugugcugaugcucguugcacauuacgccaucauuggcccgggauugcaggcgaaggcuacaagagaggcccagaaaaggacugcagccggcaucaugaagaaccccacgguggaugggauaguagcuauugaccuggauccaguggucuaugacgccaaauuugaaaagcagcuaggacagaucaugcugcucauccuuuguaccucucagauucuguugaugcgcacaacuugggcacugugcgagucaaucacccucgcuacaggcccucugaccacuuuaugggaggguagccccgggaaauucuggaauacgacaauagccguuuccauggcgaacauuuuccggggaaguuaccuugccggcgcaggucuggcuuuuucucucaugaaaagccuaggcgggggacgaagaggcaccggggcccaaggagaaacucugggcgagaaguggaaaaggcaguugaaucagcuggguaagucagaguucaacaccuauaaacgcuccgggaucauggagguggaccggagugaagcaaaggagggacucaaaagaggcgagacaacuaagcacgcugucagccgugguaccgccaaacuuaggugguuuguggaacggaaucugguaaaaccagagggcaaggugauugauuugggguguggacgcggcggguggucuuacuauugcgccggacugaaaaagguuacagaagugaaaggcuacacgaagggugggccuggacacgaggaacccaucccgauggcgaccuacggcuggaaccucgucaaauuacauuccggcaaggacguguucuuuauaccaccugagaagugugauacucugcuuugcgacaucggggagucaagccccaauccaacaauugaagagggacgaacccugagaguccuaaaaaugguggaacccuggcucagggguaaccaguucuguaucaagauucugaauccuuauaugccgucgguuguagagacuuuggagcaaaugcagcggaaacacggcgggaugcuggugcgcaacccccucucuagaaauaguacacaugaaauguacugggucuccugcggaaccggcaacaucgugagcgcuguuaauaugacgucaaggaugcuucugaaccgauuuaccauggcacaccggaagccaacauaugagcgugauguggacuuaggugccgggacuagacacgucgcuguggaaccugagguagccaaccuggauauuaucggacagcgcauagaaaauauuaaacaugagcacaaguccaccuggcauuacgacgaggauaaccccuauaagacaugggcauaccacggcucuuaugaagugaaaccuagcggcagugccuccagcaugguuaauggggucgugaaguugcucacuaaaccaugggacgugauccccauggucacccagaucgcuaugacagauaccacuccuuucggacaacagaggguuuuuaaggagaaaguggacacgcggacaccaaaggcgaagagagguaccgcccagauuauggaaguaacugcaaaauggcuguggggcuuccuaucucgcaacaagaaacccaggauauguacccgagaggaauuuacacggaaggugagaucaaaugcugccaucggggcagucuucguggacgagaaccaauggaauagugccaaagaggcuguugaagaugagagguuuugggaccuugugcaucgcgaacgugagcugcacaagcagggaaagugcgccacgugcgucuacaacaugaugggcaaacgggaaaagaaacucggugaguucgggaaggcgaaaggauccagagcaauuugguacauguggcugggcgccagguucuuggaguuugaagcucugggcuucaugaaugaggaucacugguuuagccgcgaaaacucucucucggggguggagggagagggucuucauaagcugggcuauaucuuacgagacauuucaaaaaucccagggggaaauauguacgccgaugacaccgcaggcugggauacucggauaacagaagacgaucugcagaacgaggcuaagaucaccgacauuauggaaccugagcacgccuugcucgcuaagagcaucuucaaacugacuuaucagaauaagguaguuagagugcaaaggccagccaaaaacgguacagucauggaugugauuucccgcagagaccagcgggggaguggacaggugggcaccuacggccuaaauacauuuacuaacauggaagcacagcuuaucaggcaaauggagucugaggggauauucagccccuccgaacuggagaccccuaaccucgcgggacguguccuggauugguuggaaaagcaugguguugagcgauuaaaacgcauggccauuucaggcgacgacugugugguaaagccaaucgaugacagauuugcuacggcccugaccgcacucaaugauauggggaaggugcggaaagacaucccccagugggaaccgaguaagggauggaacgauuggcagcaggucccuuucugcucucaccacuuucaucaacuuauuaugaaagacggcagggagauagugguucccugucgcaaucaggaugagcugguggguagagcucgggucagccagggggccggauggucccuaagggaaacagcaugccugggcaagucauaugcccagauguggcaacucauguacuuccaccgacgugacuugagacuggcggcuaacgccaucuguagcgcagugccaguagauuggguuccuacuucucgcaccacaugguccauucaugcccaccaucaguggaugacuaccgaggacaugcuuaguguguggaaucgggucuggaucgaagagaaccccuggauggaagauaaaacgcacauuagcucguggggcgacgugccauaucuggggaagagggaggaccaguggugcggaucccucaucgguuuaacagcuagagccaccugggcaacuaauauacaaguugcuaucaaccaggugcgccggcugauuggcaaugagaacuacuuggauuacaugacaucuaugaagagguuuaaaaaugaaucagaccccgagggggcccugugguga

SEQ ID NO: 13676 - RNA, 9879 nt, Artificial Sequence
  derived and/or modified CDS sequence (opt3) from DENV-1__FJ410236__SS-prME
agcgugaccaugcugcucaugcuuguccccacagcccuggcuuuccacuugacuacgagaggaggggaaccucauaugaucguuuccaagcaggaaagaggaaaaucuuuacuguuuaagaccucagccggugugaauaugugcacacuuauugccauggaccucggcgaacugugugaagauacuaugaccuacaaaugcccacggauuacagagaccgaaccggacgauguagacuguuggugcaaugcgacugauacaugggugaccuaugggacguguagucaaacuggagagcaccgccgagacaagcguagcgucgcucuugcaccccaugugggccuggguuuggagaccagaacagaaacuuggauguccucugagggggcauggaaacagauccagaggguugaaaccugggcccuccggcacccuggauucacagugauugcucuguuucuggcacaugccaucggcaccucgauuacgcagaagggcaucauauucauccucuuaaugcuggucacuccaucaauggcuaugcgcugcguggggauuggaagcagagauuuuguagagggucuuaguggcgccacauggguugacguggucuuggagcacggguccugugugaccacuauggcgaaggauaaacccacacuggacaucgaacugcucaagaccgaggugacgaacccugcaguccugaggaaacuuugcauugaagccaagaucucuaauaccacaacugauagccgguguccaacccaaggagaggcuacacugguugaagaacaagacgccaacuucgugugccgccgaacuuuuguagauagaggcugggguaauggguguggauuguucggcaaaggcucccucauaaccugcgcaaaguuuaagugcgugacaaaacuggaggggaagauuguccaguacgaaaacuuaaaauauucagugaucguuaccgugcacacuggagaccagcaucaagucgguaaugagaguacggaacacggcacaaccgcuacuauuacaccccaagccccuaccaccgagauccagcugacugacuacggggcgcucacacuugauuguagcccaaggacgggacuggacuucaacgaaaugguguugcuaaccaugaaggagaaaucuuggcugguacauaagcagugguuucucgaucugccgcuucccuggacuuccggcgccucaacaagccaagagaccuggaaucggcaggaccuguugguuacauucaaaacugcacacgcuaagaagcaggaaguggucgugcucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugucauguguaccggaucguucaaacuggagaaggaaguggccgagacgcagcacgguacaguucuugugcagauaaaguacgagggcaccgacgcuccuugcaaaaucccauucucgacucaagaugaaaaggggguaacacagaacggacgcuugauuaccgcgaaucccaucgucacugacaaagagaagccugugaacauagaagcagagccacccuuuggcgagucuuauauuguuaucggugccggggaaaaagcuaugaagcuguccugguucaagaaaggcucaaguaucggaaagauguuugaggccaccgcaagaggcgccaggcggauggcuauucucggggauacagccugggacuucggaagcaucgguggcguguuuacguccgucgggaaacuggugcaucagauuuucggaaccgcauacggcguacuauuuucuggugugagcuggacuaugaagauagggaucggcguucuguugacauggcucggacuaaauucacgaaguaccuccuuaagcaugacauguauugcggucggccuggugacucuauaccucggggugaugguccaggcugauucuggaugcguuaucaacuggaaaggccgcgaacugaagugugguucagggaucuucgugaccaaugaggugcacacguggacagaacaauauaaguuucaggccgacaguccgaaaagacuuagcgcagccauuggaaaggcuugggaggagggcguaugcgguauaagguccgccacccgguuggaaaacaucauguggaaacagauuucuaacgagcugaaucauauccuccuggaaaacgacaugaaguucacugucgugguuggcgauguggcagggauuuuagcucagggcaagaagaugauccgcccucaacccauggaguacaaauauucguggaaaagcuggggcaaggccaagauaaucggggcggacguccagaauaccacauuuauuaucgauggaccaaacacuccugaaugucccgacgaucagagagccuggaauauuugggagguggaggacuacggcuucgguaucuuuaccacaaacauauggcugaaacuuagggauuccuauacgcagguuugcgaccaccguuugaugucagcugcaauuaaagauaguaaggccgugcacgcugacaugggguacuggaucgaaucugagaaaaaugaaaccuggaagcucgcccgggcauccuucauugagguaaagacuuguaucuggccaaaaucccauacacuguggucaaacggaguccuagaaagcgagaugauaauccccaagauuuauggcgguccuaucucucaacacaauuaccgaccaggcuacuucacccagacugcggggccguggcaucugggaaaacucgagcuggauuuugaccuuugcgaaggcacaaccgugguggucgaugagcacugcgggaacagaggacccuccuugaggacgacuaccguuacaggcaagauuauccacgaaugguguugccgcaguuguacccugccuccauuacgguucagaggugaggacgggugcugguauggaauggagauaaggcccgugaaagaaaaggaggaaaaucucguaaagagcauggugucugccggcuccggugaggucgacucauuuagucugggccuucuguguauuagcaucaugaucgaagaggugaugcgcucgcgauggucccggaaaauguugaugacugggacacucgcuguuuucuuucugcuaauuaugggacagcugaccuggaacgaucucauccgucugugcauuauggugggcgccaaugcaucugacagaauggggaugggaacaacuuaccuugcuuugauggccaccuucaagaugaggccuauguuugcagucggccuguuauuccgccggcucacgagcagagaggugcugcuucugacaauaggucuaucacucguugccaguguggaacugccaaacuccuuggaggaacugggggauggauuagcuaugggcaucaugauucucaaacugcuuaccgacuuucaaucucaucagcugugggcgacuuugcucagccugaccuucaucaagacaacuuuuucccuacacuaugccuggaaaaccauggcaaugguccugucaauuguaagccuuuucccccucugucugaguacgacaucucagaagaccacuugguugccggugcuguuaggcucccucgggugcaagccucugacaauguuucuuaucgcugagaauaaaauauggggaaggcgaagcuggccacugaacgaagguaucauggccguuggcauugugucgaucuugcucucaucucugcuaaagaacgaugucccccuggccgggccucuuauugcuggaggcaugcucaucgcauguuacgugauaagugguuccagcgccgaccugucuuuggagaaagcggcugagguaagcugggaagaggaagccgagcauuccggggcaucacacaauauuuuaguggaaguccaggaugacggaaccaugaagaucaaagaugaggagcgcgacgauacucugacaauccuccugaaggccacccuucuggcuguuaguggcguguaucccuugagcauuccagcaacgcuauucgugugguacuucuggcagaagaagaagcagcggucuggcguccugugggacacuccuucacccccagaaguggagagagccguucucgaugacgggauauauaggaucaugcagcguggacugcuuggucgcagccagguaggcgugggggucuuucaagaaaacguguuccauaccauguggcacguuacacggggagcgguguuaauguaccagggcaaaagacuggagccgaguugggcuagcgucaagaaagaccucauuuccuacggugggggauggagguugcagggcucuuggaauaccggcgaggaagugcagguaaucgccgucgagccugggaagaaccccaaaaaugugcaaacagcaccaggaacuuuuaagacccccgaaggugagguuggcgccauugcucuggauuucaagccugggacgucgggaagcccaaucgugaaccgagaaggcaaaauagucggucucuaugggaauggagugguuacaacuucaggcaccuacguguccgccaucgcacaggcuaaggccagucaggagggcccccugccugagauugaagacgaggucuuucggaaacgcaaccuuacaaucauggaucugcacccggggucuggaaagaccagaagguauuugccagcgauugugcgggaagccaucaaacgaaagcuaagaacucugauacucgcacccacccgcguaguggcuagcgagauggccgaggcuuuaaaggguaugccuauuagguaccaaacaacggcaguuaaauccgagcauacuggcaaggagaucgucgaccugaugugccacgccaccuucacaaugcgucuucugucaccagugcgggugcccaauuauaacaugaucauuauggaugaagcccauuuuaccgacccuucuagcaucgcugcgagaggguacauaaguacuagggucggaaugggcgaggcagccgcuauuuucaugacagccaccccgcccgguuccguagaagcauuuccacagagcaaugccgugauccaggaugaggaacgcgacauuccugagcgaucuuggaacucaggguaugaguggaucacggauuuccccggaaaaacuguuugguuugugccauccauaaagaguggcaaugacauugcuaacugucucaggaaaaauggcaagcgggucauccaguugagcaggaagacauucgauaccgaauaccagaaaaccaagaacaacgacugggacuacgugguuacuacagauaucucggagaugggggcgaauuuccgcgccgaccgugugauugauccuagacggugccugaaacccgucauccucaaggacggaccagaaagggugauucuggcagguccgaugccuguaaccguggcuucugccgcacagcgccgaggcagaauagggcggaaccacaauaaagagggagaucaguauaucuacaugggccagccccuuaacaaugacgaggaucaugcccacuggacagaagcuaagaugcuacuggacaacauuaauacuccagaggguaucauccccgccuuguuugaaccugagagggaaaaguccgcggcaauugauggggaguaucgcuuaagaggcgaggccaggaaaacguucguugaacugaugcggcguggagaccucccagucuggcugagcuacaagguggcuucagagggcuuucaauauagugaucgccgauggugcuucgacggggaaagaaacaaucaggugcuugaggaaaacauggaugucgagauauggaccaaagagggagaaaggaagaaacugcggccccgcuggcucgacgccagaacauacucugacccuuuggcucugagggaguuuaaggaguucgcagccggucggcgauccguuagcggcgaucuaauccuggagauugggaaacucccgcagcaccuuacucagagagcucaaaaugcccuggacaacuuagugauguugcauaauucagaacagggaggccgcgcauauaggcacgcgauggaggagcugccagauaccaucgaaacacucaugcugcuugcccugauugcuguacucaccgguggggugacuuuguuuuuccugaguggccggggauuaggcaagacgagcaucgggcuacugugugucauggccuccucugugcuccuuuggauggcaagcguugagccccauuggauagcugccuccaucauucuggaauuuuucuugauggugcugcucaucccugagcccgaccgucagagaaccccacaggauaaccaacuggcauacgucguaauuggacuucucuuuaugauccugacaguggccgcuaaugagauggguuugcuggaaacuaccaagaaagacuuaggcauagggcacguugcgguggagaaccaccaucacgccgcaaugcuagaugucgaccugcauccugcuucagccuggacacucuacgccguggcaaccacuauuaucacacccaugaugaggcacacgauugaaaacaccacugcuaauaucucucuuacagccauagcgaaccaggcugccauccugaugggauuggauaagggcuggccaauuaguaaaauggacaucggugucccucugcucgcacuggggugcuauagccaggugaauccgcuuaccuuaaccgccgcuguucugaugcucguggcacauuacgccauuaucggccccggauugcaagcgaaggcuacacgcgaggcccagaaacggacugcagccggcauaaugaagaacccaacgguagaugggauuguggcuaucgaccuggauccugucguuuaugacgccaaguucgaaaaacagcuaggacagaucaugcugcucauucuuuguaccagccaaauccuguugaugcgaacaacuugggcacugugcgaguccauaacccucgcuacaggcccccugaccacuuuaugggaggguucuccagggaaguuuuggaauacgacaauugccgugucaauggcgaacaucuucagaggaagcuaccuugccggcgcaggucuggcuuucucccucaugaaaagucuaggcgggggaaggcgcggcaccggggcccagggagaaacucugggcgagaaguggaaacggcaguugaaucagcugucuaagagcgaauuuaacaccuauaagagaucagguauuauggaggucgaccguuccgaagcaaaagaggggcucaagaggggagagacaacuaaacacgcugugagucggggcaccgccaaacuucgcugguucguagaacgaaaucuggugaaaccugaggguaagguuaucgauuugggcugugggagaggaggcuggagcuacuauugcgccgggcugaagaaagugacagaagucaagggauacacgaaaggcggucccgggcacgaggaaccgauaccaauggcgaccuacggauggaaccucgugaaguuacauucuggcaaagacgucuuuuucaucccucccgagaagugugauacucugcuuugcgacauuggcgaguccucaccaaaucccacaaucgaagaggggaggacccugcgggugcuaaaaaugguugaaccuuggcuccgcggaaaccaauuuuguauuaagauccugaauccguauaugcccagcguaguggagacuuuggagcagaugcagagaaagcacgguggcaugcuggucaggaacccacucucgcgaaauucuacacaugaaauguacugggugaguugcgggaccggaaacauuguuuccgcugugaauaugacgagccggaugcuucugaaccguuucaccauggcacacagaaaaccuacauaugagcgcgaugucgacuuaggcgccgguacuaggcacguggcuguagaacccgagguggccaaccuggauaucauagggcagcggauugaaaauaucaagcaugagcacaaaucaaccuggcauuacgacgaggauaacccuuauaagacaugggcauaccacggauccuaugaaguuaaaccaucuggcagcgccaguuccauggucaauggcguggugaaguugcucacuaagcccugggacgucaucccuaugguuacccaaauugcuaugacagauaccacuccauuugggcagcagagaguguucaaagagaagguagacacgcgcacacccaaagcgaagaggggaaccgcccaaauaauggaagugacugcaaaauggcugugggguuuucuaagccgaaacaagaagccgcggaucuguaccagagaggaguucacaaggaaaguccgcucuaaugcugccauuggcgcaguguuuguugacgagaaccaguggaacucagccaaggaggcuguggaagaugagcguuucugggaccuuguccaucgggaaagagagcugcacaaacaggggaagugcgccacgugcguguacaacaugaugggaaaaagggaaaagaagcucggcgaguuugguaaagcgaaggggagucgcgcaaucugguacauguggcugggagcccgauucuuggaguucgaagcucugggcuuuaugaaugaggaucacugguucucccgggaaaacagccucucuggcguagagggggagggacuucauaaacuggguuauauuuuaagagacaucucgaagauaccuggcgggaauauguacgccgaugacaccgcaggaugggauacuaggaucacagaagacgaucugcagaacgaggcucgcauuaccgacaucauggaaccagagcacgccuugcucgcuaaaucaauuuuuaagcugacuuaucaaaauaaaguugugagaguccagcggcccgccaagaacggcacagugauggaugugaucagcaggcgugaccagcgagguuccgggcaggucggaaccuacggccuaaauacauucacuaacauggaagcacaacuuauacgccagauggagagugagggcauauuuucuccuagcgaacuggagaccccaaaccucgcggaaagaguucuggauugguuggagaaguauggggugaaacgguuaaagaggauggccaucuccggagacgacuguguagugaaacccaucgaugaccgcuucgcuacggcccugaccgcacucaaugauauggguaaggucagaaaagacauuccgcagugggaaccuucaaagggcuggaacgauuggcagcaagugcccuuuugcagucaucacuuccaccagcuuauaaugaaggacgggcgggagaucguugugccauguaggaaucaggaugagcuggucggacgagcucgugugucucagggcgccgguuggagccuaagagaaacagcaugccuggggaaauccuacgcccaaauguggcagcucauguauuuucaucgccgggacuugaggcuggcggcuaacgccauuuguucagcaguaccuguugauuggauccccacuagcagaaccacauggucuauucacgcccaucaccaguggaugacuaccgaggacaugcuuuccguguggaaucgcgucuggaucgaagagaacccauggauggaagauaagacgcauauaaguagcuggggagacgugcccuaccugggcaaacgggaggaccaauggugcggcucgcucaucggguuaacagcuagggccaccugggcaacuaauauucagguugcuaucaaccaggugcgaagacugauuggaaaugagaacuacuuggauuauaugacauccaugaagcgguucaaaaaugaaucugacccugagggugcccugugguga

SEQ ID NO: 13677 - RNA, 9879 nt, Artificial Sequence
  derived and/or modified CDS sequence (opt3) from DENV-1__FJ410238__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggaaaaaagaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccaggugugcgaccaccgucucaugagugcagccauuaaagauucuaaggcuguucacgccgacaugggguacuggaucgaaagcgagaaaaaugaaacauggaagcuggcacgggcguccuucauugaggugaagacguguaucuggccaaaaucacauacccuauggagcaacggaguacuggaaucugagaugauaauccccaagauuuauggcgguccuaucucccaacacaauuaccgaccaggcuacuucacucagacagccgggccguggcaucucggaaaacuggagcuugauuuugacuugugcgaaggcaccacugucgugguggaugagcacugcgggaacagaggacccagucugaggacaaccacggucacuggcaagauuauccacgaaugguguugccgcagcuguaccuuaccuccacuccgguucaaaggugaggacgggugcugguauggaauggagauaagacccguuaaggaaaaggaggaaaaucuggugaaaucuaugguauccgcuggcucaggugagguggacaguuuuagccuuggccuguuguguauuucgaucaugaucgaagaggucaugaggucccgcuggucucgaaagaugcucaugacagggacccuggccguguucuuucuacugauuaugggacagcucacuuggaacgaucugauccggcuuugcauuaugguuggcgcaaauacaagcgaccguauggggaugggaaccacauacuuggcucugauggccacuuucaaaaugagaccuauguuugcagugggcuuacucuucaggcgccugaccucacgggagguccuucugcuaacgauaggucucagucugguggccuccgcugaauugccaaacucucuggaggaauuaggggauggacucgcgaugggcaucaugauucugaagcuucugacagacuuucaaagccaucaguugugggccacccuccugucccuaacuuucaucagaaccacauuuucacugcacuaugcauggaaaacuauggcuaugguucuuagcauugugagucucuucccccuguguuugucuaccacgucccagaagacaaccuggcugccggucuuacucggcagccuggggugcaagccucuuacuauguuucugaucgccgagaauaaaauauggggaaggaagucguggccauugaacgaagguaucauggccguaggcauugugucaauccuccugucuagucuacugaaaaacgauguuccccuugcugggccucucauugcaggaggcaugcugaucgccuguuacgugauauccgguagcucugcggacuugagcuuagagaaggcugccgaggucuccugggaagaggaagcagagcauucaggggccagucacaauauucugguggaaguacaggaugacggaacaaugaaaaucaaggaugaggagcgagacgauacccucacuauccugcuuaaagcuacacuguuggcagugagcggcgucuauccccuaucuauuccagccacccuguucguuugguacuucuggcaaaagaagaaacagcgcuccggcgugcucugggacacgccuucacccccagaaguggagcgggcgguccuggaugacgggauauauagaaucaugcagaggggacuuuuaggucguagucaggugggcguugggguauuucaagaaaacguguuccauacuauguggcacgucacccgcggagcugugcugauguaccagggcaagcggcucgagccgagcugggccuccguuaaaaaggacuugauuucuuacggugggggauggagacugcagggcucguggaauacaggcgaggaagugcaggucaucgcaguggagccugggaaaaaccccaagaauguacaaaccgccccaggaacauuuaagacuagcgaaggugaggucggcgcuauugcccucgauuucaaacccgggaccucaggauccccuaucgugaacagggaaggcaagauaguuggucuguaugggaauggaguggucacgacaaguggcacuuacgugucugcaaucgcucaggccaaagcgagccaggagggcccacuucccgagauugaagacgagguuuuucgaaagcggaaccugaccaucauggauuugcacccuggguccggaaaaacacgcagauaucuaccggccauugugagggaagcaaucaagcggcgacugagaacccucauauuagcuccaacucgcgucguggccucagagauggcugaagcacugaaggguaugcccauuagguaccaaaccacagccguaaaaucugagcauacgggcaaggagaucguggaccuuaugugccacgccacuuucaccaugcgucugcucagcccuguucgggucccaaauuauaacaugaucauuauggaugaagcucauuuuacagaccccaguuccaucgcggcaagaggguacauaagcaccagggugggaaugggcgaggccgcugccauuuucaugacugcaacaccuccggguucuguggaagccuuuccccagucaaaugcugucauccaggaugaggaacgcgacauuccagagcgauccuggaacaguggguaugaguggaucaccgauuucccuggaaaaacgguaugguuugugcccagcauaaagucgggcaaugacauugcgaacuguuugagaaaaaauggcaagcggguuauccagcugucuaggaagacuuucgauacagaauaccaaaaaaccaagaacaacgacugggacuacguggucaccacugauaucuccgagaugggggccaauuuccgcgcagaccgugugauugauccaagacggugccucaaaccuguuauccugaaggacggacccgaaagggugauucuugcugguccaaugccggucacaguggccagcgcagcccagcgccgaggcagaauagggcggaaccacaauaaagagggagaucaguauaucuacaugggccagccucuaaacaaugacgaggaucaugcucacuggaccgaagccaagaugcuguuggacaacauuaauacacccgaggguaucaucccagcguuauuugaacccgagagggaaaagucagcagccauugauggggaguaucgccugagaggcgaggcuaggaaaacuuucguagaacucaugcggcguggagaccugccuguguggcuuaguuacaagguugccucugagggcuuucaauauuccgaucgccgauggugcuucgacggggaaagaaacaaucagguccuggaggaaaacauggauguggagauauggacgaaagagggagaaaggaagaaacuccggccacgcugguuggacgcuagaaccuacagcgacccccuggcacuaagggaguuuaaggaauucgccgcuggucggcgaucagugaguggcgaucugauccucgagauugggaaacuuccucagcaccugacacagagagcccaaaaugcauuagacaacuuggucaugcugcauaauagcgaacagggaggccgcguuuauaggcacgcgauggaggagcucccggauacuaucgaaacccugaugcuucuggcccucauugcuguguugacaggugggguaacccuguuuuucuuauccggccggggacuaggcaagacuucuaucgggcugcucugugugauggccagcuccguccuucuguggauggcaucaguggagccacauuggauagcugccucuaucauuuuggaauuuuuccugaugguucuccugauccccgagccugaccgucagagaacgccccaggauaaccaacuugcauacguggucauuggacuccuguuuaugaucuugaccguagccgcuaaugagaugggucuguuagaaacaacuaagaaagaccuaggcauagggcacguggcgguugagaaccaccaucacgccgcaaugcuggauguggaccuccauccagcuagugccuggacccuuuacgccgucgcaacaaccauuaucacuccuaugaugaggcacacaauugaaaacacgaccgcuaauaucucgcugacugccauagcgaaccaggcugccaucuugaugggacuggauaagggcuggcccauuagcaaaauggacaucggugugccacuccuggcacuugggugcuauucccaggucaauccuuuaacacugaccgccgcugugcucauguugguugcacauuacgccauuaucggcccgggacugcaagcgaaggcuacccgcgaggcccagaaacggacagcagccggcauaaugaagaaccccacuguggaugggauuguagcuaucgaccuagauccaguggucuaugacgccaaguucgaaaaacagcugggacagaucaugcuccuuauucuguguacgucucaaaucuugcugaugcgaaccacaugggcacucugcgagucaauaacucuggcuaccggcccuuuaacaacccuuugggaggguagccccgggaaguuuuggaauacuacgauugccguuuccauggcgaacaucuucagaggaaguuaccuggccggcgcaggucucgcuuucucucuaaugaaaagccugggcgggggaaggcgcggcacaggggcccagggagaaaccuugggcgagaaguggaaacggcagcugaaucagcucucaaaguccgaauuuaacacuuauaagagaagugguauuauggagguggaccguagcgaagcaaaagaggggcuuaagaggggagagaccacaaaacacgcugucucucggggcacugccaagcugcgcugguucguggaacgaaauuugguaaaaccagaggguaaggugaucgaucugggcugugggagaggaggcugguccuacuauugcgccgggcucaagaaaguuaccgaagugaagggauacacaaaaggcgguccugggcacgaggaacccauaccgauggcgacguacggauggaacuuagucaagcugcauucaggcaaagacguguuuuucaucccaccugagaagugugauacccuucugugcgacauuggcgagagcucgcccaauccaacuaucgaagaggggaggacacuacggguccucaaaaugguggaacccuggcugcgcggaaaccaauuuuguauuaagaucuugaauccuuauaugccgucuguuguagagacccuggagcagaugcagagaaagcacgguggcaugcucgugaggaacccccuuagucgaaauuccacucaugaaauguacugggucagcugcgggacaggaaacauugugucagcuguuaauaugaccucccggaugcuguuaaaccguuucacgauggcacacagaaaaccaaccuaugagcgcgauguggaccugggcgccgguacaaggcacgucgcuguggaaccugagguagccaacuuggauaucauagggcagcggauugaaaauaucaagcaugagcacaaaucuacuuggcauuacgacgaggauaaccccuauaagaccugggcauaccacggaagcuaugaagugaaaccuaguggcuccgccagcucuaugguuaauggcgucgugaagcuccugacaaagccaugggacgugauccccauggucacucaaauugcuaugaccgauacaaccccuuuugggcagcagagaguuuucaaagagaagguggacacucgcacgccaaaagcgaagaggggaacagcccaaauaauggaaguaaccgcaaaauggcuaugggguuuucuuucacgaaacaagaagccccggaucuguacuagagaggaauucaccaggaaagugcgcaguaaugcugccauuggcgcagucuuuguggacgagaaccaguggaauuccgccaaggaggcuguugaagaugagcguuucugggaccuggugcaucgggaaagagagcuccacaaacaggggaagugcgccacaugcgucuacaacaugaugggaaaaagggaaaagaagcugggcgaguuugguaaagcgaaggggagccgcgcaaucugguacaugugguugggagcccgauuccuggaguucgaagcucucggcuuuaugaaugaggaucacugguucucucgggaaaacucgcuuucaggcguggagggggagggacugcauaaauuagguuauauucugagagacaucagcaagauaccgggcgggaauauguacgccgaugacacggcaggaugggauaccaggaucacugaagacgauuugcagaacgaggcuaaaauuacagacaucauggaaccugagcacgcccuccuggcuaaguccauuuuuaaacuaaccuaucaaaauaagguaguucgcgugcagagaccagccaagaacggcacugucauggaugugaucagucggagggaccagcgugguucugggcaggugggaacauacggccuuaauaccuucacaaacauggaagcacaacugauacgacagauggagagcgagggcauuuuuucccccucagaacucgagacuccuaaccuggcggggcgcgucuuggauugguuagaaaaacauggaguugagagacugaagcggauggccaucaguggugacgacugugugguaaaaccaaucgaugacagguucgcuaccgcccucacggcacuuaaugauaugggcaaggugcgcaaagacauuccccagugggaaccgucuaagggguggaacgauuggcagcaagucccuuuuugcagccaccacuuccaucagcugauaaugaaggacggaagagagaucgugguucccugucggaaucaggaugagcuagugggcagggcucgagucucccagggugccggguggucacugcgugaaaccgcaugccucggaaaaagcuaugcccaaauguggcaguugauguacuuucacagacgcgaccugcggcuugcggcuaacgccauuuguucugcagugccaguagauuggguuccuacauccaggacuaccuggaguauccaugcccaccaucaguggaugacaacugaggacaugcugagcguguggaauagagucuggauugaagagaaccccuggauggaagauaagacccacgugucguccuggggcgacguuccauaucucggcaaacgcgaggaccaauggugcgggucuuuaaucggacugacggcucgggccacaugggcaaccaauauacagguggcuaucaaccaggucaggcgauugcuggguaaugagaacuaccucgauuacaugacuucaaugaagagauucaaaaaugaaagcgaccccgagggcgcccuuugguga

SEQ ID NO: 13678 - RNA, 9879 nt, Artificial Sequence
  derived and/or modified CDS sequence (opt3) from DENV-1__FJ410239__SS-prME
uccgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaacuugccgagacgcagcacggaacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccgcagggaaacugguucaucagauuuucggaaccgcguacggcguguuguuuucuggugucagcuggacuaugaagauagggaucggcgugcuccugacaugguuaggacuaaauucacgaaguaccucccuaagcaugacauguauugcuguaggccucgugacucuguaccuugggguuaugguccaggccgauucuggaugcgugaucaacuggaaaggccgcgaauugaagugugguucagggaucuucgugaccaaugagguccacacguggacagaacaauauaaguuucaggcagacaguccgaaaagacugagcgccgcuauuggaaaggccugggaggagggcguuugcgguauaagguccgcaacccggcucgaaaacaucauguggaaacagauuucuaacgagcugaaucauaucuuacuggaaaacgacaugaaguucacuguggugguaggcgaugucgcugggauucuugcccagggcaaaaagaugauccgcccucaacccauggaguacaaauauucguggaaaagcuggggcaaggcgaagauaaucggggccgacgugcagaauaccacauuuauuaucgauggaccaaacacuccugaaugucccgacgaucagagagcuuggaauauuugggagguugaggacuacggcuucgguaucuuuaccacaaacauaugguugaagcucagggauuccuauacacaggugugcgaccaccgucugaugucagcagccauuaaagauaguaaggcuguccacgccgacaugggguacuggaucgaaucugagaaaaaugaaaccuggaagcuagcacgggcgagcuucauugaggugaagacuuguaucuggccaaaaucccauacacuguggucaaacggaguucucgaaagcgagaugauaauccccaagauuuauggcgguccuaucucucaacacaauuaccgaccaggcuacuucacccagacugccgggccguggcaucugggaaaacuugaguuggauuuugaccugugcgaaggcacaaccgugguagucgaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgugaaagaaaaggaggaaaaucuugucaagagcaugguuucugcuggcuccggugagguggacucauuuagucugggcuugcucuguauuagcaucaugaucgaagagguaaugcgcucgcgauggucccggaaaaugcugaugacugggacacuagccguguucuuucugcucauuaugggacagcugaccuggaacgaucuuauccguuugugcauuauggucggcgcaaaugcuucugacagaauggggaugggaacaacuuaccuggccuuaauggcaaccuucaagaugaggccuauguuugccgugggccuccuguuccgccggcuuacgagcagagagguucugcuacucacaauaggucugucauugguggcuagugucgaacugccaaacuccuuagaggaacucggggauggacuggcgaugggcaucaugauucuuaaacuguugaccgacuuucaaucucaucagcucugggccacucugcuaagccugaccuucaucaagacaacuuuuucccuucacuaugcauggaaaaccauggcuauggugcucucaauuguuagccuguuccccuugugucugaguacgacaucucagaagaccacuugguuaccgguguuucucggcucccuggggugcaagccucuuacaauguuccugaucgccgagaauaaaauauggggaaggcgaagcuggccauugaacgaagguaucauggccgucggcauuguaucgauccuccugucaucucuacugaagaacgaugugccccuugcugggccucucauugcaggaggcaugcugaucgccuguuacguuauaagugguuccagcgcggacuugucuuuagagaaagcugccgaggugagcugggaagaggaagcagagcauuccggggccucacacaauauucuggucgaagugcaggaugacggaaccaugaagaucaaagaugaggagcgcgacgauacucucacaauccugcuuaaggcuacccuguuggcaguaaguggcguguauccccuaagcauuccagccacgcuguucgucugguacuuuuggcagaaaaagaagcagcggucuggcguucucugggacacuccuucacccccagaaguggagagagcggugcuggaugacgggauauauaggaucaugcagcguggacuuuuaggucgcagccaggucggcguggggguuuuccaagaaaacguauuucauaccauguggcacgugacacggggagcuguccugauguaccagggcaaaagacucgagccgaguugggccagcgugaagaaagacuugauuuccuacggugggggauggaggcugcagggcucuuggaauaccggcgaggaaguucaggugaucgcagucgagccugggaagaaccccaaaaaugugcaaacagccccaggaacuuucaagacccccgaaggugagguaggcgcuauugcccucgauuuuaagccugggacgucgggaagcccaaucgucaaccgagaaggcaaaauagugggucuguaugggaauggaguugugacaacuucaggcaccuacgucuccgcaaucgcucaggccaaggcgagucaggagggcccccuuccugagauugaagacgagguguuccggaaacgcaaccugacaaucauggauuugcacccggggucuggaaagaccagaagguaucuaccagccauuguucgggaagcaaucaaacgaaagcugagaacucucauauuagcucccacccgcguggucgccagcgagauggcugaagcacugaaggguaugccuauuagguaccaaacaacggccgugaaauccgagcauacuggcaaggagaucguagaccuuaugugccacgccaccuuuacaaugcgucugcucucaccagugcggguucccaauuauaacaugaucauuauggaugaagcucauuucaccgacccuucuagcaucgcggcaagaggguacauaaguacuagggucggaaugggcgaggccgcugccauuuuuaugacagcaaccccgcccgguuccguggaagccuucccacagagcaaugcugugauccaggaugaggaacgcgacauuccugagcgaucuuggaacucaggguaugaguggaucacggauuuucccggaaaaacugucugguucguaccauccauaaagaguggcaaugacauugcgaacuguuugaggaaaaauggcaagcgggugauccagcugagcaggaagacauucgauaccgaauaccagaaaaccaagaacaacgacugggacuacguugugacuacagauaucucggagaugggggccaauuuucgcgcagaccgugucauugauccuagacggugccucaaacccgugauccugaaggacggaccagaaaggguuauucuugcugguccgaugccugugaccgucgccucugcagcccagcgccgaggcagaauagggcggaaccacaauaaagagggagaucaguauaucuacaugggccagccccuaaacaaugacgaggaucaugcucacuggacagaagccaagaugcuguuggacaacauuaauacuccagaggguaucauccccgcguuauucgaaccugagagggaaaaguccgcagccauugauggggaguaucgccugagaggcgaggcuaggaaaacguuuguggaacucaugcggcguggagaccugccaguauggcuuagcuacaagguggccucagagggcuuccaauauagugaucgccgauggugcuuugacggggaaagaaacaaucagguucuggaggaaaacauggaugucgagauauggaccaaagagggagaaaggaagaaacuccggccccgcugguuggacgcuagaacauacucugacccucuggcacuaagggaguucaaggaauuugccgcuggucggcgauccgugagcggcgaucugauccucgagauugggaaacuuccgcagcaccugacucagagagcccaaaaugcauuagacaacuuggugaugcugcauaauucagaacagggaggccgcgcguauaggcacgccauggaggagcucccagauaccaucgaaacacugaugcuucuggcucucauugccgucuugaccggugggguuacucuguucuuuuuaaguggccggggacuaggcaagacgagcaucgggcugcucugugugauggcauccucuguacuucuguggauggcuagcguggagccccauuggauagccgcauccaucauuuuggaguucuuucugaugguccuccugaucccugagcccgaccgucagagaaccccacaggauaaccaacuugccuacgugguuauuggacuccuguucaugaucuugacaguggcugcgaaugagaugggucuguuagaaacuaccaagaaagaccuaggcauagggcacgucgccguagagaaccaccaucacgcagcuaugcuggauguggaccuccauccugccucagccuggacacuuuacgcaguugcuaccacuauuaucacacccaugaugaggcacacgauugaaaacaccacugccaauaucucucugacagcgauagcuaaccaggccgcaaucuugaugggacuggauaagggcuggccaauuaguaaaauggacaucggugugccucuccuggcccuugggugcuauucgcaggucaauccguuaacccugaccgcugcagugcucauguuggucgcccauuacgcgauuaucggccccggacugcaagcuaaggccacacgcgaggcacagaaacggacugccgcuggcauaaugaagaacccaacgguggaugggauuguugccaucgaccuagauccugugguauaugacgcaaaguuugaaaaacagcugggacagaucaugcuccuuauucuguguaccagccaaaucuugcugaugcgaacaacuugggcucucugcgaguccauaacccuggccacaggccccuuaaccacucuuugggaggguucuccagggaaguucuggaauacgacaauugcggugucaauggccaacaucuucagaggaagcuaccuggcaggcgcuggucucgccuuuucccuaaugaaaagucugggcgggggaaggcgcggcaccggggcacagggagaaacuuugggcgagaaguggaaacggcagcugaaucagcucucuaagagcgaguucaacaccuauaagagaucagguauuauggaggucgaccguuccgaagcuaaagaggggcuuaagaggggagagacaacuaaacacgccguuagucggggcaccgccaagcugcgcugguuuguggaacgaaauuuggucaaaccugaggguaaggugaucgaucugggcugugggagaggaggcuggagcuacuauugcgcggggcucaagaaaguaacagaagugaagggauacacgaaaggcggucccgggcacgaggaaccgauaccaauggcuaccuacggauggaacuuaguuaagcugcauucuggcaaagacguguucuuuaucccucccgagaagugugauacucuucugugcgacauuggcgaguccucaccaaaucccacaaucgaagaggggaggacccuacggguccucaaaaugguggaaccuuggcugcgcggaaaccaauucuguauuaagaucuugaauccguauaugcccagcgucguggagacucuggagcagaugcagagaaagcacgguggcaugcucguuaggaacccacuuucgcgaaauucuacacaugaaauguacuggguaaguugcgggaccggaaacauuguguccgcagucaauaugacgagccggaugcuguuaaaccguuuuaccauggcccacagaaaaccuacauaugagcgcgauguggaccugggcgcugguacuaggcacguugccguggaacccgaggucgcaaacuuggauaucauagggcagcggauugaaaauaucaagcaugagcacaaaucaaccuggcauuacgacgaggauaacccuuauaagacaugggccuaccacggauccuaugaagugaaaccaucuggcagcgcuaguuccaugguaaauggcgugguuaagcuccugacuaagcccugggacgucaucccuauggugacccaaauugcgaugacagauaccacuccauucgggcagcagagaguguuuaaagagaaggucgacacgcgcacacccaaagccaagaggggaaccgcacaaauaauggaaguuacugcuaaauggcuaugggguuuccuuagccgaaacaagaagccgcggaucuguaccagagaggaauuuacaaggaaagugcgcucuaaugccgcaauuggcgccguauucguggacgagaaccaguggaacucagcuaaggaggccgucgaagaugagcguuuuugggaccuggugcaucgggaaagagagcuccacaaacaggggaagugcgcgacgugcguuuacaacaugaugggaaaaagggaaaagaagcugggcgaguucgguaaagcaaaggggagucgcgccaucugguacaugugguugggagcucgauuccuggaguuugaagcccucggcuucaugaaugaggaucacugguuuucccgggaaaacagccuuucuggcguggagggggagggacugcauaaauuagguuauauucugagagacaucucgaagauaccuggcgggaauauguacgcagaugacaccgcuggaugggauacuaggaucacagaagacgauuugcagaacgaggcccgcauuaccgacaucauggaaccagagcacgcucuccuggccaaaucaauuuucaagcuaacuuaucaaaauaaagucgugagaguacagcggcccgcaaagaacggcacaguuauggaugugaucagcaggcgugaccagcgagguuccgggcaggucggaaccuacggccuuaauacauuuacuaacauggaagcgcaacugauacgccagauggagagugagggcauuuucucuccuagcgaacucgagaccccaaaccuggccgaaagaguguuggauugguuagagaaguaugggguggaacggcugaaaaggauggcuaucuccggagacgacugugucguuaagcccaucgaugaccgcuuugccacggcacucaccgcucuuaaugauauggguaaagugagaaaggacauuccgcagugggagccuucaaaaggcuggaacgauuggcagcaaguacccuucugcagucaucacuuucaccagcugauaaugaaggacgggcgggagaucguggucccauguaggaaucaggaugagcuggugggacgagcccguguuucucagggcgcagguuggagccugagagagacagccugccucgggaaguccuacgcgcaaauguggcaguugauguauuuccaucgccgggaccugaggcuugcugccaacgcaauuuguucagccgugccugucgauuggauccccacuagcagaaccacauggucuauucacgcucaucaccaguggaugacuaccgaagacaugcuguccguguggaaucgcguauggaucgaggaaaacccauggauggaggauaaaacgcauauaaguagcuggggagacguucccuaccucggcaagcgggaggaccaauggugcggcucguuaaucgggcugacagccagggcaaccugggcuacuaauauucagguggccaucaaccagguccgaagauugauuggaaaugaaaacuaccuggauuauaugacauccaugaaacgguuuaagaaugagucugacccugaaggugcgcucugguga

SEQ ID NO: 13679 - RNA, 9879 nt, Artificial Sequence
  derived and/or modified CDS sequence (opt3) from DENV-1__FJ410240__SS-prME
agcgugaccaugcugcuaaugcuuaugcccaccgcacuggcuuuccacuugacuacgagaggcggggaaccucauaugaucgucuccaagcaggaaagggggaagucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccgcccacacuggagaccagcaucaaguugguaaugagaguacggaacacggcacaaccgcgacuaucacaccccaggccccuagcacagagauucaguuaaccgacuacggggcacugacucucgauuguucuccaaggacaggacuugacuuuaacgaaauggugcuguugacgaugaaggagaaauccuggcuaguccauaagcagugguuccuggaucucccgcugcccuggaccucaggcgcuagcacaagucaagagacauggaaucggaaagaccuucuggugaccuuuaagacagcccacgcuaagaaacaggaaguaguuguguuggguucucaggagggggccaugcacacugcacucaccggcgccacggaaauccaaaccuccggaacaacuaccaucuucgcuggccaucugaagugccguuuaaaaauggauaagcugacacuaaaagggaugagcuaugucauguguacuggaucguucaagcucgagaaggaaguggcggagacccagcacgguacgguccuggugcagauuaaauacgagggcacagacgcaccuugcaagauaccauuuucuacccaggaugaaaaagggguuacucaaaacggacgccuuaucacagccaaucccauugugaccgacaaggagaaaccuguaaacaucgaagcugagccacccuucggcgaguccuauauagucauuggugccggggaaaaggcauugaagcugucaugguuuaaaaagggcaguagcaucggaaaaauguucgaggccacugcuagaggcgccaggcggauggcaauccucggggauaccgcgugggacuuuggauccauugguggcguguucacaucuguugggaagcuggugcaucagaucuuuggaacggcuuacggcguccuuuucagcggugugucauggaccaugaaaauugggauaggcguacuguugacuuggcucggacugaauagucgauccacuagcuuaucuaugaccuguaucgccgugggccugguuacacuauaccucggggucauggugcaggcagauucaggaugcgugauuaacuggaagggccgcgaacugaagugugguagugggaucuuugucacuaaugagguucacaccuggacggaacaguauaaauuccaagccgacagcccgaagagacuuuccgcugccaucggaaaagcaugggaggagggcgugugcgguauuaggucugcuacacgguuggaaaacauaauguggaagcagaucucgaacgagcugaaucauauucuccuggaaaacgacaugaaauuuaccgugguagucggcgauguggccgggaucuuagcgcagggaaagaaaaugauucgcccucagcccauggaguacaaguauagcuggaaguccuggggcaaagccaagaucauaggggcugacguucaaaauacuaccuucaucauugauggaccaaacacaccugaaugucccgacgaucagagagcauggaauaucugggagguggaggacuacggcuuugguauuuucacuaccaacaucuggcugaaacuuagggauucauauacacaggucugcgaccaccguuugaugagugccgcuauaaaggauucuaaagccgugcacgcagacaugggguacuggauugaaagcgagaagaaugaaacguggaagcucgcgcgggccuccuucaucgagguuaaaaccuguauuuggccaaagucacauacucuguggagcaacggagugcuagaaucugagaugaucauacccaaaaucuauggcgguccuauuucccagcacaauuaccgaccaggcuacuuuacacaaaccgcugggccguggcaucugggaaagcucgagcuggauuucgaccuuugcgaaggcacuacaguagucguggaugagcacugcgggaacagaggacccaguuugaggaccacgacugugaccggcaaaaucauucacgaaugguguugccgcagcuguacacugccuccauuacgguuuaagggugaggacgggugcugguauggaauggagaucagacccgucaaggaaaaagaggaaaaucucguuaagucuaugguguccgccggcucaggugagguagacaguuucagccugggccuucuguguauaucgauuaugaucgaagaggugaugaggucccgcuggucucgaaaaauguugaugaccgggacucucgcagucuuuuuccugcuaaucaugggacagcugacauggaacgaucucauucggcugugcaucauggugggcgcuaaugccagcgaccguauggggaugggaaccacauaccuugcauugauggccacuuuuaagaugagaccuauguucgcuguuggccuguuauuuaggcgccucaccucacgggaggugcugcuucugacgauuggucuaagucucgucgcguccguggaacugccaaacucuuuggaggaacugggggauggauuagccaugggcauaaugauccucaaacugcuuacagacuuccagagccaucaacugugggcaaccuugcucucccugacuuuuauuaagaccacauucucacuacacuaugcuuggaagacuauggccaugguucugagcaucgugagucuuuuuccccucugucugucuaccacgucccagaaaacaaccugguugccgguccuguuaggcagccucgggugcaagccucugacuauguuccuuauugccgagaauaaaaucuggggaagaaagucguggccacugaacgaagguauaauggcuguaggcaucgugucaauuuugcucucuagucugcucaagaaugauguuccccuggcagggccucuuaucgccggaggcaugcucauugcguguuacgugaucuccgguagcucugcugaccugagcuuggagaaggccgcagaggucuccugggaagaggaagccgagcauucaggggcuagucacaauauauuaguggaaguacaggaugacggaacaaugaaaauuaaggaugaggagagggacgauacccugacuauccuccugaaggcaacacuucuggccgugagcggcgucuaucccuugucuaucccagcgacccuauucguuugguacuuuuggcagaaaaagaaacaacgauccggcgugcugugggacacgccuucacccccagaaguggagcgcgcuguccucgaugacgggauuuaucggauaaugcagagaggacugcuugguaggagucaggugggcguugggguauuccaggaaaacguguuucauacuauguggcacgucacccguggagccguguuaauguaccaaggcaagcgccuggagccgagcugggcauccguuaaaaaggaccucaucucuuacggugggggauggcgguugcagggcucguggaauacaggcgaggaagugcaggucauugccguggagccugggaagaaccccaaaaauguacagaccgcuccaggaacauucaagacuagcgaaggugaggucggcgccaucgcacuggauuuuaaacccgggaccucaggauccccuauugugaacagagaaggcaagaucguuggucucuaugggaauggaguggucacgacaaguggcacuuacgugucugcuauagcccaagcgaaagccagccaggagggcccacugcccgagaucgaagacgagguuuucaggaagcgaaaccuuaccauuauggaucugcacccuggguccggaaagacacggcgcuauuugccggcaaucgugagagaagcuauuaaaaggaagcuacggacccugauccucgccccaacucgagucguggcuucagagauggcagaagccuuaaaagguaugcccauaagauaccagaccacagccguaaagucugagcauacgggcaaagagauuguggaccugaugugccacgcuacuuuuaccaugcgccuucugagcccuguuagggucccaaauuauaacaugaucaucauggaugaagcgcauuucacagaccccaguuccauugcagcccguggguacaucagcacccgggugggaaugggcgaggcugccgcaauauuuaugacugccacaccuccggguucuguggaggcuuucccccaaucaaaugcggucauucaggaugaggaaagagacaucccagagagguccuggaacaguggguaugaguggauuaccgauuuuccuggaaagacgguaugguucgugcccagcaucaagucgggcaaugacauagccaacugucuccgcaaaaauggcaagcgaguuauucaguugucuagaaaaacuuucgauacagaauaccagaagaccaaaaacaacgacugggacuacguggucaccacugauaucuccgagaugggggcaaauuuucgggcugacagggugaucgauccacgccguugccugaagccuguuauucucaaggacggacccgaaagagugauccuggccgguccaaugccggucacaguggcaagcgccgcucaacggaggggccgcauugggcgaaaccacaauaaagagggagaucaguauauauacaugggccagccucuuaacaaugacgaggaucaugcccacuggaccgaagcgaagaugcuacuggacaacaucaauacacccgaggguauuaucccagcauuguucgaacccgagagagaaaaaucagccgcuaucgauggggaguaucgguuaaggggcgaggcccgcaagacuuuuguagaacugaugagaaggggagaccucccuguguggcugaguuacaaaguugcuucugagggcuuccaguauuccgaucggcguuggugcuuugacggggaacgcaacaaucaaguccuugaggaaaacauggauguggagauuuggacgaaggagggagaacgaaagaaacugagaccaagguggcucgacgcacggaccuacagcgaccccuuggcccugcgcgaguucaaagaauuugcugccgguagaaggucagugaguggcgaucuaauacuggagaucgggaaacucccucagcaccuuacacagcgggcacagaaugcgcuggacaacuuagucauguugcauaauagcgaacaaggaggccgagccuauagacacgcuauggaggagcugccggauacuauugaaacccucaugcugcuugcccugaucgcaguucucacagguggggugaccuuguucuuucuguccggccgcggauuaggcaagacuucuauugggcuacuguguguaauggcuagcuccgugcuccuuuggauggccucagucgagccacauuggaucgcagccucuauaauccuggaguucuuuuugauggugcugcucauucccgagccugacaggcagcggacgccccaggauaaccagcuggcuuacguugugaucggacuucucuucaugauucugaccgucgcggccaaugagauggguuugcuggaaacaacuaaaaaggacuuaggcaucgggcacguagcaguggagaaccaccaucacgcugccaugcuagauguugaccugcauccagccagugcauggacccucuacgcuguggccacaaccauaauuacuccuaugaugcgucacacaaucgaaaacacgaccgcgaauauuucgcuuacugcuaucgccaaccaagcagccauacugaugggauuggauaaaggcuggcccaucagcaagauggacauuggugucccacugcucgcucuggggugcuauucccaggugaauccucuuacauuaaccgcagccguccugaugcucguggcgcauuacgcuaucauuggcccgggauugcaggccaaggcaaccagagaggcccagaagaggacagcugccggcaucaugaagaaccccacuguugaugggauaguggcaauugaccuggauccaguaguguaugacgcuaaauuugaaaagcagcuaggacagaucaugcugcucauccuuuguacgucucagauucuguugaugcgcaccacaugggcccugugcgagucaaucacucucgcgaccggcccucugacaaccuuaugggaggguagccccgggaaauucuggaauacuacgauagccgucuccauggcaaacauuuuccggggaaguuaccuugcuggcgccggucuggcauuuucucucaugaaaagccuaggcgggggacgaagaggcacaggggcucaaggagaaacccugggcgagaaguggaaaaggcaguugaaucagcugucaaaguccgaguucaacacuuauaaacgcagugguaucauggagguugaccggagcgaagccaaggaggggcucaaaagaggagagaccacaaagcacgccgugucucguggcacugcgaaacuuaggugguuugucgaacggaaucuggugaaaccagaggguaagguaauugauuugggcugugggcgcggaggcugguccuacuauugcgcugggcugaaaaaggugaccgaaguuaaaggauacacaaagggcgguccugggcacgaggaacccaucccgauggcaacguacggauggaaccucgugaaauuacauucaggcaaggacgucuucuuuauaccaccugagaagugugauacccugcuuugcgacaucggcgagagcucgcccaauccaacuauugaagaggggcgaacacugagagugcuaaaaauggucgaacccuggcucaggggaaaccaguucuguaucaagauucugaauccuuauaugccgucugugguugagaccuuggagcaaaugcagcggaaacacgguggcaugcugguacgcaacccccucaguagaaauuccacucaugaaauguacugggugagcugcgggacaggaaacaucgucucagccgugaauaugaccuccaggaugcuucugaaccgauuuacgauggcucaccggaagccaaccuaugagcgugauguugacuuaggcgccgguacaagacacguggcagucgaaccugagguggccaaccuggauauuaucgggcagcgcauagaaaauauuaaacaugagcacaagucuacuuggcauuacgacgaggauaaccccuauaagaccugggcuuaccacggaagcuaugaaguaaaaccuaguggcuccgcgagcucuauggugaauggcguugucaaguugcucacaaaaccaugggacgugauccccauggugacucagaucgccaugaccgauacaaccccuuucgggcaacagagggucuuuaaggagaaaguugacacucggacgccaaaggcaaagagaggaacagcucagauuauggaagugaccgccaaauggcugugggguuuccuaucacgcaacaagaaacccaggauauguacucgagaggaauuuacccggaagguaagaaguaaugcagccaucggcgcuguguucgucgacgagaaccaauggaacuccgccaaagaggcgguggaagaugagagguuuugggaccuuguucaucgcgaacgugagcugcacaagcaggggaagugcgcaacaugcguguacaacaugaugggaaaacgggaaaagaaacucggcgaguucgguaaggccaaagggagcagagcuauuugguacauguggcugggagccagguucuuggaguuugaagcacugggcuucaugaaugaggaucacugguuuucucgcgaaaacucgcucucaggcgucgagggggagggacuucauaagcuggguuauaucuuacgagacauuagcaaaaucccgggcgggaauauguacgcugaugacacggccggaugggauacccggauaacugaagacgaucugcagaacgaggcuaagaucacagacauuauggaaccugagcacgccuugcucgcaaaguccaucuucaaacugaccuaucagaauaaggugguaagaguucaaaggccagcgaaaaacggcacugugauggaugucauuagucgcagagaccagcgggguucuggacaggugggaacauacggccuaaauaccuuuacaaacauggaagcccagcuuaucaggcaaauggagagcgagggcauauucucccccucagaacuggagacuccuaaccucgcugggcgugugcuggauugguuggaaaagcauggagucgagcgauuaaaacgcauggccauuaguggugacgacuguguugugaagccaaucgaugacagauuugcaaccgcucugacggcccucaaugauaugggcaagguacggaaagacaucccccagugggaaccgucuaagggguggaacgauuggcaacaggugccuuucugcagccaccacuuucaucaacuuauuaugaaagacggaagggagauagucgugcccugucgcaaucaggaugagcugguuggcagagcacgggugucccagggugccggguggucacuaagggaaaccgcgugccugggaaagagcuaugcucagauguggcaacucauguacuuccaccgacgugacuugagacuggccgcaaacgccaucuguucugcugucccaguggauuggguaccuacaucccgcacuaccuggaguauucaugcccaccaucaguggaugacaacugaggacaugcuuagcguuuggaaucggguguggaucgaagagaaccccuggauggaagauaaaacccacauuucguccuggggcgacgucccauaucugggcaagagggaggaccaguggugcgggucucucaucggauuaacggcaagagcuacaugggccaccaauauacaaguggcgaucaaccagguucgccggcugauugguaaugagaacuacuuggauuacaugacuucaaugaagagguuuaaaaaugaaagcgaccccgagggcgcucugugguga

SEQ ID NO: 13680 - RNA, 9879 nt, Artificial Sequence
  derived and/or modified CDS sequence (opt3) from DENV-1__FJ410242__SS-prME
agcgugaccaugcugcuaaugcuuaugcccacagcacuggcuuuccacuugacuacgcgaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaagcggaaccggacgauguggacuguuggugcaaugcuaccgauacuugggugacauaugggaccuguagucagacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucuacgacacgguuggaaaacaucauguggaagcagauuucgaacgagcugaaucauauccuccuggaaaacgacaugaaauuuaccguagucgugggcgauguugcagggauuuuagcucagggaaagaaaaugauccgcccucagcccauggaguacaaguauagcuggaaguccuggggcaaagccaagauaaucggggcggacgugcaaaauacuaccuucauuaucgauggaccaaacacaccugaauguucagacgaucagagagccuggaauauuugggaggucgaggacuacggcuuugguaucuucacuaccaacauauggcugaaacuuagggauaguuauacacaggugugcgaccaccguuugaugucugcugcaauuaaggauagcaaagccguucacgcugacaugggguacuggaucgaauccgagaagaaugaaacguggaagcucgcccgggcaucauucauugaggugaaaaccuguaucuggcccaagagccauacucuguggucuaacggaguacuagaauccgagaugauaaucccaaaaauuuauggcggucccaucagucagcacaauuaccgaccuggcuacuuuacacaaaccgcggggccauggcaucugggaaagcucgagcuggauuucgaccuuugcgaaggcacuacagucgugguggaugagcacugcgggaacagaggaccgagcuugaggaccacgacugucaccggcaaaauuauccacgaaugguguugccgcucuuguacacugcccccuuuacgguuuaagggugaggacgggugcugguauggaauggagauaagaccaguuaaggaaaaagaggaaaaucucgugaaguccaugguaucagccggcaguggugagguggacagcuucucgcugggccuucuguguauuuccaucaugaucgaagaggucaugaggucucgcuggagccgaaaaauguugaugaccgggacucucgcuguguuuuuccugcuaauuaugggacagcugacauggaacgaucucauccggcugugcauuaugguuggcgccaaugcaucagaccguauggggaugggaaccacauaccuugcuuugauggccacuuuuaagaugagacccauguucgcagugggccuguuauuuaggcgccucaccagucgggagguccugcuucugacgauaggucuaucccucguggccucuguugaacugccuaacagcuuggaggaacugggggauggauuagcuaugggcaucaugauucucaaacugcuuacagacuuccagucccaucaacugugggcgaccuugcucucacugacuuuuaucaagaccacauucagccuacacuaugccuggaagacuauggcaauggugcugaguauugucucucuuuuuccacucugucuguccaccacgagccagaaaacaaccugguugcccguacuguuaggcucgcucgggugcaagccgcugacuauguuccuuaucgcugagaauaaaauauggggaagaaagucauggccucugaacgaagguaucauggccgugggcauuguuucuaucuugcucaguucccugcucaagaacgaugugccacuggccgggccccuuauugcuggaggcaugcucaucgcauguuacgucauaagcgguucuagcgccgaccuguccuuggagaaggcggcugaggugucaugggaagaggaagccgagcauaguggggcaagccacaauauuuuaguagaagugcaggaugacggaacaaugaaaaucaaggaugaggagagggacgauacccugacuauccuccugaaggccacacuucuggcugucucuggcguuuauccuuuguccauucccgcaacccuauucgugugguacuuuuggcagaaaaagaaacaacgaucaggcgugcugugggacacgccaaguccucccgaagucgagcgcgccgugcucgaugacgggauauaucggaucaugcagagaggacugcuugguaggagccagguuggcguagggguguuccaggaaaacgucuuucauacuauguggcacgugacccguggagcgguuuuaauguaccaaggcaagcgccuggagccauccugggcuucugugaaaaaggaccucauuucguacggugggggauggcgguugcagggcagcuggaauacaggcgaggaaguccaggugaucgccguagagccggggaagaacccuaaaaauguccagaccgcacccggaacauucaagacuucagaaggugaggugggcgccauugcucuggauuuuaaaccagggaccuccggaagucccaucguuaacagagaaggcaagauagugggucucuaugggaauggagucgugacgacaucuggcacuuacguuagcgccaucgcacaagcuaaagccucccaggagggcccucugccagagauugaagacgagguguucaggaagcgaaaccuuaccaucauggaucugcaccccgggucaggaaagacacggcgcuauuugccugcgauugucagagaagccaucaaaaggaagcuacggacccugauacucgcaccgacucgagugguagcuucugagauggccgaggcuuuaaaagguaugccaauuagauaccagaccacagcaguaaagagcgagcauacgggcaaagagaucguugaccugaugugccacgccacuuuuaccaugcgccuucugagucccgucagggugccuaauuauaacaugaucauuauggaugaagcccauuucacagacccauccagcaucgcugcgcguggguacauaucuacccgggugggaaugggcgaggcagccgcuauuuuuaugacugccacacccccugguucagucgaagcauucccgcaauccaaugccguaauccaggaugaggaaagagacauucccgagaggaguuggaacagcggguaugaguggaucaccgauuuuccaggaaagacggugugguucguuccuucgauaaagucuggcaaugacauugcuaacugucuccgcaaaaauggcaagcgagugauccaguuguccagaaaaacuuucgauacagaauaccagaagaccaaaaacaacgacugggacuacgucgugaccacugauaucagcgagaugggggcgaauuuucgggccgacaggguuauugauccccgccguugccugaagccagugauccucaaggacggaccugaaagagucauucuggcaggucccaugccagugacaguagcuucagccgcacaacggaggggccgcauagggcgaaaccacaauaaagagggagaucaguauaucuacaugggccagccgcuuaacaaugacgaggaucaugcccacuggaccgaagcuaagaugcuacuggacaacauuaauacaccugaggguaucauccccgccuuguucgaaccagagagagagaaaagugcggcaauugauggggaguaucgguuaaggggcgaggcccgcaagacuuuuguggaacugaugagaaggggagaccuccccguuuggcugucuuacaaagucgcuuccgagggcuuccaguauagcgaucggcguuggugcuuugacggggaacgcaacaaucaagugcuugaggaaaacauggauguggagauauggacgaaggagggagaaaggaaaaagcugagaccuagauggcucgacgcccggaccuacucagacccauuggcucugcgcgaguucaaggaauuugcagccgguagaaggagugucagcggcgaucuaauccuggagauugggaaacucccccagcaccuuacacagcgggcucagaaugcccuggacaacuuaguuauguugcauaauuccgaacaaggaggccgagcauauagacacgcgauggaggagcugccugauacuaucgaaacccucaugcugcuugcccugauugcugugcucacaggugggguaaccuuguucuuucugucuggccgcggauuaggcaagacuagcaucgggcuacugugugugauggccuccucaguccuccuuuggauggcaucuguggagccgcauuggauagcugccaguaucauucuggaguucuuuuugaugguucugcucaucccagagcccgacaggcagcggacgccucaggauaaccagcuggcauacguggucauuggacuucucuucaugauccugaccguagccgcuaaugagauggguuugcuggaaacaacuaaaaaggacuuaggcauagggcacguggcggccgagaaccaccaucacgcagcuaugcuagauguugaccugcaucccgccucggccuggacccucuacgcaguggcuacaaccauuaucacuccaaugaugcgucacacaauugaaaacacgaccgccaauaucagccuuacugcgauagcuaaccaagccgcaauccugaugggauuggauaaaggcuggccuauuuccaagauggacaucggugucccccugcucgcccuggggugcuauucucaggugaauccacuuacauuaaccgcugcaguccugaugcucguggcccauuacgcgauuaucggcccuggauugcaggcuaaggccaccagagaggcacagaaaaggacagccgcuggcauaaugaagaacccgacuguugaugggauuguggccaucgaccuggaucccguaguguaugacgcaaaauuugaaaagcagcuaggacagaucaugcugcucauucuuuguacgucacagauccuguugaugcgcaccacaugggcucugugcgagagcauaacucucgccaccggcccacugacaaccuuaugggaggguuccccugggaaauucuggaauacuacgauugcggucaguauggccaacaucuuccggggaucuuaccuugcaggcgcuggucuggccuuuagccucaugaagucacuaggcgggggacgaagaggcacaggggcacaaggagaaacccugggcgagaaguggaaaaggcaguugaaucagcuguccaagagugaguucaacacuuauaaacgcagcgguauuauggagguugaccggucugaagcuaaggaggggcucaaaagaggagagaccacaaagcacgccgugucccguggcacugccaaacuuaggugguuugucgaacggaaucuggugaaacccgaggguaagguaaucgauuugggcugugggcgcggaggcuggucauacuauugcgcggggcugaaaaaggugaccgaaguuaaaggauacacaaagggcgguccagggcacgaggaaccuauacccauggcuacguacggauggaaccucgugaaauuacauagcggcaaggacgucuucuuuaucccgccagagaagugugauacccugcuuugcgacauuggcgagucgucuccuaaucccacuaucgaagaggggcgaacacugagagugcuaaaaauggucgaaccauggcucaggggaaaccaguucuguauuaagauccugaaucccuauaugccuagugugguugagaccuuggagcaaaugcagcggaaacacgguggcaugcugguacgcaacccgcucuccagaaauagcacucaugaaauguacugggugucaugcgggacaggaaacauugucuccgcagugaauaugaccucuaggaugcuucugaaccgauuuacgauggcccaccggaagcccaccuaugagcgugauguugacuuaggcgcugguacaagacacguggccgucgaaccagagguggcaaaccuggauaucauagggcagcgcauugaaaauaucaaacaugagcacaagagcacuuggcauuacgacgaggauaacccuuauaagaccugggccuaccacggaaguuaugaaguaaaacccuccggcagcgcuucuucaauggugaauggcguugucaaguugcucacaaaaccuugggacgugaucccaauggugacucagauugcgaugaccgauacaacccccuucgggcaacagagggucuuuaaggagaaaguugacacucggacgccuaaggccaagagaggaacagcacagauaauggaagugaccgcuaaauggcugugggguuuccuaagucgcaacaagaaaccaaggaucuguacucgagaggaauuuacccggaagguaagauccaaugccgcaauuggcgccguguucgucgacgagaaccaauggaauagcgcuaaagaggccguggaagaugagagguuuugggaccuuguucaucgcgaacgugagcugcacaagcaggggaagugcgcgacaugcguguacaacaugaugggaaaacgggaaaagaaacucggcgaguucgguaaggcaaaagggucuagagccaucugguacauguggcugggagcuagguucuuggaguuugaagcccugggcuucaugaaugaggaucacugguuuucgcgcgaaaacucacucagcggcgucgagggggagggacuucauaagcuggguuauauuuuacgagacaucuccaaaauacccggcgggaauauguacgcagaugacacggcuggaugggauacccggaucacugaagacgaucugcagaacgaggccaagauuacagacaucauggaaccggagcacgcuuugcucgccaagaguauuuucaaacugaccuaucagaauaaggugguaagaguucaaaggccugccaaaaacggcacugugauggaugucaucucucgcagagaccagcgggguagcggacaggugggaacauacggccuaaauaccuuuacaaacauggaagcgcagcuuauaaggcaaauggaguccgagggcauuuucucaccaagugaacuggagacucccaaccucgccgggcgugugcuggauugguuggaaaagcauggagucgagcgauuaaaacgcauggcuaucucuggugacgacuguguugugaagccuaucgaugacagauuugccaccgcacugacggcucucaaugauaugggcaagguacggaaagacauuccacagugggaacccagcaagggguggaacgauuggcaacaggugccguucugcucccaccacuuucaucaacuuauaaugaaagacggaagggagaucgucgugccuugucgcaaucaggaugagcugguuggcagagcccgggugucacagggugcaggguggagccuaagggaaaccgccugccugggaaagucuuaugcgcagauguggcaacucauguacuuccaccgacgugacuugagacuggcugccaacgcaauuuguuccgccguccccguggauuggguaccaacaagucgcacuaccuggagcauccaugcucaccaucaguggaugacaacugaggacaugcuuucgguuuggaaucggguguggauugaagagaacccuuggauggaagauaaaacccacaucuccucuuggggcgacguccccuaucugggcaagagggaggaccaguggugcgggucacucauaggauuaacggccagagcaacaugggcuaccaauauccaaguggccauuaaccagguucgccggcugaucgguaaugagaacuacuuggauuacaugacuagcaugaagagguuuaaaaaugaaagugacccagagggcgcgcugugguga

SEQ ID NO: 13681 - RNA, 9879 nt, Artificial Sequence
  derived and/or modified CDS sequence (opt3) from DENV-1__FJ410243__SS-prME
agcgugaccaugcugcucaugcuuaugcccaccgcacuggcuuuccacuugacuacgagaggaggggaaccucauaugaucgucuccaagcaggaaagggggaaaucuuuacuguuuaagaccucagccgguguuaacaugugcacacugauugccauggaccucggagaguucugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaagcauggcuagugcauaagcagugguuccuggaucucccgcugcccuggaccuccggcgcuucaacuagccaagagacauggaaucggaaagaccuucugguaaccuuuaagacagcccacgcuaagaaacaggaaguuguggucuuggguagucaggagggggccaugcacacugcacucaccggcgccacggaaauccaaaccucuggaacaacuaccaucuucgcuggccaucugaagugccguuuaaaaauggauaagcugacacuacgcgggauguccuaugugauguguacuggcagcuucaaacucgagaaggaagucgcggagacccagcacgguacggugcugguucagauuaaguacgagggcacagacgcaccuugcaaaauaccauuuucgacccaggaugaaaagggggugacucaaaacggaagacuuaucacagccaaucccauuguaaccgacaaagagaagccugucaacaucgaagcugagccacccuucggcgagucuuauauagugauuggugccggggaaaaagcauugaagcuguccugguuuaagaaaggcucaaguaucggaaagauguucgaggccacugcuaggggcgcccggcgaauggcaauccucggggauaccgcgugggacuuuggaagcauugguggcguuuucacauccguggggaaacugguccaucagaucuuuggaacggcuuacggcgugcuuuucucugguguaagcuggaccaugaagauugggauaggcgugcuguugacuuggcucggacuaaauucacgcaguacauccuuaagcaugaccuguaucgccguuggccuggucacacuauaccucggggugauggugcaggcagauucuggaugcgucauuaacuggaaaggcagagaacugaagugugguucagggaucuuuguuacuaaugaggugcacaccuggacggaacaguauaaguuccaagccgacaguccgaaaaggcuuagcgcugccaucggaaaggcaugggaggagggcgugugcgguauucgguccgcuacacgcuuggaaaacauaauguggaaacagaucucuaacgagcugaaucauauucuccuggaaaacgacaugaaguuuaccguagucgugggcgauguugccgggaucuuagcgcagggcaagaagaugauuagaccucagcccauggaguacaaauauucguggaaaagcuggggcaaggccaagaucauaggggcugacgugcaaaaugcaacuuucaucauugauggaccaaacaccccugaaugucccgacgaucagagggccuggaauaucugggaggucgaggacuacggcuuugguauuuucacaacuaacaucuggcugaaacuucgugauuccuauacccaggugugcgaccaccgguugaugucagcugccauaaaagauaguaaggcaguucacgcggacaugggguacuggauugaaucugagaaaaaugaaacauggaagcucgcccgagcuagcuucaucgaggugaagacguguauuuggccaaaaucccauacccuguggucaaacggaguacuagaaagcgagaugaucauacccaagaucuauggcgguccuauuucucagcacaauuacagaccaggcuacuuuacucaaacagccgggccguggcaucugggaaaacucgagcuggauuucgaccuuugcgaaggcaccacugucgugguggaugagcacugcgggaacaggggacccuccuugcgcacaaccacggucacuggcaagaucauucacgaaugguguugccggaguuguacccugccuccauuaagauuuaaaggugaggacgggugcugguauggaauggagaucaggcccguuaaggaaaaggaggaaaaucucgugaaaagcaugguaucugcaggcuccggugagguggacucauucagucugggccuucuguguauaagcauuaugaucgaagaggucaugcgcucgcgauggucccggaagauguugaugacagggacccucgcuguguuuuuccugcuaaucaugggacagcugacuuggaacgaucucauucgucugugcaucaugguuggcgccaaugcaucugacagaauggggaugggaacaaccuaccuugccuugauggcuacauuuaaaaugaggccuauguucgcggugggccuguuauuucgccggcucacuagcagagagguccugcuucugaccauuggucuaucacucguggccaguguugaacugccaaacuccuuggaggaacugggggauggauuagcaaugggcauaaugauccucaagcugcuuacggacuuccagucucaucaacugugggcuacauugcucagccugaccuuuauuaaaacuaccuucucccuacacuaugccuggaagacaauggccauggugcugucaaucgucagccuuuuuccccucugucugaguacuaccucucagaagacgacaugguugccgguacuguuaggcucccucgggugcaaaccucugaccauguuccuuauugcugagaauaagaucuggggaaggaaaagcuggccacugaacgaagguauaauggcagugggcaucguuucgauuuugcucucaucucugcuaaagaacgaugugccccuggccgggccucuuaucgcgggaggcaugcucauugcuuguuacgucaucagugguuccagcgccgaccugucuuuggagaaagcagccgaggugagcugggaagaggaagcugagcauuccggggcaucacacaauauauuaguagaagugcaggaugacggacccaugaagauuaaagaugaggagcgagacgauaugcugacuauccuccugaaggccacacuucuggcggucaguggcguuuauccauugagcaucccugcuacccuauucgugugguacuuuuggcagaagaaaaagcaacgcucuggcgugcugugggacacucccuccccaccggaagucgagcgggccgugcucgaugacgggauuuauagaauaaugcagaggggacugcuuggucguucacagguuggcguagggguguuccaggaaaacgucuuucauacaauguggcacgugacccgcggagcaguuuuaauguaccaaggcaaacggcuggagccuaguugggccagcgugaagaaagaccucaucuccuacggugggggauggagauugcagggcucuuggaauacgggcgaggaaguccaggugauugcuguagagcccgggaagaacccaaagaauguccagacugcccccggaaccuucaaaacaucggaaggugaggugggcgcaaucgcucuggauuuuaagccugggaccagcggaucaccaauuguuaacagggaaggcaaaaucgugggucucuaugggaauggagucgugacaacuuccggcaccuacguuagugccauagcgcaagccaaggcaucucaggagggcccccugccugagaucgaagacgagguguuccgaaaacggaaccuuacgauuauggaucugcacccggggagcggaaagacacgcagauauuugccagcuaucgucagggaagccauuaagcggaaacuacgaacucugauccucgcucccaccagagugguagcauccgagauggccgaagccuuaaaggguaugccuauacgcuaccagacaaccgcugugaaaucagagcauacuggcaaggagauuguugaccugaugugccacgcgaccuuuacaaugaggcuucugucuccaguccgugugcccaauuauaacaugaucaucauggaugaagcacauuucacggacccuagcaguauugccgcucggggguacaucuccacuagagugggaaugggcgaggccgcagccauauuuaugaccgcuacaccgcccgguagcauggaagcguucccacaaucuaaugccgucauucaggaugaggaaagggacaucccugagcgcucauggaacuccggguaugaguggauuaccgauuuucccggaaaaacuguaugguucgugccaaguaucaagagcggcaaugacauagcaaacugucuccgaaagaauggcaaaagaguuauucaguugucgcggaagacauucgauaccgaauaccagaaaacgaagaacaacgacugggacuacguggucacuacagauaucucugagaugggggcuaauuuuagggccgaccgcgugaucgauccucguagaugccugaaacccguuauucucaaggacggaccagaacgggugauccuggcagguccgaugccugucaccguggccuccgcugcccaaaggcgcggccgaauugggagaaaccacaauaaggagggagaucaguauauauacaugggccagccccuuaacaaugacgaggaucaugcgcacuggaccgaagcaaaaaugcuacuggacaacaucaauacuccagaggguauuauccccgccuuguucgaaccugagcgggaaaagagcgcugccaucgauggggaguauagguuacgcggcgaggcuagaaaaacauuuguagaacugaugaggcggggagaccucccaguguggcugucauacaagguugcaagugagggcuuccaguauucugaucgucgcuggugcuuugacggggaacgaaacaaucaaguccuugaggaaaacauggauguggagauuuggaccaaagagggagaaagaaagaaacugaggccccgguggcucgacgcccgcacauacuccgacccuuuggcucugagagaguucaaggaauuugccgcagguaggcggagcgugucaggcgaucuaauacuggagaucgggaagcucccgcagcaccuuacucagcgagcgcagaaugcccuggacaacuuagucauuuugcauaauagugaacaaggaggcagagcuuaucgccacgccauggaggagcugccagauacgaucgaaacccucaugcugcuugcacugauugcuguucucacagguggggugacuuuguucuuucugagcggcaggggauuaggcaaaaccuccaucgggcuacuguguguaauggccucuagcgugcuccuuuggauggcauccgucgagccccauuggauagccgcuucaaucauucuggaguucuuuuugauggugcugcucaucccugagcccgaccggcagcguacaccacaggauaaccagcuggcguacguugugauuggacuucucuucaugauccugaccgucgccgcaaaugagauggguuugcuggaaacuacgaagaaagacuuaggcauagggcacguagcuguggagaaccaccaucacgccgccaugcuagauguugaccugcauccugcaucugcuuggacccucuacgccguggcgacaacuauuaucacccccaugaugagacacacaauugaaaacaccacugcuaauaucagucuuacagccauagcaaaccaagccgcuauccugaugggauuggauaagggcuggccaauuucgaaaauggacaucggugucccucugcucgcacuggggugcuauagccaggugaauccgcuuacguuaaccgccgcgguccugaugcucguggcucauuacgccauuaucggccccggauugcaggcaaaggccacuagggaggcucaaaagcgcacagccgcaggcauaaugaaaaacccaaccguugaugggauuguggcuaucgaccuggauccuguaguguaugacaccaaguuugaaaaacagcuaggacagaucaugcugcucauucuuuguacaucccagauccuguugaugcggacuacgugggcccugugcgagucuauaacccucgcgacaggcccccugacuaccuuaugggaggguucaccagggaaguucuggaauacaaccauugccgucagcauggcaaacaucuuccgaggauccuaccuugcuggcgccggucuggcauuuagucucaugaaaucucuaggcgggggaagaaggggcacuggggcucaaggagaaacgcugggcgagaaguggaagcgccaguugaaucagcugagcaaaucagaguucaacacauauaagcgguccgguauuauggagguugacagaagugaagccaaagaggggcucaagcguggagagaccacuaaacacgccgugagcaggggcaccgcgaaacuucggugguuugucgaacgcaaucuggugaagccugaggguaaaguaaucgauuugggcugugggcgaggaggcuggucuuacuauugcgcugggcugaagaaagugacagaaguuaagggauacacuaaaggcggucccgggcacgaggaaccgauaccaauggcaaccuacggauggaaccucgugaaguuacauuccggcaaagacgucuucuuuaucccucccgagaagugugauacacugcuuugcgacauuggcgagucaagcccaaaucccacgaucgaagaggggagaacccugagggugcuaaagauggucgaaccuuggcuccggggaaaccaguucuguauuaaaauccugaauccguauaugcccucggugguugagacuuuggagcaaaugcagcgcaagcacgguggcaugcugguaagaaacccacucucuaggaauaguacacaugaaauguacuggguguccugcgggaccggaaacauugucagcgccgugaauaugacuucacgaaugcuucugaaccgguuuacaauggcucaccguaaaccuaccuaugagagagauguugacuuaggcgccgguacgcgccacguggcagucgaacccgagguggccaaccuggauaucauagggcagaggauugaaaauaucaagcaugagcacaaauccaccuggcauuacgacgaggauaacccuuauaagacaugggcuuaccacggaucuuaugaaguaaagccaagcggcagugcguccagcauggugaauggcguugucaaauugcucacuaagcccugggacgugaucccuauggugacccagauugccaugacagauacuaccccauucgggcaacagcgggucuuuaaagagaagguugacacaagaacccccaaagcaaagcgcggaacugcucagauaauggaagugacggccaaguggcugugggguuuccuaucuaggaacaaaaagccgcgaaucuguacacgggaggaauuuaccagaaaaguaaggucaaaugcagccauuggcgcuguguucgucgacgagaaccaauggaauagugccaaggaggcgguggaagaugagcgcuuuugggaccuuguucaucgugaacgggagcugcacaaacaggggaagugcgcaacuugcguguacaacaugaugggaaagagagagaagaagcucggcgaguucgguaaagccaagggguccagggcuaucugguacauguggcugggagcccgcuucuuggaguuugaagcacugggcuucaugaaugaggaucacugguuuagccgagaaaacucucucucgggcgucgagggggagggacuucauaaacuggguuauauuuuacgggacaucucaaagauaccuggcgggaauauguacgcugaugacaccgccggaugggauacaagaaucacggaagacgaucugcagaacgaggcuaaaauuaccgacaucauggaaccagagcacgccuugcucgcaaagagcauuuucaagcugacuuaucagaauaaagugguaaggguucaacgccccgcgaagaacggcacagugauggaugucaucuccagacgggaccagagggguaguggacaggugggaaccuacggccuaaauacuuuuacaaacauggaagcccagcuuauacgucaaauggagucugagggcauuuucagcccuuccgaacuggagaccccaaaccucgcugggcgagugcuggauugguuggaaaaacauggagucgagcgcuuaaagagaauggccaucucaggugacgacuguguugugaaacccaucgaugaccgguuugcaacagcucugacugcccucaaugauaugggcaagguaaggaaggacauuccgcagugggaaccuaguaaaggguggaacgauuggcaacaggugcccuucugcucucaccacuuucaucaacuuauaaugaaggacggacgcgagaucgucgugccauguagaaaucaggaugagcugguuggccgggcaagggugagccagggugccggguggucccuacgagaaaccgcgugccugggaaaaucauaugcucagauguggcaacucauguacuuccaccguagagacuugcgccuggccgcaaacgccauuuguagcgcugucccuguggauuggguacccacgucucggaccacaugguccauccaugcccaccaucaguggaugacuaccgaggacaugcuuaguguuuggaauaggguguggauugaagagaacccauggauggaagauaagacacacaucagcucguggggcgacguccccuaucugggcaaaagagaggaccaguggugcgggucccucauaggauuaacugcacgcgcuaccugggccacgaauauccaaguggcgauuaaccagguucggaggcugaucgguaaugagaacuacuuggauuacaugacaucuaugaagcgauuuaagaaugaaauugacccugagggcgcucugugguga

SEQ ID NO: 13682 - RNA, 9879 nt, Artificial Sequence
  derived and/or modified CDS sequence (opt3) from DENV-1__FJ410244__SS-prME
agcgugaccaugcugcucaugcuuaugcccaccgcacuggcuuuccacuugacuacgagaggcggggaaccucauaugaucgucuccaagcaggaaagggggaaaucuuuacuguuuaagaccucagccgguguuaauaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaaugaacaagcugacacuaaaagggaugagcuaugugauguguacuggaucguucaagcucgagaaggaagucgcugagacccagcacgguacggugcugguucagauuaaauacgagggcacagaugcgccuugcaagauaccauuuucuacccaggacgaaaaaggggugacucaaaauggacgccuuaucacagcaaaccccauuguaaccgauaaggagaaaccugucaauaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggacaccgcaugggauuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaacagucgauccacuagcuuaucuaugaccuguaucgcuguuggccuggucacacuauaccucggggugauggugcaggccgacucaggaugcgucauuaauuggaagggccgcgaacugaagugugguagugggaucuuuguuacuaacgaggugcacaccuggacggaacaguauaaauuccaagcagauagcccgaagagacuuuccgccgcuaucggaaaagccugggaggagggcgugugcgguauuaggucugcaacacgguuggaaaacauaauguggaagcagaucucgaaugagcugaaccauauucuccuggaaaaugacaugaaauuuaccguagucgugggcgacguugcugggaucuuagcccagggaaagaaaaugauucgcccucagcccauggaguacaaguauagcuggaaguccuggggcaaagcgaagaucauaggggccgaugugcaaaacacuaccuucaucauugacggaccaaauacaccugaaugucccgaugaccagagagcuuggaacaucugggaggucgaggauuacggcuuugguauuuucacuaccaauaucuggcugaaccuuagggacucauauacacaggugugcgaucaccguuugaugagugcagccauaaaagacucuaaggcuguucacgccgauaugggguacuggauugaaagcgagaaaaaugaaacguggaagcucgcacgggcguccuucaucgaggugaagaccuguauuuggccaaaaucacauacucuguggagcaacggaguacuagaaucugagaugaucauacccaagaucuauggcgguccuauuucccagcacaauuaccgaccaggcuacuuuacacaaaccgccgggccguggcaucugggaaaacucgagcuggacuucgaucuuugcgaaggcacuacagucgugguggacgagcacugcgggaacagaggacccaguuugaggaccacgacugucaccggcaagaucauucacgaaugguguugccgcagcuguacacugccuccauuacgguuuaaaggugaggaugggugcugguauggaauggagaucagacccguuaaggaaaaggaggaaaaucucgugaaaucuaugguauccgcuggcucaggugagguggacaguuucagccugggccuucuguguauaucgauuaugaucgaagaggucaugaggucccgcuggucucgaaagauguugaugaccgggacucucgccguguuuuuccugcuaaucaugggacagcugacauggaacgaccucauucggcugugcaucaugguuggcgcaaaugcuagcgaucguauggggaugggaaccacauaccuugccuugauggcaacuuuuaaaaugagaccuauguucgccgugggccuguuauuuaggcgccucaccucacgggagguccugcuucugacgauuggucuaagucucguggcuuccguugaacugccaaacucuuuggaggaacugggggacggauuagcgaugggcauaaugauccucaagcugcuuacagauuuccagagccaucaacugugggccaccuugcucucccugacuuuuauuaaaaccacauucucacuacacuaugcauggaagacuauggcuauggugcugagcaucgucagucuuuuuccccucugucugucuaccacgucccagaagacaaccugguugccgguacuguuaggcagccucgggugcaaaccucugacuauguuccuuauugccgagaacaagaucuggggaagaaaaucguggccacugaaugaagguauaauggccgugggcaucguuucaauuuugcucucuagucugcuaaagaacgacgugccccuggcugggccucuuaucgcaggaggcaugcucauugccuguuacgucaucuccgguagcucugcggaucugagcuuggagaaagcugccgagguguccugggaagaggaagcagagcauucaggggccagucacaauauauuaguagaagugcaggacgauggaacaaugaagauuaaagacgaggagagggaugacacccugacuauccuccugaaggcuacacuucuggcagucagcggcguuuaucccuugucuaucccagccacccuauucgugugguacuuuuggcagaagaaaaagcaacgauccggcgugcugugggauacgccuucacccccagaagucgagcgcgcggugcucgacgaugggauuuaucggauaaugcagagaggacugcuugguaggagucagguuggcguagggguguuccaggaaaacgucuuucauacuauguggcacgugacccguggagcuguuuuaauguaccaaggcaaacgccuggagccgagcugggccuccgugaagaaagaccucaucucuuacggugggggauggcgguugcagggcucguggaauacaggcgaggaaguccaggugauugcaguagagccugggaagaaccccaagaauguccagaccgccccaggaacauucaaaacuagcgaaggugaggugggcgcuaucgcccuggacuuuaagcccgggaccucaggauccccuauuguuaacagagaaggcaaaaucgugggucucuaugggaauggagucgugacgacaaguggcacuuacguuucugcaauagcucaagccaaggcgagccaggagggcccacugcccgagaucgaagaugagguguucaggaaacgaaaccuuaccauuauggaccugcacccuggguccggaaagacacggcgcuauuugccggccaucgucagagaagcaauuaagaggaaacuacggacccugauccucgcuccaacucgagugguagccucagagauggcugaagcauuaaaggguaugcccauaagauaccagaccacagccgugaaaucugagcauacgggcaaggagauuguugaucugaugugccacgccacuuuuaccaugcgccuucugagcccugucagggugccaaauuauaacaugaucaucauggacgaagcucauuucacagaucccaguuccauugcggcacguggguacaucagcacccgggugggaaugggcgaggccgcugccauauuuaugacugcaacaccuccggguucugucgaagccuucccccaaucaaaugcuauuauccaggacgaggaaagagauauuccagagagguccuggaacaguggguaugaguggaucaccgacuuuccuggaaaaacgguaugguucgugcccagcauaaagucgggcaaugauauugcgaacugucuccgcaagaacggcaaacgaguuauccaguugucuagaaagacuuucgacacagaauaccagaaaaccaagaauaacgauugggacuacguggucaccacugacaucuccgagaugggggccaauuuucgggcagauagggugauugacccacgccguugccugaaaccuguuauccucaaggauggacccgaaagagugauucuggcugguccaaugccggucacaguggccagcgcagcccaacggaggggccgcauagggcgaaaccacaauaaggagggagaccaguauaucuacaugggccagccucuuaacaaugaugaggaccaugcucacuggaccgaagccaaaaugcuacuggauaacauuaauacacccgaggguaucaucccagcguuguucgaacccgagagagaaaagucagcagccauugacggggaguaucgguuaaggggcgaggcucgcaaaacuuuuguagaacugaugagaaggggagaucucccuguguggcugaguuacaagguugccucugagggcuuccaguauuccgaccggcguuggugcuuugauggggaacgcaacaaucaaguccuugaggaaaacauggacguggagauauggacgaaagagggagaacgaaagaaacugagaccaagguggcucgaugcucggaccuacagcgaccccuuggcacugcgcgaguucaaggaauuugccgcugguagaaggucagugaguggcgaccuaauccuggagauugggaagcucccucagcaccuuacacagcgggcccagaaugcacuggauaacuuagucauguugcauaauagcgaacaaggaggccgagcguauagacacgccauggaggagcugccggacacuaucgaaacccucaugcugcuugcucugauugccguucucacagguggggugaccuuguucuuucuguccggccgcggauuaggcaaaacuucuaucgggcuacuguguguaauggcaagcuccgugcuccuuuggauggcuucagucgagccacauuggauagccgcaucuaucauucuggaguucuuuuugauggugcugcucauccccgagccugauaggcagcggacgccccaggacaaccagcuggccuacguugugauuggacuucucuucaugauccugaccgucgcugcgaacgagauggguuugcuggaaacaacuaagaaagauuuaggcauagggcacguagccguggagaaucaccaucacgcagcuaugcuagacguugaucugcauccagccagugccuggacccucuacgcaguggcuacaaccauuaucacuccuaugaugcgucacacaauugaaaacacgaccgccaauaucucgcuuacugcgauagcuaaccaagccgcaauccugaugggauuggacaagggcuggcccauuagcaaaauggauaucggugucccacugcucgcccuggggugcuauucccaggugaauccucuuacauuaaccgcugcaguccugaugcucguggcccauuacgcgauuaucggcccgggauugcaggcuaaggccaccagagaggcacaaaagaggacagccgcuggcauaaugaaaaaccccacuguugacgggauuguggccaucgaucuggacccaguaguguaugaugcaaaguuugaaaaacagcuaggacagaucaugcugcucauucuuuguacgucucagauccuguugaugcgcaccacaugggcucugugcgagucaauaacucucgccaccggcccucugacaaccuuaugggaggguagccccgggaaguucuggaauacuacgauugcggucuccauggccaacaucuuccggggaaguuaccuugcaggcgcuggucuggccuuuucucucaugaaaagccuaggcgggggacgaagaggcacaggggcacaaggagaaacccugggcgagaaguggaagaggcaguugaaucagcugucaaaauccgaguucaacacuuauaagcgcagugguauuauggagguugaccggagcgaagcuaaagaggggcucaagagaggagagaccacaaaacacgccgugucucguggcacugccaaacuuaggugguuugucgaacggaaucuggugaagccagaggguaaaguaaucgacuugggcugugggcgcggaggcugguccuacuauugcgcggggcugaagaaagugaccgaaguuaagggauacacaaaaggcgguccugggcacgaggaacccauaccgauggcuacguacggauggaaccucgugaaguuacauucaggcaaagaugucuucuuuaucccaccugagaagugugacacccugcuuugcgauauuggcgagagcucgcccaauccaacuaucgaagaggggcgaacacugagagugcuaaagauggucgaacccuggcucaggggaaaccaguucuguauuaaaauccugaauccuuauaugccgucugugguugagaccuuggagcaaaugcagcggaagcacgguggcaugcugguacgcaacccccucaguagaaauuccacucaugaaauguacugggugagcugcgggacaggaaacauugucucagcagugaacaugaccuccaggaugcuucugaaucgauuuacgauggcccaccggaaaccaaccuaugagcgugacguugauuuaggcgcugguacaagacacguggccgucgaaccugaggugcccaaccuggacaucauagggcagcgcauugaaaauaucaagcaugagcacaaaucuacuuggcauuacgaugaggacaacccuuauaagaccugggcauaccacggaagcuaugaaguaaagccaaguggcuccgccagcucuauggugaauggcguugucaaauugcucacaaagcccugggaugugaucccuauggugacucagauugcuaugaccgacacaaccccauucgggcaacagagggucuuuaaagagaagguugauacucggacgcccaaagcgaagagaggaacagcccagauaauggaagugaccgcaaaguggcugugggguuuccuaucacgcaacaaaaagccgaggaucuguacucgagaggaauuuacccggaaaguaagaaguaaugcugccauuggcgcaguguucgucgacgagaaccaauggaacuccgccaaggaggcuguggaagacgagagguuuugggaucuuguucaucgcgaacgugagcugcacaaacaggggaagugcgccacaugcguguacaacaugaugggaaagcgggagaagaagcucggcgaguucgguaaagcgaaggggagcagagcaaucugguacauguggcugggagccagguucuuggaguuugaagcucugggcuucaugaaugaggaccacugguuuucucgcgaaaacucgcucucaggcgucgagggggagggacuucauaaacuggguuauauuuuacgagauaucagcaagauaccuggcgggaauauguacgccgacgauacggcaggaugggacacccggaucacugaagaugaccugcagaacgaggcuaaaauuacagauaucauggaaccagagcacgccuugcucgcuaaguccauuuucaagcugaccuaucagaauaaagugguaagaguucaaaggcccgccaagaacggcacugugauggacgucaucagucgcagagaucagcgggguucuggacaggugggaacauacggccuaaacaccuuuacaaauauggaagcacagcuuauaaggcaaauggagagcgagggcauuuucuccccuucagaacuggagacuccaaaccucgcggggcgugugcuggacugguuggaaaaacauggagucgagcgauuaaagcgcauggccaucaguggugaugacuguguugugaaacccaucgacgauagauuugcuaccgcccugacggcacucaaugacaugggcaagguacggaaggaugugccgcagugggaaccuucuaaaggguggaacgacuggcagcagguccccuucugcagccaccacuuucaucaacuuauuaugaaggauggaagggagauagugguuccaugucgcaaucaggacgagcuggugggcagagcucgggucucccagggugccggguggucacuaagggaaaccgcaugccugggaaaaagcuaugcccagauguggcaacucauguacuuccaccgacgugauuugagacuggcggcuaacgccaucuguucugcagugccuguagacuggguucccacaucccgcacuaccuggaguauucaugcccaccaucaguggaugacaacugaggauaugcuuagcguguggaaucgggucuggaucgaagagaacccauggauggaagacaagacccacauuucguccuggggcgaugugcccuaucugggcaaaagggaggaccaguggugcgggucucucaucggauuaacggcuagagccacaugggcaaccaauauacaaguugcuaucaaccaggugcgccggcugauugguaaugagaacuacuuggacuacaugacuucaaugaagagguuuaagaaugaaagcgauccugagggcgcccugugguga

SEQ ID NO: 13683 - RNA, 9879 nt, Artificial Sequence
  derived and/or modified CDS sequence (opt3) from DENV-1__FJ410245__SS-prME
agcgugacaaugcugcucaugcuuaugcccacggcccuggcuuuccacuugacuacgagaggaggggaaccucauaugauagucuccaagcaggaaaggggaaaaucuuuacuguuuaagaccucagccgguguuaacaugugcacacuaauugccauggaccucggcgaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucaaaggugaggacgggugcugguauggaauggagauaagacccguuaaggaaaaggaggaaaaucuggugaaaagcaugguaucugcuggcuccggugagguggacucauuuagucuuggccuguuguguauuagcaucaugaucgaagaggucaugaggucgcgcuggucccgacggaugcucaugaccgggacucuggccguguucuuucuacugauuaugggacagcucacauggaacgaucugauccgucuuugcauuaugguuggcgcaaaugcuucugacagaauggggaugggaaccacauacuuggcccugauggcaacuuucaagaugaggccuauguuugccgugggcuuacucuuccgccggcugaccagcagagagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaagaccacauuuucccugcacuaugcauggaaaacuauggcuauggugcuuucaauugucagccucuucccccuguguuugaguaccacgucucagaagacaaccuggcugccgguauuacucggcucccuggggugcaagccucuuacuauguuucugaucgccgagaauaaaauauggggaaggcgaagcuggccauugaacgaagguaucauggccgugggcauuguuucgauccuccugucaucucuacugaagaacgaugugccccuugcugggccucucauugcaggaggcaugcugaucgccuguuacgucauaagugguuccagcgcggacuugucuuuagagaaagcugccgaggugagcugggaagaggaagcagagcauuccggggccucacacaauauucugguagaagugcaggaugacggaacaaugaagaucaaagaugaggagcgcgacgauacccucacuauccugcuuaaggcuacacuguuggcagucaguggcguuuauccccuaagcauuccagccacccuguucgugugguacuucuggcagaaaaagaagcagcggucuggcgugcucugggacacgccuucacccccagaagucgagagagcggugcuggaugacgggauauauaggaucaugcagcguggacuuuuaggucgcagccagguuggcguagggguguuucaagaaaacgucuuccauacuauguggcacgugacccggggagcuguucugauguaccagggcaaaagacucgagccgaguugggccagcgugaagaaagacuugauuuccuacggugggggauggaggcugcagggcucuuggaauaucggcgaggaaguccaggugauugcaguagagccugggaagaaccccaaaaauguccaaacagccccaggaaccuuuaagacacccgaaggugaggugggcgcuaucgcccucgauuucaagccugggacuucgggaagcccaauaguuaaccgagaaggcaaaaucgugggucuguaugggaauggagucgugaccacgucaggcacauacguuuccgcaauugcucaggccaaggcgagucaggagggcccccuuccugagaucgaagacgagguguuucggaaacgcaaccugacuauuauggauuugcacccggggucuggaaagaccagaagguaucuaccagccaucguccgggaagcaaucaaaaagaagcugcgaacacucauuuuagcucccaccagagugguagccagcgagauggcugaagcacugaaagguaugccuauccgcuaccaaacuaccgccgugaaguccgagcauacaggcaaagagaucguugaccuuaugugccacgccacguucacuaugaggcugcucucaccaguccgugugcccaauuauaacaugauuaucauggaugaagcucauuuuaccgacccuucuagcauagcggcacggggguacauuaguacaagagugggaaugggcgaggccgcugccaucuucaugaccgcaacuccgcccgguuccgucgaagccuuuccacagagcaaugcuguaauucaggaugaggaaagggacaucccugagcgcucuuggaacucaggguaugaguggauaacagauuuccccggaaagaccgugugguuuguuccauccauuaaaaguggcaaugacaucgcgaacuguuugcgaaagaauggcaagagagugauccagcugagccggaaaacguucgauacugaauaccaaaagaccaaaaauaacgacugggacuacgucgugaccaccgauauuucggagaugggggccaauuucagggcagaccgcguuaucgauccucguagaugccucaagcccgugauucugaaagacggaccagaacgggucauacuugcugguccgaugccugugacuguagccucugcagcccagaggcgcggccgaaucgggagaaaccacaauaaggagggagaucaguauauuuacaugggccagccccuaaacaaugacgaggaucaugcucacuggacagaagccaagaugcuguuggacaacaucaauaccccagaggguaucauucccgcguuauuugaaccugagcgggaaaaauccgcagccauagauggggaguauaggcugcgcggcgaggcuagaaagacauucguggaacucaugaggcggggagaccugccaguuuggcuuagcuacaaagucgccucagagggcuuucaauauagugaucgucgcuggugcuucgacggggaacgaaacaaucaggugcuggaggaaaacauggauguggagaucuggacuaaggagggagaaaggaaaaagcucaggccccggugguuggacgcucgcacguacucugacccucuggcacuaagagaguuuaaagaguucgccgcugguaggcgguccgucagcggcgaucugauucucgagaucgggaaacuuccgcagcaccugacccagcgagcccaaaaugcauuagacaacuugguuaugcugcauaauucagaacagggaggcagagcguaucgccacgccauggaggagcucccagauacaauugaaacucugaugcuucuggcucucaucgccguguugaccggugggguaacacuguuuuucuuaaguggcaggggacuaggcaagaccagcauagggcugcucugugugauggcauccucuguccuucuguggauggcuagcguggagccccauuggaucgccgcauccauuaucuuggaauuuuuccugaugguucuccugauuccugagcccgaccggcagcguacuccacaggauaaccaacuugccuacguggucaucggacuccuguuuaugauauugacgguagcugcgaaugagaugggucuguuagaaaccaccaaaaaggaccuaggcauugggcacguggccguugagaaccaccaucacgcagcuaugcuggauguggaccuccauccugccucagccuggacucuuuacgcagucgcuaccacaaucauuacccccaugaugagacacacuaucgaaaacacaacggccaauauaucucugaccgcgaucgcuaaccaggccgcaauuuugaugggacuggauaaaggcuggccaaucaguaagauggacauuggugugccucuccuggcccuugggugcuauucgcaggucaauccguuaacucugacagcugcagugcucauguugguugcccauuacgcgaucauaggccccggacugcaagcuaaagccaccagggaggcacagaagcgcaccgccgcuggcauuaugaagaacccaacaguggaugggaucguagccaucgaccuagauccuguggucuaugacgcaaaauucgaaaagcagcugggacagauuaugcuccuuauccuguguacuagccaaauauugcugaugcggacgaccugggcucucugcgaguccauuacacuggccacuggccccuuaaccacacuuugggaggguucuccagggaaauuuuggaauaccacuaucgcgguuucaauggccaacauuuuccgaggaagcuaccuggcaggcgcuggucucgccuucucccuaaugaagagucugggcgggggaagaaggggcacgggggcacagggagaaacauugggcgagaaauggaagcgccagcugaaucagcucucuaagagcgaauuuaacaccuauaaacggucagguaucauggagguggacagauccgaagcuaaggaggggcuuaaacguggagagacuaccaagcacgccgucaguaggggcacagccaaacugcggugguucguggaacgcaauuugguaaagccugaggguaaggugauagaucugggcugugggcgaggaggcuggagcuacuauugcgcggggcucaaaaagguuacugaagugaaaggauacaccaagggcggucccgggcacgaggaaccgaucccaauggcuacauacggauggaacuuagucaaacugcauucuggcaaggacguguuuuucauuccucccgagaaaugugauacgcuucugugcgacaucggcgaguccucaccaaaucccaccauugaagaggggagaacucuaaggguccucaagaugguggaaccuuggcugcggggaaaccaauuuuguaucaagauuuugaauccguauaugcccagcguuguagagacacuggagcagaugcagcgcaaacacgguggcaugcucgugagaaacccacuuucgagaaauucuacccaugaaauguacugggucaguugcgggacuggaaacaucguguccgcaguuaauaugacaagccgaaugcuguuaaaccgguucaccauggcccaccguaagccuacguaugagagagauguggaccugggcgcugguacccgccacgucgccguggaacccgagguagcaaacuuggauauaauugggcagaggaucgaaaauaucaaacaugagcacaagucaacauggcauuacgacgaggauaacccuuauaaaacuugggccuaccacggauccuaugaagugaagccaucuggcagcgcuaguuccaugguuaauggcgucgugaagcuccugaccaaacccugggacgugauuccuauggucacacaaauagcgaugacugauaccacaccauuugggcagcagcggguuuucaaggagaaaguggacaccagaacucccaaggccaaacgcggaacggcacaaaucauggaaguaacagcuaaguggcuaugggguuuucuuagcaggaacaagaaaccgcgaauuuguacccgggaggaguucacuagaaaggugaggucuaaugccgcaaucggcgccgucuuuguggacgagaaccaguggaacucagcuaaagaggccguugaagaugagcgcuucugggaccuggugcaucgugaacgggagcuccacaagcaggggaaaugcgcgaccugcgucuacaacaugaugggaaagagagaaaagaaacugggcgaguuugguaaggcaaaagggaguagggccauuugguacaugugguugggagcucgcuuccuggaguucgaagcccucggcuuuaugaaugaggaucacugguucucccgagaaaacagccuuucuggcguggagggggagggacugcauaaguuagguuauauccugcgggacauaucgaaaaucccuggcgggaauauguacgcagaugacacagcuggaugggauacgagaauuaccgaagacgauuugcagaacgaggccaggaucacugacauuauggaaccagagcacgcucuccuggccaagucaaucuuuaaacuaacauaucaaaauaagguaguucgcgugcagagacccgcaaagaacggcaccgucauggaugugauaagccggagggaccagcgugguuccggacaggugggaacuuacggccuuaauacauucaccaacauggaagcgcaacugauucgacagauggagagugagggcaucuuuucuccuagcgaacucgagacaccaaaccuggccgaacgcgucuuggauugguuagagaaauaugggguugaaagacugaagcggauggcuaucuccggagacgacugugugguaaaacccauugaugacagguucgccacugcacucaccgcucuuaaugauauggguaaggugcgcaaagacauaccgcagugggagccuucaaagggcuggaacgauuggcagcaaguccccuuuugcagucaucacuuccaccagcugaucaugaaggacgggagagagauugugguuccaugucggaaucaggaugagcuagugggaagggcccgagucucucagggcgcagguuggagccugcgugagacggccugccucgggaaauccuacgcgcaaauguggcaguugauguauuuucauagacgcgaccugcggcuugcugccaacgcaaucuguucagccgugccuguagauuggauucccaccagcaggacaacuuggucuauccacgcucaucaccaguggaugaccacagaagacaugcuguccguuuggaauagaguguggauagaggaaaacccauggauggaggauaagacucauaucaguagcuggggagacguccccuaccucggcaaacgcgaggaccaauggugcggcucguuaauugggcugaccgcccgggcaacgugggcuacaaauauccagguggccauuaaccagguuaggcgauugaucggaaaugaaaacuaccuggauuauaugaccuccaugaagagauucaaaaaugagucugacccugaaggugcgcucugguga

SEQ ID NO: 13684 - RNA, 9879 nt, Artificial Sequence
  derived and/or modified CDS sequence (opt3) from DENV-1__FJ410246__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagauaagccugucaacauagaggccgaaccacccuucggcgaguccuauauugugaucggugcuggggagaaagccuugaagcugucaugguuuaagaaaggcaguagcaucggaaagauguucgaagcaaccgccagaggcgcuaggcggauggccauucucggggacacugcaugggauuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgacucaggaugcgucaucaacuggaaaggccgcgagcugaagugugguagugggaucuuuguuacaaaugaagugcacacuuggaccgagcaauauaaguuccaggcagacagcccgaaaagacuuuccgccgcuauuggaaaggccugggaagagggcgugugcgguauaaggucugcaacgcgguuggagaacaucauguggaaacagauuucgaacgaacugaaucauauccuccuggagaacgauaugaaguuuacaguagucgugggcgacguugcugggauuuuagcccagggaaaaaagaugauccgcccucaacccauggaauacaaauauagcuggaaguccuggggcaaggcgaaaauaaucggggccgaugugcagaauaccacuuucauuaucgacggaccaaacaccccugagugucccgaugaccagagagcuuggaauauuugggaagucgaggauuacggcuuugguaucuucacaacuaacauauggcugaagcuuagggacucauauacccaggugugcgaucaccguuugaugagugcagccauuaaagacucuaaggcuguucacgccgauaugggguacuggaucgagagcgaaaaaaaugagacauggaagcucgcacgggcguccuucauugaagugaagacguguaucuggccaaaaucacauacccuguggagcaacggaguacuagagucugaaaugauaauccccaagauuuauggcgguccuaucucccaacacaauuaccgaccaggcuacuuuacucagacagccgggccguggcaucugggaaaacucgagcuggacuucgaucuuugcgagggcaccacugucgugguggacgaacacugcgggaacagaggacccaguuugaggacaaccacggucacuggcaagauuauccacgagugguguugccgcagcuguacccugccuccauuacgguuuaaaggugaagacgggugcugguauggaauggagauaagacccguuaaggagaaggaagagaaucucgugaaaucuaugguauccgcuggcucaggugaaguggauaguuucagccugggccuucuguguauuucgaucaugacagaggaagucaugaggucccgcuggucucgaaagauguugaugaccgggacucucgccguguuuuuccugcuaaucaugggacagcugacauggaacgaccucauucggcugugcaucaugguuggcgcaaaugcuagcgaucguauggggaugggaaccacauaccuugccuugauggcaacuuuuaaaaugagaccuauguucgccgugggccuguuauuuaggcgccucaccucacgggagguccugcuucugacgauuggucuaagucucguggcuuccguugagcugccaaacucuuuggaagagcugggggacggauuagcgaugggcauaaugauccucaagcugcuuacagauuuccaaagccaucagcugugggccaccuugcucucccugacuuuuauuaaaaccacauucucacuacacuaugcauggaagacuauggcuauggugcugagcaucgucagucuuuuuccccucugucugucuaccacgucccagaagacaaccugguugccgguacuguuaggcagccucgggugcaaaccucugacuauguuccuuauugccgaaaauaagaucuggggaagaaaaucguggccacugaacgaggguauaauggccgugggcaucguuucaauuuugcucucuagucugcuaaagaacgacgugccccuggcugggccucuuaucgcaggaggcaugcucauugccuguuacgucaucuccgguagcucugcggaucugagcuuggaaaaagcugccgagguguccugggaggaagaggcagaacauucaggggccagucacaauauauuaguagaggugcaggacgauggaacaaugaagauuaaagacgaagagagggaugacacccugacuauccuccugaaggcuacacuucuggcagucagcggcguuuaucccuugucuaucccagccacccuauucgugugguacuuuuggcaaaagaaaaagcagcgauccggcgugcugugggauacgccuucacccccagaggucgaacgcgcggugcucgacgacgggauuuaucggauaaugcagagaggacugcuugguaggagucagguuggcguagggguguuccaagagaacgucuuucauacuauguggcacgugacccguggagcuguuuuaauguaccagggcaaacgccuggaaccgagcugggccuccgugaagaaagaucucaucucuuacggugggggauggcgguugcagggcucguggaauacaggcgaggagguccaggugauugcaguagaaccugggaagaaccccaagaauguccaaaccgccccaggaacauucaaaacuagcgagggugaagugggcgcuaucgcccuggacuuuaagcccgggaccucaggauccccuauuguuaacagagagggcaaaaucgugggucucuaugggaauggagucgugacgacaaguggcacuuacguuucugcaauagcucaggccaaggcgagccaggaaggcccacugcccgagaucgaggaugaaguguucaggaaacgaaaccuuaccauuauggaccugcacccuggguccggaaagacacggcgcuauuugccggccaucguccaugaggcaauuaagagaaaacuaaggacccugauccucgcuccaacucgggugguagccucagaaauggcugaggcauuaaaggguaugcccauacgauaccaaaccacagccgugaaaucugaacacacgggcaaggagauuguugaucugaugugccaugccacuuuuaccaugagacuucugagcccuguccgcgugccaaauuauaacaugaucaucauggacgaggcucacuucacagaucccaguuccauugcggcaaggggguacaucagcacccgugugggaaugggcgaagccgcugccauauuuaugacugcaacaccuccggguucugucgaggccuucccccagucaaaugcuguaauucaggacgaagagcgggauaucccagaaagauccuggaacaguggguaugaguggauuaccgacuuuccuggaaaaacggugugguucguucccagcaucaagucgggcaaugauauagcgaacugucucaggaagaauggcaaacgcgugauucaguugucucgaaagacuuucgacacagaguaccaaaaaaccaagaacaacgacugggauuacgucgugaccacugacaucuccgaaaugggggccaauuuuagagcagaucggguuaucgacccaaggcgcugccugaaaccugugauucucaaggauggacccgagcgugucauccuggcugguccaaugccggugacaguagccagcgcagcccagagacggggcaggauugggcgcaaccauaauaaggaaggagaccaguauguguacaugggccagccucuuaacaaugaugaggaccacgcucacuggaccgaggccaaaaugcuacuggauaacauaaauacacccgaagguaucauuccagcguuguucgagcccgaacgagagaagucagcagccaucgacggggaauauagauuacggggcgaggcuaggaaaacuuuuguugagcugaugcgcagaggagaucucccugucuggcugaguuacaagguggccucugaaggcuuccaauauuccgacaggcgguggugcuuugauggggagcguaacaaucaggugcuugaagagaacauggacgucgaaaucuggacgaaagagggagagcgcaagaaacugcgaccaagauggcucgacgcuaggaccuacagcgaucccuuggcacugcgggaauucaaggaguuugccgcuggucgcagaucaguuaguggcgaccuaauucuggaaauagggaagcucccucagcaucuuacacagagggcccaaaaugcacuggauaacuuagugauguugcacaauagcgagcagggaggccgggcguaucgacaugccauggaagagcugccggacacuaucgagacccucaugcugcuugcucugauugccguacucacagguggggugaccuuguucuuucuguccggcagaggauuaggcaaaacuucuaucgggcuacugugugucauggcaagcuccgugcuccuuuggauggcuucaguugaaccacacuggauugccgcaucuaucauacuggaguucuuuuugauggugcugcucauccccgaaccugaucgccagaggacgccccaggacaaccaacuggccuacgucguaauuggacuucucuucaugauccugaccguggcugcgaaugagauggguuugcuggagacaacuaagaaagauuuaggcauugggcacguugccguggaaaaccaucaccaugcagcuaugcuagacgucgaucugcacccagccagugccuggacccucuacgcaguggcuacaaccaucauaacuccuaugaugcggcauacaauugagaacacgaccgccaauaucucgcuuacugcgauugcuaaccaggccgcaauccugaugggauuggacaagggcuggcccauaagcaaaauggauaucggugucccacugcucgcccuggggugcuauucccaggugaauccucuuacauuaaccgcugcaguucugaugcucguggcccacuacgcgauuaucggcccgggauugcaagcuaaggccacccgugaagcacagaagagaacagccgcuggcauuaugaaaaaccccacuguagacgggaucguggccauagaucuggacccagucguuuaugacgcaaaguuugagaaacagcuaggacagauuaugcugcucauccuuuguacgucucaaauccuguugaugaggaccacaugggcucugugcgaaucaauuacucucgccaccggcccucugacaaccuuaugggaggguagccccgggaaguucuggaauacuacgaucgcgguguccauggccaacauauuccgcggaaguuaccuugcaggcgcuggucuggccuuuucucucaugaaaagccuaggcgggggacggcgaggcacaggggcacagggagagacccugggcgaaaaguggaagagacaguugaaucagcugucaaaauccgaguucaacacuuauaagaggagugguauuauggaagucgaucgcagcgaggcuaaagaagggcucaagcggggagagaccacaaaacacgccgugucuagaggcacugccaagcuucguugguuuguagagaggaaucuggugaagccagaagguaaaguuaucgacuugggcugugggcggggaggcugguccuacuauugcgcggggcugaagaaagugaccgaggucaagggauacacaaaaggcgguccugggcaugaagagcccauuccgauggcuacguacggauggaaccucgugaaguuacacucaggcaaagaugucuucuuuaucccaccugaaaagugugacacccugcuuugcgauauaggcgagagcucgcccaauccaacuaucgaggaagggcgcacacugcgagugcuaaagaugguugagcccuggcucagaggaaaccaauucuguauuaaaauccugaauccuuauaugccgucuguaguggaaaccuuggagcagaugcagaggaagcaugguggcaugcugguccggaacccccucagucgcaauuccacucacgagauguacugggugagcugcgggacaggaaacauuguuucagcagugaauaugaccuccagaaugcuucugaacagguuuacgauggcccaccgaaaaccaaccuaugaacgggacgucgauuuaggcgcugguacacgucauguggccguagagccugaaguggcaaaccuggacaucauugggcagagaaucgagaauauaaagcacgaacauaaaucuacuuggcacuacgaugaggacaaccccuauaagaccugggccuaccauggaagcuaugagguuaagccuaguggcuccgcuagcucuauggucaauggcguggugaaauugcucacaaagccaugggaugucauucccaugguuacucaaaucgcgaugaccgacacaaccccuuucgggcagcagcgcguguuuaaagaaaagguagacacuaggacgccaaaagccaagcggggaacagcacaaaucauggaggugaccgcuaaguggcugugggguuuccuaucaagaaacaaaaagccccgcauuuguacuagggaagaguuuacccgaaaaguccggaguaaugccgcaauaggcgccguguucguugaugaaaaccaguggaauuccgcuaaggaggccguggaggacgaaagauuuugggaucuuguccacagggagcgcgaacugcacaaacaggggaagugcgcgacaugcguguacaacaugaugggaaagcgugagaaaaagcucggcgaauucgguaaagcaaaggggagccgggccaucugguacauguggcugggagcuagauucuuggaguuugaggcccugggcuucaugaaugaagaccauugguuuucuagggagaacucgcucucaggcguagaaggggagggacuucacaaacuggguuauauuuuacgcgauaucagcaagauuccgggcgggaauauguacgcagacgauacggcuggaugggacacccgaaucacugaggaugaccugcagaacgaagccaaaauaacagauaucauggagccugaacaugcuuugcucgccaaguccauuuucaagcugaccuaucaaaauaaaguugugcggguccagagaccagcaaagaacggcacugugauggacgugaucaguaggcgcgaucagagagguucugggcaggucggaacauacggccuaaauaccuuuacaaacauggaggcgcaacuuauucggcagauggaaagcgagggcaucuucucccccucagagcuggaaacuccuaaccucgccgggaggguucuggacugguuggagcgucacggaguggaacgauuaaaacgcauggcuauaaguggugacgauuguguagugaagccaauugacgauagauuugccaccgcacugacggcucucaaugacaugggcaaaguccggaaggauaucccccagugggagccgucuaagggguggaacgacuggcagcaagugccuuucugcagccaccauuuucaccagcuuaucaugaaagauggaagggaaauuguugugcccugucgcaaucaggacgagcuggucggcagagcccgggugucccagggugcaggguggucacuaagggagaccgccugccugggaaagagcuaugcgcaaauguggcagcucauguacuuccaucgacgugauuugagacuggcugccaacgcaauauguucugccguaccaguugacugggugccuacaucccgcacuaccuggaguauccacgcucaucaccaguggaugacaacugaagauaugcuuagcgucuggaaucggguguggauugaggaaaaccccuggauggaggacaaaacccacaucucguccuggggcgacguuccauaucugggcaagagggaagaucaauggugcgggucucucauuggauuaacggccagagcaacaugggcuaccaauauccagguggccauaaaccagguccgccggcugaucgguaaugagaacuacuuggacuacaugacuucaaugaaaagguuuaagaaugagagcgaucccgaaggcgcgcugugguga

SEQ ID NO: 13685 - RNA, 9879 nt, Artificial Sequence
  derived and/or modified CDS sequence (opt3) from DENV-1__FJ410247__SS-prME
agcgugaccaugcugcucaugcuuaugcccaccgcccuggcuuuccacuugacuacgcggggaggggagccucauaugaucgucuccaagcaggaaaggggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcaauucugaggaaacuuugcaucgaagccaagauaucuaauaccacaacugauagccgguguccaacccaaggagaggcuacacugguggaagaacaggacgccaacuucgucugccgccgaacuuuuguugauagaggcugggguaauggguguggauuguucggcaaaggcucccucauuaccugcgcaaaguuuaagugcgugacaaaacuggaggggaagaucguacaguacgaaaacuuaaaauauucagugauugucaccgugcacacuggagaccagcaucaaguugguaaugagaguacggaacacggcacaaccgcuacuaucacaccccaggccccuacaaccgagauccagcugacugacuacggggcgcucacacuugauuguagcccaaggacgggacuggacuucaacgaaaugguguugcuaaccaugaaggagaaaucuuggcugguccauaagcagugguuucucgaucugccgcuucccuggacuuccggcgccucaacaagccaagagaccuggaaucggcaggaccuguuggugacauucaaaacugcacacgcuaagaagcaggaaguaguugugcucgguagucaagagggggccaugcacaccgcucugacgggcgccaccgaaauucagacaucuggaacuaccacaauauuugcaggccauuuaaaaugccgucugaagauggauaaacuaacucucaaggggauguccuaugucauguguaccggaucguucaaacuggagaaggaaguggccgagacgcagcacgguacaguccuugugcagaucaaguacgagggcaccgacgcuccuugcaaaauuccauucucgacucaagaugaaaaggggguuacacagaacggacgcuugaucaccgcgaaucccauagugacugacaaagagaagccuguaaacauugaagcagagccacccuuuggcgagucuuauaucgucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaaaaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccagacugcggggccguggcaucucggaaaacuggagcuugauuuugacuugugcgaaggcacaaccguagucguggaugagcacugcgggaacagaggacccucccugaggacgacuaccgugacaggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuuccuacugcucaucaugggacagcugaccuggaacgaucuuauucguuugugcauaauggugggcgccaaugcaucugacagaauggggaugggaacaacuuaccuggcuuuaauggccaccuuuaagaugaggccuauguucgcaguuggccuccuguuucgccggcuuacgagcagagaggugcugcuacucacaaucggucugucauuggucgccaguguggaacugccaaacuccuuagaggaacucggggauggacuggcuaugggcauuaugauccuuaaacuguugaccgacuuccaaucucaucagcucugggcgacucugcuaagccugaccuuuauuaagacaacuuucucccuucacuaugccuggaaaaccauggcaaugguucucucaaucgugagccuguuucccuugugucugaguacgacaucucagaagaccacuugguuaccgguccuccugggcucccuugggugcaagccucugacaauguucuugauagcugagaauaggaucuggggacgacgcagcuggccacucaacgaagguauuauggccguaggcaucgugucgauucugcuaucaucucugcuuaaaaacgauguuccccucgccgggccucugaucgcuggaggcauguugauagcauguuacgugauuagugguuccagcgccgacuuaucucuggagaaggcggcugaggucagcugggaagaggaagccgagcauuccggggcaucacacaauauccucguggaaguacaggaugacggaaccaugaaaaucaaggaugaggagcgggacgauacucugacaauucuucugaaagccaccuugcuagcugugaguggcgucuauccccugagcauaccagcaacgcucuuuguuugguacuucuggcaaaagaaaaagcagagaucuggcgugcugugggacacuccuucacccccagaaguggagagggccguccuugaugacgggaucuaucguauuaugcagcgcggauuacugggucggagccaggugggcguugggguauuccaagaaaacguguuucauaccauguggcacgucacaagaggagcggugcucauguaccagggcaagagguuggagccgaguugggcuagcguuaaaaaggaccugaucuccuacggugggggauggcgacuccagggcucuuggaauaccggcgaggaagugcaggucauugccguggagccugggaaaaaccccaagaauguacaaacaacuccaggaaccuucaaaacgcccgaaggugaggucggcgcaaucgcccuggauuuuaagccugggacaucgggaagcccaauagugaaccgggaaggcaagaucguuggucuuuaugggaauggaguggucacuaccucaggcacauacguguccgcuauugcccaggcaaaagcuagucaggagggcccccugccugagaucgaagacgagguuuuccgcaagagaaacuugaccauuauggaucuacacccggggucuggaaaaacuaggcgguaucugccagccaucgugcgagaagcgauaaagagaaaacuccgcaccuuaauucuggcccccacaagggucguggcaagcgagauggcugaagcccuuaaggguaugccuauccguuaccaaacgacugcuguaaaguccgagcauaccggcaaagagaucguggaccugaugugccacgcaacauuuaccaugcggcucuugucaccaguuagaguccccaauuauaacaugauuaucauggaugaagcccauuucacugacccuucuagcauagccgcuaggggguacauuaguacacgcgugggaaugggcgaggcggcagccaucuuuaugaccgcuacgccgcccgguuccguggaagccuucccacagagcaaugcagucauucaggaugaggaacgagacaucccugagagaucuuggaacucaggguaugaguggauaacugauuuucccggaaagacaguaugguucgugccauccauuaaaaguggcaaugacaucgccaacugucugcggaagaauggcaaaaggguuauccagcucagccgcaagaccuuugauaccgaauaccaaaagacuaaaaacaacgacugggacuacguggucacaaccgauauuucggagaugggggcuaauuuccgugcggacagagugaucgauccucggaggugccugaagcccguuauucuuaaagacggaccagaacgcgugauacuagccgguccgaugccugucacaguggcaucugcugcccagcgaagaggccggaucgggaggaaccacaauaaggagggagaucaguauauuuacaugggccagccccugaacaaugacgaggaucaugcacacuggacugaagccaaaauguuguuagacaacaucaauacgccagaggguaucauucccgcucuguucgaaccugagcgcgaaaaguccgccgcgauagauggggaguauagacucaggggcgaggcacggaagaccuuuguagaacugaugcgucgcggagaccuuccaguguggcugagcuacaaaguugccucagagggcuuccaauauagugaucgaagauggugcuuugacggggaaaggaacaaucagguccucgaggaaaacauggauguggagaucuggacaaaggagggagaacggaaaaaguugcgccccagauggcuggacgcuaggacuuacucugacccucuagcccugcgggaguucaaagaauuugcugcaggucgaagauccgugagcggcgaucucauucuugagaucgggaagcugccgcagcacuuaacccagcgcgcccaaaaugcuuuggacaaccuggucaugcuccauaauucagaacagggaggcagggccuaucggcacgcaauggaggagcugccagauacaauugaaacccuuaugcugcucgcguugaucgccguucugacugguggggugacguuauucuuucuaaguggccguggacugggcaaaaccagcauagggcuccuuuguguaauggcuuccucugugcuguuguggauggccagcgucgagccccauuggaucgcagcuuccauuauccuggaguucuuucucauggugcugcuuauuccugagcccgacagacagaggacaccacaggauaaccaacucgccuacguugugaucggacuguuguucaugauacugacugucgcagccaaugagauggguuuacuagaaaccacaaagaaggaccugggcauugggcacguagcugugggaaaccaccaucacgcggccaugcucgauguugaccuucauccugcaucagcuuggacccuguacgccguggccacuacaaucauuacgcccaugaugcgccacaccaucgagaacacuacagcaaauauaucuuugaccgcuaucgccaaccaggcggcuauucugaugggccucgauaaagguuggccaaucaguaagauggacauuggggucccucugcuugccuuaggcugcuauagccaggugaauccgcugacccucacagcagccgucuugaugcugguggcucauuacgcaaucauaggacccggccuacaagccaaagcgacucgggaagcucagaagcgaacggccgcagggauuaugaaaaacccaaccguugauggaaucguggccaucgaccuggauccuguaguguaugacgcuaaguuugagaagcagcucggccagauuaugcuucugaucuuguguacaagccaaauacugcucaugagaacuaccugggcccugugcgaauccauuacauuagcaaccgguccccuuacuacgcugugggaggggucuccaggaaaauucuggaauacaaccaucgcugucucaauggccaacauuuuuaggggcagcuaccucgcgggugccggccuagcauucucccugaugaagagucuagggggaggccgccgggggacuggagcucagggcgagacccugggugaaaaauggaagagacagcucaaucagcuuucuaaaagcgaguucaacacauauaagcguucagggaucauggaaguugacagguccgaggccaaggaaggacugaaacggggcgagacuaccaagcacgcagugagucgcgguacagcuaaauugcgaugguuugucgagagaaaucuggugaagccugaaggcaaaguaauagaucucggguguggaaggggcggguggagcuacuauugcgccggauuaaagaaggugacggagguuaaaggcuacaccaagggugggcccggacacgaagaaccgaucccaauggccacuuacggcuggaaccuggugaaacuucauucuggcaaggacgucuucuuuauuccucccgaaaaaugugauacacugcuaugcgacaucggggaguccucaccaaaucccaccauugaggaaggacggacucuccgcgugcugaagauggucgagccuugguugagagguaaccaauucuguaucaaaauucugaauccguauaugcccagcgugguugaaacacucgagcagaugcagaggaagcacggcgggaugcuuguacgaaacccacugucgagaaauucuacccaugagauguacugggugaguugcggaacgggcaacaucgucuccgcggugaauaugaccagccguauguuacugaacagauuuacaauggcucaccgcaagccuacuuaugaaagggauguugacuugggugcagggacccggcacguggccgucgagcccgaaguggcuaaccucgauauaauuggacagagaaucgagaauaucaaacaugaacacaagucaacauggcauuacgacgaggauaacccuuauaaaacuugggccuaccacggcuccuaugagguaaagccaucuggcagcgcaaguuccauggugaaugggguugucaaacugcuaaccaagcccugggacgugauuccuauggugacacaaauagccaugaccgauacuacgccauucggacagcagcgcgucuuuaaggaaaaaguugacacaaggacccccaaggcuaaacaagguacugcgcagaucauggaggugaccgccaaguggcuuuggggcuuccugagccgaaacaaaaagccgcggauuuguacaagagaagaguuuacgaggaagguacgcucuaaugcagcuaucggggccguguucgucgacgaaaaccaguggaacucagcaaaagaggccguggaggaugaacguuuuugggaccucguucaucgggagagagaacugcacaagcagggaaaaugcgcuaccugcguguacaacaugaugggcaagagggagaaaaaguugggugaguucgggaaggccaaaggaagucgcgcgauuugguacauguggcugggcgcacgauuucucgaguucgaggcccuuggcuucaugaaugaagaucacugguuuucccgggagaacagccugucuggggucgaaggagaggguuuacauaagcugggcuauaucuugagagacauaucgaaaaucccugggggaaauauguacgcugaugacacugccggcugggauacaaggauuaccgaggacgaucuccaaaacgaagcacgcaucacugacauuauggagccagaacacgcucugcuagccaagucaaucuucaaacuuacauaucagaauaaggugguaagaguucagcggcccgcuaaaaacgguaccgugauggaugucauaagcaggcgugaccagcgaggguccggacaagugggcacauacggccugaauacuuuuaccaacauggaggcccagcucauucgccagauggaaagugaggggaucuucucuccuagcgagcuggaaacgccaaacuuggcagagagaguguuagauuggcuggaaaaguauggagucgagcggcucaagaggauggcgaucuccggugacgacuguguugugaaacccauugaugaccgcuuugccaccgcucuuacagcccugaaugauaugggcaagguaagaaaagacauaccgcagugggaaccuucaaagggguggaacgauuggcaacaggugcccuucugcagucaucacuuucaccagcuaaucaugaaagacggacgggagauugucgugccauguaggaaucaggaugagcugguuggccgagcacgugugucucaaggugcuggguggagccucagagaaacugccugcuugggaaaguccuacgcacagauguggcagcugauguauuuccaucgccgggaccuuaggcuggccgcgaacgcuaucuguucagccgucccuguggauuggauucccaccagcagaacaacuuggucuauccacgcacaucaccaauggaugaccacggaggacaugcucuccguauggaaucgcguuuggauagaagagaacccauggauggaagauaagacacauaucaguagcuggggcgacgugcccuacuuaggcaaacgggaggaccaguggugcgggucgcugauuggauugaccgccagggcuacuugggccacaaauauccaggucgcaauuaaccaggugcgaagacugaucgguaaugagaacuaccucgauuauaugaccuccaugaagcgguuuaaaaaugaaucugacccugagggcgcucuuugguga

SEQ ID NO: 13686 - RNA, 9879 nt, Artificial Sequence
  derived and/or modified CDS sequence (opt3) from DENV-1__FJ410248__SS-prME
agcgugaccaugcugcucaugcuuaugcccacagcacuggcuuuccacuugacuacgagaggaggggagccucauaugaucgucuccaagcaggaaaggggaaaaucuuuacuguuuaagaccucagccgguguuaacaugugcacacuaauugcaauggaccucggcgagcugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuagcaccgagauccagcugacagacuacggggcccucacccuugauuguucuccaaggacuggacuggacuucaacgaaauggucuugcuaacaaugaaggagaaauccuggcuggugcauaagcagugguuucucgaucugccgcuucccuggacgucaggcgcaagcaccagucaagagacuuggaaucggcaggaccuguugguaacauucaaaaccgcucacgccaagaagcaggaaguugugguccucgguucucaagagggggcuaugcacacagcccugacuggcgcaaccgaaauccagacguccggaaccacaacuauuuuugccggccauuuaaaaugccgucugaagauggauaaacuaacccucaaggggaugagcuaugugauguguacaggaucguucaaacuggagaaggaagucgcugagacucagcacgguaccgugcuuguucagauaaaguacgagggcacggacgcgccuugcaaaaucccauucucuacacaagaugaaaagggggugacccagaacggacgcuugauuacugcaaaucccaucguaacagacaaagagaagccugucaacauagaagccgagccacccuuuggcgaguccuauauugugaucggugcuggggaaaaagcccugaagcucucaugguucaagaaaggcaguagcaucggaaagauguuuguugcaaccgccagaggcgcuaggcggauggccauucugggggauacugcaugggacuucggauccaucgguggcguguuuaccucugucgggaaacuugugcaucagauuuucggaacagcguacggcguacuguuuagcggugugucauggacgaugaagauagggaucggcguuuugcucaccuggcugggauuaaauagucgauccacuagccugucuaugacauguauugcugucggccuagugacccucuaccugggggugaugguccaggccgauucaggaugcguuaucaacuggaaaggccgcgagcuuaagugugguagugggaucuucgugacaaaugaagugcacacuuggaccgagcaauauaaguuucaggcagacagcccgaaaagauuguccgccgcuauuggaaaggccugggaagagggcguaugcgguauaaggucugcaacgcggcuggagaacaucauguggaaacagauuucgaacgaacucaaucauauccuguuagagaacgacaugaaguucacagucgugguuggcgauguggcugggauucuggcccagggcaagaaaaugauccgcccucaacccauggaauacaaauauagcuggaaguccuggggcaaggcgaaaauaaucggggccgacguccagaauaccacuuuuauuaucgauggaccaaacaccccugagugucccgacgaucagagagcuuggaauauuugggaaguggaggacuacggcuucgguaucuuuacaacuaacauauggcuuaaguugagggauucauauacccagguuugcgaccaccgucucaugagugcagccauuaaagauucuaaggcugugcacgccgacaugggguacuggaucgagagcgagaaaaaugagacauggaagcuggcacgggcguccuucauugaaguaaagacguguaucuggccaaaaucacauacccuauggagcaacggaguccuggagucugaaaugauaauccccaagauuuauggcgguccuaucucccaacacaauuaccgaccaggcuacuucacucagacagccgggccguggcaucucggaaaacuggagcuugauuuuaacuugugcgagggcaccacugugguggucgacgaacacugcgggaauagaggacccagucugaggacaaccacgguuacuggcaagauuauccacgagugguguugccgcagcuguaccuuaccuccacuccgguucaaaggugaagaugggugcugguauggaauggagauaagacccgugaaggagaaggaagagaaccugguaaaaucuaugguguccgcuggcucaggugaagucgacaguuuuagccuuggccuguuguguauuucgaucaugaucgaggaagugaugaggucccgcuggucucgaaagaugcucaugacagggacccuggccguuuucuuucuacugauuaugggacagcucacuuggaaugaccugauccggcuuugcauuauggugggcgcaaacgcuagcgaucguauggggaugggaacaaccuacuuggcccugauggcaacauucaaaaugagaccuauguuagccgucggccuccuguuuaggcgccuuacuucacgggaggugcugcuacucaccauaggucugaguuugguugcuuccguggagcugccaaauucuuuagaagaacucggggacggacuggcgaugggcaucaugauucuuaagcuguugacggauuuccaaagccaucagcucugggccacacugcuaucccugaccuuuaucaaaacuaccuauucacuucacuacgcauggaagacaauggcuaugguccucagcauuguaagucuguuccccuugugucugucuacuaccucccagaagacgacaugguuaccggugcuccugggcagccuugggugcaaaccucugaccauguuuuugaucgccgaaaacaagauauggggaagaaaaucguggccacucaacgaggguaucauggccguuggcauugugucaauccugcuaucuagucugcuuaagaaugacgucccccucgcugggccucugauugcaggaggcauguugaucgccuguuaugugauauccgguagcucugcggauuuaagccuggaaaaagcugccgagguauccugggaggaagaggcagaacauucaggggccagucacaacauucucguggagguccaggacgauggaacuaugaagaucaaagacgaagagagggaugacacacugaccauccuucugaaggcuacuuugcuagcaguuagcggcguguacccccugucuauuccagccacacucuucgugugguauuuuuggcaaaagaaaaagcagcgauccggcguccugugggauaccccuucacccccagagguggaacgcgcgguucuugacgaugggauauaccggaucaugcagagaggauuacuggguaggagucagguaggcgugggggucuuccaagagaauguguuccauacgauguggcacguuacucguggagcugugcucauguaccagggcaaacgcuuggaaccgagcugggccuccgucaagaaagaccugauuucuuauggugggggauggcggcuccagggcucguggaacaccggcgaggaggugcagguaaucgcagucgaaccugggaagaaucccaagaacgugcaaacagccccaggaaccuuuaaaacaagcgagggugaaguuggcgcuauugcccuggacuucaagcccgggacuucaggauccccuaucgugaauagagagggcaaaauagucggucuuuacgggaacggagugguuaccacgaguggcacauaugugucugcaaucgcucaggccaaggcgagccaggaaggcccacugcccgagauugagaaugaagucuuuaggaaacgaaacuugacuaucauggaucuacacccuggguccggaaagacccggcgcuaccugccggccauugugagagaggcaaucaagaggaaacuccggacauuaauacuggcuccaacccgaguaguggccucagaaauggcugaggcacuuaaggguaugcccauuagauaucaaacuaccgccguuaaaucugaacauacaggcaaggagaucgucgaccugaugugccacgccacguucacuaugcgccucuugagcccugugagggugccaaauuacaacaugaucauuauggaugaggcucauuuuaccgaccccaguuccaucgcggcacguggguauauaagcacacgggucggaaugggcgaagccgcugccauuuucaugaccgcaacuccuccggguucuguagaggccuuuccccagucaaaugcugugauccaggaugaagagagagacauuccagaaagguccuggaacaguggguacgaguggaucacagauuucccuggaaaaaccguuugguuugugcccagcauaaagucgggcaaugacauugcgaacugucugcgcaagaacggcaaacgagucauccagcucucuagaaagacguucgauacugaguaccagaaaacaaagaauaacgacugggauuaugugguuaccaccgacaucuccgaaaugggggccaauuuucgggcagacagggugauugauccacgccguugccugaaaccugucauccuuaaggacggacccgagagagugauucuagcugguccaaugccgguaacuguggccagcgcagcccagcggaggggccgcauagggcgaaaccacaauaaggaaggagaucaguacaucuauaugggccagccucugaacaaugacgaggaucaugcucacuggacagaggccaaaauguuguuagacaacauuaauacccccgaagguaucaucccagcgcuguucgagcccgaaagagagaagucagcagccauugauggggaauaccggcucaggggcgaggcucgcaaaacauucguugagcugaugagaaggggagaccuuccugucuggcugaguuauaagguggccucugaaggcuuucaauacuccgaucggcguuggugcuucgacggggagcgcaacaaucaggugcucgaagagaacauggaugucgaaauauggacuaaagagggagagcgaaagaaauugagaccaagguggcuggacgcucggacguauagcgauccccuagcacugcgcgaauuuaaggaguucgccgcugguagaaggucaguuaguggcgaccucauccuugaaauugggaagcugccucagcacuuaacccagcgggcccaaaaugcauuggacaaccuggugaugcuccauaauagcgagcagggaggccgagcguacagacacgccauggaggaacugccggauacaaucgagacucuuaugcugcucgcuuugauugccguacugaccgguggggugacauuauuuuuccuauccggccgcggacugggcaaaaccucuaucgggcuccuuugugucauggcaagcuccgugcuguuguggauggcuucaguugaaccacauuggauagccgcaucuaucauucuggaguuuuuccucauggugcugcuuauccccgaaccugacaggcagcggacuccccaggauaaccaacucgccuacgucguaauuggacuguuguuuaugauccugacgguggcugcgaacgagauggguuuacuagagaccacaaagaaagaccugggcauagggcacguugccguggaaaaucaccaucacgcagcuaugcucgaugucgaccuucauccagccagugccuggacucuguaugcaguggcuaccacaauuaucaccccuaugaugcgucacacuauugagaacacaacggccaauaucucguugaccgcgauagcuaaccaggccgcaauccugaugggacucgauaagggcuggcccauuagcaaaauggacaucggugucccacugcuugccuuagggugcuacucccaggugaauccucugacucucacagcugcaguuuugaugcugguggcccauuaugcgauuaucggcccgggacuacaagcuaaggccaccagagaagcacagaagaggaccgccgcuggcauaaugaaaaaccccacaguagaugggauuguggccaucgaccuggauccagucguuuacgacgcaaaguucgagaaacagcucggacagaucaugcuucugauuuuguguacuucucaaauccugcucaugcgcacgaccugggcucugugcgaaucaauaacauuagccacuggcccucuuaccacacugugggaggguagccccgggaaguuuuggaauaccacuauugcgguguccauggccaacaucuuccggggaaguuaucucgcaggcgcuggucuagccuuuucucugaugaagucauugggcgggggacgaagaggcacgggggcacagggagagacacugggcgaaaaguggaagaggcagcucaaucagcuuagcaaauccgaguucaacaccuacaagcgcagugguauuauggaagucgaucggagcgaggcuaaagaagggcugaagagaggagagacuaccaaacacgccgugucucguggcacagccaaguugaggugguucguagagcggaaucuggugaagccagaagguaaaguuaucgaccucggcugugggcgcggaggcugguccuauuacugcgcgggguuaaagaaagugacugaggucaagggauacaccaaaggcgguccugggcacgaggagcccauaccgauggcuacauauggauggaaccuggugaaacuucauucaggcaaagacgucuuuuucaucccaccugaaaagugugauacgcugcuaugcgacauuggcgagagcucgcccaauccaaccaucgaggaagggcgaacucucagagugcugaagaugguugagcccugguugaggggaaaccaauuuuguauuaaaauccugaauccuuacaugccgucuguaguggaaacacucgagcagaugcagcggaagcacgguggcaugcuuguccgcaacccccugaguagaaauuccacccaugagauguauugggugagcugcgggacuggaaacauuguuucagcagugaacaugacauccaggauguuacugaaucgauucaccauggcccaccggaaaccaacguacgaaaaggaugucgacuugggcgcugguacccgucacguggccguagagccugaaguggcaaaccucgauaucauagggcagagaauugagaauaucaaacaugaacacaagucuacauggcauuaugacgaggauaaccccuacaagacuugggccuaucacggaagcuacgagguuaaaccuaguggcuccgcuagcucuauggucaauggcguggugaagcugcuaaccaaaccaugggacgucauccccaugguuacacaaauugcgaugacugauaccacaccuuuugggcagcagcgcguguucaaggaaaaaguagacaccaggacuccaaaggccaagcggggaacggcacaaauaauggaggugacagcuaaauggcuuugggguuuucugucaagaaacaagaaaccccgcaucuguaccagggaagaguucacucgaaagguccggaguaaugccgcaauuggcgccguguuuguugaugaaaaccaguggaacuccgcuaaagaggccguggaggacgaaagauucugggaccucguccauagggagcgcgaacugcacaagcaggggaagugcgcgaccugcguguacaacaugaugggaaaacgugagaagaaauugggcgaauuugguaaggcaaaagggagccgggccaucugguauauguggcugggagcuagauuccucgaguuugaggcccuuggcuucaugaaugaagaucacugguucucuagggagaacucgcugucaggcguagaaggggagggauuacauaagcuggguuacauuuugcgcgacaucagcaaaauaccgggcgggaauauguaugcagaugacacagcuggaugggauacgcgaaucaccgaggacgaucuccagaacgaagccaagauuacugacaucauggagccugaacacgcucugcuagccaaguccauuuuuaaacuuacauaccaaaauaagguugugcggguccagagaccagccaaaaauggcaccgugauggaugugaucaguaggcgcgaccagagagguucugggcaggucggaacuuauggccugaacacauucaccaauauggaggcgcaacucauacggcagauggaaagcgagggcauauuuucccccucagagcuggaaacaccuaacuuggccgggaggguuuuagauuggcuggagaagcauggaguggaacgucucaaacgaauggcuaucaguggugacgauuguguagugaagccaaucgacgaccgcuucgccacugcacuuaccgcucugaaugauaugggcaaggucagaaaagacauuccccagugggagccgucuaagggguggaacgauuggcagcaagugccuuuuugcagccaccacuuccaucagcuaauaaugaaagacggacgggaaaucguugugcccuguaggaaucaggaugagcuggucggccgcgccagagugucccagggugcaggguggucacuccgggagacggccugcuugggaaagagcuacgcgcaaauguggcagcugauguauuuucacaggcgagaccuucgucuggcugccaacgcaauuuguucugccguaccaguugauugggugccuaccuccagaacaacuuggaguauccaugcucaccaucaguggaugaccacagaagacaugcucagcgucuggaaucgcguguggauugaggaaaaccccuggauggaggauaaaacucacaucucguccuggggcgacguuccauacuuaggcaagcgggaagaucaauggugcgggucucugauaggauugaccgccagggcaacgugggcuacaaauauccagguggccauuaaccaggucagacgccugaucgguaaugagaacuaccucgacuauaugaccucaaugaagcgguucaaaaaugagagcgaccccgaaggcgcgcuuugguga

SEQ ID NO: 13687 - RNA, 9879 nt, Artificial Sequence
  derived and/or modified CDS sequence (opt3) from DENV-1__FJ410249__SS-prME
agcgugaccaugcugcucaugcuuaugcccacugcacuggcuuuccacuugacuacgaggggcggggaaccucauaugaucgucuccaagcaggaaaggggaaagucuuuacuguuuaagaccucagccgguguuaauaugugcacccuaauugccauggaccucggcgaguucugugaagauacuaugaccuacaaaugcccacggauuacagaagcggaaccggacgauguggacuguuggugcaaugcuaccgauacuuggguaacauaugggaccuguagucaaacgggagagcgccgacgugacaagagaagcguggcccuggcaccccacgucggccuuggucuggagacuaggaccgaaacauggauguccucugagggggccuggaaacagauccagcggguggaaacuugggcuuugcgccauccuggauuuaccguuauugcacucuuccuggcccacgcuaucggcacaucgauuacccagaagggcaucauauuuauccugcucauguuagugacgccaucaauggccaugagaugcgucggggugggaagcagggauuucguugagggucugaguggcgcgacuuggguugacgugguccuugagcauggguccugugugacaaccauggcaaaggauaaacccacuuuggacauugaacugcuaaagacagaggugaccaacccugccguccuccggaaacugugcaucgaagcuaagauuucuaauacgaccacagauagccgcuguccaacucaaggagaggccacccuuguugaagaacaggacgcaaacuuugugugccgaagaacauucguagauaggggcugggguaauggguguggacuguuuggcaaaggcuccuugaucacuugcgcuaaguucaagugcgugaccaaacucgaggggaagacaguccaguacgaaaaccugaaauauucagugauaguuaccgugcacacuggagaccagcaccaagucgguaaugagaguacggaacauggcacaaccgccacuauuacaccccaggcgccuagcacagagauccaguuaaccgacuacggggcccugacucucgauuguucuccacggacaggacuugacuuuaacgaaauggugcuguugacgaugaaggagaaauccuggcuaguacacaagcagugguuccuggaucucccgcugcccuggaccucaggcgcaagcacaagucaagagacauggaaucguaaagaccuucugguuaccuuuaagacagcucaugccaagaaacaggaaguggucguguuggguucucaggagggggcuaugcacacugcccucaccggcgcaacggaaauucaaaccuccggaacaacuaccaucuucgccggccaccugaagugccgcuuaaaaauggauaagcugacacuaaaagggaugagcuaugucauguguacuggaucguucaagcucgagaaggaaguggcugagacccagcaugguacgguucuggugcagaucaaauacgagggcacagacgcgccuugcaagauuccauuuucuacccaggaugaaaaagggguaacucaaaacggaagacuuauaacagcaaaucccaucgucaccgacaaggagaaaccugugaacauugaagccgagccacccuucggcgaguccuauaucguuauaggugcuggggaaaaggccuugaagcugucaugguuuaaaaagggcaguagcauuggaaaaauguucgaggcaacugccaggggcgcucggcgaauggccauccucggggauaccgcaugggacuuuggauccaucgguggcguguucacaucugucgggaagcuggugcaccagauuuuuggagcggcuuacggcguacuuuucagcggugugucauggacgaugaaaaucgggauuggcguucuguugaccuggcucggacugaauagucgcuccacuagcuuaucuaugacauguauagccgucggccuggugacccuauaccucggggugaugguccaggcagauucaggaugcguuaucaacuggaagggcagagaacugaagugugguagugggauuuuugugacaaaugaggugcauacuuggaccgaacaguauaaauuccaagccgacagcccgaagaggcuuuccgcugccaucggaaaagcaugggaggagggcguaugcgguauccggucugcuacgcgcuuggaaaacauuauguggaagcagauaucgaacgagcugaaucacauccuccuggaaaacgacaugaaauuuacagucgugguuggcgauguggccgggauuuuagcgcagggaaagaaaaugaucagaccucagcccauggaguacaaguauagcuggaaguccuggggcaaagccaagauuaucggggcugacguccaaaauaccacuuucauaaucgauggaccaaacaccccugaaugucccgacgaucagagggcauggaauauuugggagguggaggacuacggcuuugguaucuucacaacuaacauuuggcugaaacuucgugauucauauacccagguuugcgaccaucgguugaugagugccgcuaucaaggauucuaaagccgugcacgcagacaugggguacuggauagaaagcgagaagaaugaaacauggaagcucgcgcgagccuccuucauugagguaaaaacguguaucuggccaaagucacacacccuguggagcaacggaguccuagaaucugagaugauuauccccaaaauauauggcgguccuaucucccagcauaauuacagaccaggcuacuuuacucaaacagcugggccguggcaccugggaaagcucgagcuggauuucgaccuuugcgaaggcaccacugugguggucgaugagcauugcgggaacaggggacccaguuugcgcacaaccacgguuacuggcaaaauuauccacgaaugguguugccggagcuguacccugccuccauuaagauuuaagggugaggacgggugcugguauggaauggagauuaggcccgugaaggaaaaagaggaaaaucucguaaagucuaugguguccgccggcucaggugaggucgacaguuucagccugggccuucuguguaucucgauaaugauugaagaggugaugcgcucccgauggucucggaaaauguugaugacagggacccucgcaguauuuuucuuucugaucaugggacagcuaacuuggaacgaucugauccgucucugcauuauggugggcgcuaaugccagcgacagaauggggaugggaacaaccuaccuggcacuuauggccacauucaagaugaggccuauguuugcugucggcuugcuguuccgccgguuaacuucaagagaggugcuccugcuuaccacgggucugagucuaguugcguccguggaacucccaaacucucuggaggaauugggggauggacuggccaugggcaucaugauuuuaaaacuccugacagacuuucagagccaccaacuuugggcaacccuguugucccucacuuucauaaagaccacauuuucacugcauuaugcuuggaagacuauggccaugguccuaagcaucguaagucuguucccccuuugucucucuaccacgucccagaaaacaaccuggcugccgguguugcugggcagcuuagggugcaagccucucacuauguuccugauugccgagaauaaaaucuggggaaggaagucguggccacuuaacgaagguauuauggcuguuggcaucgugucaauacuguugucuagucuccugaaaaacgaugucccccuagcagggccucugaucgccggaggcaugcuuauugcguguuacgugaucuccgguagcucugcugaccucagccuggagaaggccgcagagguauccugggaagaggaagccgagcacucaggggcuagucauaauauuuugguggaaguccaggaugacggaacaaugaaaaucaaggaugaggagcgagacgauaccuuaacuauacugcucaaggcaacacugcuugccguuagcggcguguauccccugucuauuccagcgaccuuguuugugugguacuucuggcagaaaaagaaacaacgcuccggcguccuaugggacacgccuucacccccagaaguggagcgggcuguucuggaugacgggaucuauagaaucaugcagaggggacuccugggucguagucagguaggcgugggggucuuucaggaaaacguguuccacacuauguggcauguuacccgcggagccgugcuuauguaccaaggcaagcgguuagagccgagcugggcauccgucaaaaaggaccugauuucuuacggugggggauggagacuccagggcucguggaauacaggcgaggaagugcagguaauagccgucgagccugggaagaaccccaaaaaugugcagaccgcuccaggaacauuuaagacuagcgaaggugagguuggcgccaucgcauuggauuucaaacccgggaccucaggauccccuauugugaacagggaaggcaagaucgucggucuguaugggaauggagugguuacgacaaguggcacuuacgugucugcuauugcccaagcgaaagccagccaggagggcccacuccccgagaucgaagacgaggucuuucgaaagcggaaccugaccauaauggaucuucacccuggguccggaaagacacgcagauaucugccggcaaucgugagggaagcuauuaaacggaaguugcgaacccuaauccuggccccaacuagaguaguggcuucagagauggcagaagcccucaaagguaugcccauucgcuaccagaccacagccguuaagucugagcacacgggcaaagagaucgucgacuuaaugugccaugcuacuuucaccaugaggcugcuuagcccugugcgugugccaaauuauaacaugauaauuauggaugaagcgcacuuuacagaccccaguuccaucgcagcccggggguacaucagcaccagagucggaaugggcgaggcugccgcaauuuucaugacugccacaccuccggguucuguagaggcuuuuccccaaucaaaugcggugauccaggaugaggaaagggacauaccagagcgcuccuggaacaguggguaugaguggauuaccgauuucccuggaaagacgguuugguucgugcccagcaucaagucgggcaaugacauugccaacugucugagaaagaauggcaagagagucauccagcucucucggaaaacuuuugauacagaauaccagaagaccaaaaacaacgacugggacuacgugguuaccacugauauauccgagaugggggcaaauuucagggcugaccgcgugauugauccacguagaugcuugaagccugucauccugaaggacggacccgaacgggugauccucgccgguccaaugccgguaacaguggcaagcgccgcucaaaggcgcggccgaauugggagaaaccauaauaaagagggagaucaguauaucuacaugggccagccucugaacaaugacgaggaucacgcccauuggaccgaagcgaagaugcuucuagacaacauuaauacacccgaggguauaaucccagcacuguuugaacccgagcgggaaaaaucagccgcuauugauggggaguauagguugcgcggcgaggccagaaagacuuucguugaauuaaugaggcggggagaccugccugucuggcucaguuacaaaguggcuucugagggcuuucaguauuccgaucgucgcuggugcuucgacggggaacgaaacaaucaagugcuggaggaaaacauggaugucgagaucuggacgaaggagggagaacgaaagaaacuuaggccacgguggcuggacgcacgcaccuacagcgacccccucgccuugagagaguuuaaggaguucgcugccgguaggcggucaguuaguggcgaucugauccuagagauugggaaacugccucagcaccucacacagcgagcacagaaugcgcuugacaaccuggugauguuacacaauagcgaacaaggaggcagagccuaucgccaugcuauggaggaguugccggauacuauagaaacccugaugcuccuggcccuuaucgcaguacugacagguggggugacccucuuuuucuuguccggcaggggacugggcaagacuucuauuggguuacuaugugucauggcuagcuccgugcugcucuggauggccucaguugagccacacuggaucgcagccucuauuauccuugaauuuuuccugaugguguugcugauacccgagccugaccggcagcguacgccccaggauaaccagcucgcuuacgucguaaucggacugcuuuuuaugauucucaccguggcggccaaugagaugggucuguuggaaacaacuaaaaaggaccugggcaucgggcauguugcaguggagaaccaccaccaugcugccauguuagaugucgaccuacacccagccagugcauggacccuguacgcuguggccacaaccauuaucacuccuaugaugagacauacaauagaaaacacgaccgcgaauauuucgcucacugcuaucgccaaccaagcagccauucuuaugggacuggauaaaggcuggcccaucagcaagauggacauaggugucccauugcuggcucucgggugcuauucccaggugaauccucugacacuuaccgcagccguuuuaaugcugguggcgcacuacgcuaucauuggcccgggacuccaggccaaggcaaccagggaggcccaaaaacgcacagcugccggcaucaugaagaaccccacuguagaugggauuguggcaaucgacuuggauccagucguuuaugacgcuaaauucgaaaagcagcugggacagauaaugcuacugauucucuguacgucucagauccuucugaugcggaccacaugggccuugugcgagucaaucacucuggcgaccggcccucucacaacccugugggaggguagccccgggaaauucuggaauacuacgauugccguguccauggcaaacaucuuucgaggaaguuacuuagcuggcgccggucuugcauucucucugaugaaaagccucggcgggggaagaaggggcacaggggcucaaggagaaacccuaggcgagaaguggaaacgccagcugaaucaguugucaaaguccgaauuuaacacuuauaaacggagugguauaauggaggucgacagaagcgaagccaaggaggggcugaaacguggagagaccacaaagcaugccgugucuaggggcacugcgaagcuccggugguucguagaacgcaaucuugugaaaccagaggguaagguuauugaucugggcugugggcgaggaggcugguccuacuauugcgcuggguugaaaaaggugaccgaagucaaaggauacacaaagggcgguccugggcacgaggaacccaucccgauggcaacguacggauggaaccuggugaaacuccacucaggcaaggacgucuuuuucauuccaccugagaagugugauaccuuacugugcgacaucggcgagagcucgcccaauccaacuauagaagaggggagaacacuuagggugcugaaaaugguugaacccuggcuacggggaaaccaguuuuguaucaagauucucaauccuuauaugccgucuguaguggagacccuggagcaaaugcagcgcaaacaugguggcauguuggucagaaacccccugaguagaaauuccacucacgaaauguacugggugagcugcgggacaggaaacaucguuucagccgugaauaugaccucccgaaugcuccuuaaccgguucacgauggcucaucguaagccaaccuaugagagagaugucgaccugggcgccgguacacgccacguggcaguagaaccugagguggccaacuuagauauuaucgggcagaggauugaaaauaucaaacacgagcauaagucuacuuggcacuacgacgaggauaaccccuauaagaccugggcuuaccauggaagcuaugaaguuaaaccuaguggcuccgcgagcucuauggucaauggcguggugaagcuguugacaaaaccaugggacgucauacccaugguuacucagauugccaugaccgauacaaccccuuuugggcaacagcggguguucaaggagaaaguagacacuagaacgccaaaggcaaagcgcggaacagcucagaucauggaagugaccgccaaauggcucugggguuuucugucaaggaacaagaaaccccgaaucuguacucgggaggaguucaccagaaaggucaggaguaaugcagccauuggcgcuguguuuguugacgagaaccaauggaacuccgccaaagaggcgguggaagaugagcgcuucugggaccuaguccaccgugaacgggagcuucauaagcaggggaagugcgcaacaugcguguacaacaugaugggaaaaagagaaaagaaacugggcgaguucgguaaggccaaagggagcagggcuauaugguacauguggcucggagcccgcuuucuggaguucgaagcauugggcuuuaugaaugaggaucacugguucucucgagaaaacucgcugucaggcguagagggggagggacuccacaaacuugguuauauccugcgggacauuagcaaaaucccgggcgggaauauguacgcugaugacacggccggaugggauaccagaauuacugaagacgauuuacagaacgaggcuaagaucacagacauaauggaaccugagcaugcccuguuggcaaaguccaucuuuaaacucaccuaucagaauaagguugugaggguccaacgcccagcgaaaaacggcacugugauggaugugauuaguagacgggaccagagggguucugggcaggucggaacauacggccugaauaccuucacaaacauggaagcccagcuaauccgucaaauggagagcgagggcauauuuucccccucagaacuugagacuccuaaccuggcugggcgaguucucgauuggcuggaaaagcacggaguggagcgcuugaaaagaauggccaucaguggugacgacuguguagugaagccaauagaugaccgguucgcaaccgcuuuaacggcccugaaugauaugggcaaggucaggaaagacgugccccagugggaaccgucuaagggguggaacgauuggcagcagguuccuuuuugcagccaucacuuccaccaacucauuaugaaagacggacgcgagaucgugguccccuguagaaaucaggaugagcuugugggccgggcaaggguaucccagggugccggguggucacugcgagaaaccgcgugccuaggaaagagcuaugcucagauguggcaacugauguacuuucaucguagagaccuccgcuuggccgcaaacgccaucuguucugcuguuccaguggauugggucccuacaucccggacuaccuggaguauucacgcccaucaccaguggaugacaacugaggacaugcugagcguguggaauaggguuuggauagaagagaaccccuggauggaagauaaaacccauaucucguccuggggcgacgugccauaucuuggcaagagagaggaccaguggugcgggucucugauuggacucacggcacgcgcuacaugggccaccaauauccaagucgcgauuaaccaggugcggagguuaaucgguaaugagaacuaccuggauuacaugacuucaaugaagcgauucaaaaaugaaagcgaccccgagggcgcuuugugguga

SEQ ID NO: 13688 - RNA, 9879 nt, Artificial Sequence
  derived and/or modified CDS sequence (opt3) from DENV-1__FJ410251__SS-prME
agcgugaccaugcugcucaugcuuaugcccaccgcccuggcuuuccacuugacuacgaggggcggggagccucauaugaucguaaccaagcaggaaaggggaaaauccuuacuguuuaagacaucugccgguguuaauaugugcacucugauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcugggggcaaagcccugaagcucuccugguucaagaaaggaucaaguaucggcaagauguuugaagcaacugccagaggggcuaggcggauggccauucugggagauaccgcaugggacuucgguagcgugggcgggguuuuuacauccgugggaaaacuuguccaucagaucuucggcacggcguacggugugcuguuuucugggguaagcuggaccaugaagauuggcauaggaguguugcucacuuggcugggcuuaaauucacgaaguacaucccugagcaugaccuguaucgcuguugggcuagucacacucuaccugggagugauggugcaggccgauucuggcugcgucauuaacuggaaaggucgcgagcuuaagugugggucaggaaucuucguuacuaaugaagugcacaccuggacggagcaauauaaguuucaggcagacaguccgaaaagauugagcgccgcuaucggcaaggccugggaagagggugugugcggcauuagguccgcaacacggcuggagaacauaauguggaaacagaucucuaacgaacucaaucauauucuguuagagaacgacaugaaguucaccguagucgugggggauguugugggaauccuggcucagggcaaaaagaugauucgcccucaacccauggaacacaaauacucguggaaaagcugggggaaggccaagaucauaggagcggacguccagaauacuaccuuuaucauugauggcccaaacacaccugagugucccgacgaucagagagccuggaauaucugggaaguggaggacuaugguuucgggauuuuuacuaccaacaucuggcuuaaguugagggauuccuacacacagguuugcgaccaccgucucaugucagcugcaauaaaagauaguaaggccgugcaugcugacaugggauauuggauugagucugagaaaaaugagacguggaagcuggcccgggcauccuucaucgaaguaaagaccuguauuuggccaaaaucccacacucuauggucaaacggcguccuggagagcgaaaugaucauacccaagaucuacgguggcccuauuucucaacauaauuaucgaccaggguacuucacacagaccgcgggaccguggcaccucggcaaacuggagcuugauuuugacuugugcgaggggacuacagugguggucgaugaacacugcggaaacagaggccccucccugaggaccacgacuguuaccgguaagaucauucaugagugguguugccgcaguuguacauuaccuccacuccgguucaaaggggaagacggaugcugguacggcauggagaucagacccgugaaggagaaggaagagaaucugguaaaaagcauggugucugccgguuccggcgaagucgacucauuuagucuugggcuguuguguauaagcauuaugaucgaggaagugaugaggucgcgcuggucccgaaagaugcucaugaccggaacucuggcuguuuuccuacugcucaucaugggccagcugacauggaacgaucuuauucgguugugcaucauggugggggccaaugcaucugaccguaugggaaugggcaccacauaucuggcuuuaauggccacuuuuaaaaugagaccuauguucgcagucggucuccuguuuaggcgccuuaccagccgggaggugcugcuacucacgauugggcugucauugguugccaguguggagcugccaaacuccuuagaagaacucggagauggccuggcuaugggcauaaugauccuuaagcuguugacagacuuccaaucucaccagcucugggcgacccugcuaagccugacuuuuauuaaaaccacacuuucccuccauuacgccuggaagacuauggcaaugguccugucaaucgucagcuuguucccccuguguuuaaguaccacgucucagaagacaaccuggcucccggugcugcuugggucccugggaugcaaaccuuugacuauguuucucauuacagaaaauaagaucugggguagaaaaagcuggccacugaacgagggcauaauggcuguugggguggucucgauccuacugucaucucuucucaagaacgaugugccccuggccggaccuuugauugccggcgguauguuaaucgcuuguuauguaauuaguggguccagcgcagaccugucucucgaaaaagccgcggaggugagcugggaggaagaggcugaacacuccggagccucacauaauauccuggucgagguucaggaugacggcaccaugaagauaaaagaugaagagagggacgauacucuuacaauucuguugaaggcaacccuacuggccgugaguggcguguacccccucagcaucccagcuacgcuguucgucugguauuuuuggcaaaagaaaaagcagcgaucuggggugcuuugggacacuccuucacccccagagguugaacgcgcaguauuagaugacggaaucuaccggauuaugcagagaggucugcucggcaggagccaggugggggucggaguguuccaagagaacguuuuccacaccauguggcacgugacacguggcgccgucuugauguaucaggguaaacgccuggaaccgaguugggcgagcgugaagaaagaccucauauccuacgggggaggcuggcggcugcagggcucuuggaauaccggggaggagguacaggucaucgcuguggaaccuggaaagaaccccaagaauguucaaacagccccagguacuuuuaaaacccccgagggcgaagugggggcaauugcccuugauuucaagccuggaacgucgggcagcccaaucgucaacagagaggguaaaauuguggggcuguacggaaauggcguugugacaacuucaggcaccuaugucuccgcuaucgcccaggcaaaggcuagucaggaagggcccuugccugagauagaggacgaaguguuuaggaaacgaaaccuaacaaucauggaucugcauccgggaucugguaagacccggcgcuaccucccagccauuguaagagaggcgaucaagaggaaauuacggacucugauucuugcccccacccgagugguugcaagcgaaauggcugaggcccugaagggcaugccuaucagauaucaaacaacggcugucaaauccgaacacacugggaaggagauaguggaccucaugugccaugcaaccuucacaaugcgcuugcugucaccagugaggguccccaauuacaacaugauuaucauggaugaggcccacuuuaccgacccuucuagcaucgccgcucguggauauauuaguacucggguaggcaugggugaagcggcagccaucuucaugacagcuaccccgcccggguccguggaggccuuuccacagagcaaugcaguuauacaggaugaagagagagacauuccugaaaggucuuggaacucaggauacgaguggaucacggauuuccccggcaaaacugugugguuugucccauccauuaagaguggcaaugacaucgccaacugucuccgcaagaaugggaaacgagugauacagcugagcagaaagacauucgauaccgaguaucagaaaaccaagaacaacgacugggacuacguugugacuacagauauuucggaaaugggagcuaauuuucgggcggacagggucaucgauccucgccguugccuuaaacccgugauccuaaaggacgguccagagagaguaauucuggccggcccgaugccugugaccguugcaucugcugcccagcggagggggcgcaucggacgaaaccauaauaaggaaggcgaucaguacauuuauaugggucagcccuugaacaaugacgaggaucacgcacacuggacagaggccaaaauguuacuggacaacauaaauacuccagaagggaucauucccgcucucuucgagccugaaagagagaaguccgccgcgaucgauggcgaauaccggcugaggggagaggcacgcaaaacguucgucgagcuuaugagaaggggcgaccugccaguguggcucagcuauaagguggccucagaaggguuucaauacagugaucggcguuggugcuucgacggagagcgcaacaaucaggucuuggaagagaacauggauguugaaaucuggaccaaagagggugagcgaaagaaacugagacccagguggcuagacgcucggacauauucugacccucuggcccuccgcgaauuuaaggaguucgcugcaggcagaagguccgugagcggggaucuuauucuggaaauaggaaaguuaccgcagcauuugacucagcgggcccaaaaugcucuggacaaccucguaaugcugcacaauucagagcagggcggucgagccuacagacaugcaauggaggaacuuccagauaccaucgagacacugaugcucuuggcgcugauugccguguuaaccgggggcgucacucuauuuuuccugaguggacgcggccucgggaaaacgagcaucggacuucugugugugauggcuuccucuguuuugcuguggauggccagcguggaaccccacuggauugcagcuuccaucauacucgaguuuuuccugaugguccuucucaucccugaacccgacaggcagcggaccccacaggauaaccaacuggccuauguagugauugguuugcuguuuaugaucuuaacaguugcagccaaugagaugggccuacuggagacuaccaagaaagaccucgggauuggacacguggcugucgaaaaccaucaccaugcgacaaugcuugauguggaccugcacccugccucagcauggaccuuguacgcugucgccacuacaaucauaacgcccaugaugcgucauaccauugagaacacuacagccaauaucucucugaccgcaauugcuaaccaggccgcgauccucaugggccuggauaaggguuggccaauaaguaaaauggacaucggggugccucuuuuagcucugggcugcuacucgcagguuaauccgcucaccuugacagccgcagugcugaugcuaguagcccacuaugcuauuaucggacccggccugcaagcaaaggccacuagagaagcgcagaagaggacggcugccgggauuaugaaaaacccaaccguggauggaaucgucgcaauagaccucgauccuguuguguacgacgccaaguucgagaaacagcuuggccagauuaugcuguugauccuguguacaagccaaauccuccugaugcgcacuaccugggcuuuaugcgaauccauuacacuugccaccgguccccugacuacgcucugggaggggucuccaggaaaguuuuggaauacaaccaucgcagucucaauggcuaacauauuccggggcagcuaucuagccggugcgggccuggccuuuuccuugaugaaaagucuagggggaggccgaagagggacuggagcacagggcgagacccucggugaaaaguggaagaggcagcuuaaucagcugucuaaaagcgaguucaacauuuacaagcgcucagggaucauggaaguggaccgguccgaggcuaaagaaggauugaagagaggcgagacaacucgucacgccguaaguagggguaccgcaaaacugcggugguucguggagcgcaaucucguuaagccugaaggcaaggugauugauuuaggguguggacgaggcggguggagcuauuacugcgcuggacugaaaaaggucacagaggugaaaggcuauacgaagggugggcccggacaugaggagccgaucccaauggccaccuacggcuggaaccuugucaaacugcacucuggcaaggacguguuuuucacuccucccgaaaaaugugauacacuacucugcgacauaggggaguccucaccaaaucccaccaucgaggaaggaagaacucugaggguuuugaagaugguagagccuuggcugcgggguaaccaauuuuguauuaagauccucaauccguacaugcccagcguggucgaaacacuugagcagaugcagcgcaaacauggcgggaugcuggugagaaacccauuaucgagaaauucuacccacgagauguauuggguuaguugcggaacgggcaacauuguguccgccgucaauaugaccagccgaaugcuguugaaccgguucacaauggcgcaccguaagccuacuuacgaaagagauguggaccucggugcugggacccgccauguagcaguggagcccgaaguugccaaccuggauaucauuggacagaggaucgagaauauaaaacacgaacauaagucaacauggcacuaugacgaggauaacccuuacaaaacuugggcuuaucauggcuccuacgaggucaagccaucuggcagcgccaguuccauggugaaugggguggucaagcuacuuaccaaacccugggacguuauuccuauggugacacaaaucgcaaugaccgauacuacgccauuuggacagcagcggguauucaaggaaaaaguggacacaagaacccccaaggccaaacgcgguacugcucaaaucauggaggucaccgcgagguggcuguggggcuuucucagccgaaacaagaagccgcggauuuguacaagagaagaguucacgaggaaagugcgcucuaaugccgcaauaggggcuguuuuuguggacgaaaaccaguggaacucagccaaggaggcagucgaggaugaacguuucugggaccuggugcagaaagagcgggaauugcacaagcagggaaaaugcgcaaccugcguauauaacaugaugggcaagagagagaagaaacugggugaauuugggaaggcuaaaggaaguagggccaucugguacauguggcucggcgcgcgcuuccuugaguuugaggcacugggcuucaugaaugaagaucacugguucucccgagagaacagcuuaucugggguugaaggagagggucugcauaaguugggcuacauucuccgggacaucucgaaaauuccugggggaaauauguaugccgaugacacugcuggcugggauacaagaaucaccgaggacgaucugcaaaacgaagccaagauaacugacaucauggagccagaacacgcacuacuugcuacaucaauuuuuaaacugaccuaccagaauaagguggucagggugcagcgccccgccaagaacgguacagugauggaugucaucagcagacgggaccagaggggguccggacaaguuggcacuuauggccucaauaccuucacgaacauggaggcucagcugauucgucagauggaaagugaggggaucuuuuugccuucugaguuagaaaccccaaaccuggccgagcgagugcucgauuggcuugaaaaauacggaguagagcgccugaagagaauggcaauaagcggugacgacuguguggucaaacccauugaugaccgguucgcgacagcccuaacugcucugaaugauaugggcaaggugaggaaagacaucccgcagugggaaccuuccaagggguggaacgauuggcaacagguucccuuuugcucacaucacuuccaccagcucaucaugaaggacggacgcgagauuguggucccauguagaaaucaggaugaguuggugggccgggccaggguaagucaaggugcaggguggucucugcgagaaaccgcuugccuuggaaaaagcuaugcccagauguggcagcugauguacuuucaucguagagaccuccgcuuagcagccaacgcgauauguuccgcuguuccuguggauuggguccccacaucacggacuaccuggagcauccacgcccaucaccaauggaugacgacagaggacaugcugucuguguggaauaggguuuggauugaagagaacccauggauggaagauaagacccauguguccaguuggggcgacguccccuauuugggcaaaagagaggaccaguggugcgggagccugaucggacucacugcacgcgccacaugggcuucgaauauucagguggccaucaaccagguacggaggcuuauagguaaugagaacuaccuggauuacaugaccuccaugaagcgauucaaaaaugaaggcgacccugagggggcacuaugguga

SEQ ID NO: 13689 - RNA, 9879 nt, Artificial Sequence
  derived and/or modified CDS sequence (opt3) from DENV-1__FJ410252__SS-prME
agcgugaccaugcugcucaugcuuaugcccacagcacuggcuuuccacuugacuacgagaggaggggaaccucauaugaucgucuccaagcaggaaagggggaaaucuuuacuguuuaagaccucagccgguguuaacaugugcacacugauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguuccguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacacugguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuagcaccgagauccagcugacagacuacggggcccucacccuugauuguucuccaaggacuggacuggacuucaacgaaauggucuugcuaacaaugaaggagaaauccuggcuggugcauaagcagugguuucucgaucugccgcuucccuggacgucaggcgcaagcaccagucaagagacuuggaaucggcaggaccuguugguaacauucaaaaccgcucacgccaagaagcaggaaguugugguccucgguucucaagagggggcuaugcacacagcccugacuggcgcaaccgaaauccagacguccggaaccacaacuauuuuugccggccauuuaaaaugccgucugaagauggauaaacuaacccucaaggggaugagcuaugugauguguacaggaucguucaaacuggagaaggaagucgcugagacucagcacgguaccgugcuuguucagauaaaguacgagggcacggacgcgccuugcaaaaucccauucuugacacaagaugaaaagggggugacccagaacggacgccugauuacugcaaaucccaucguaacagacaaagagaagccugucaacauagaagccgagccacccuuuggcgagucuuauauugugaucggugcuggggaaaaagcccucaagcuguccugguucaagaaaggcucaaguaucggaaagauguuugaggcaaccgccagaggcgcuaggcggauggccauucuuggggauacugcaugggacuucggaagcaucgguggcguuuuuaccuccguggggaaacugguccaucagauuuucggaacagcguacggcguguuguuuucugguguaagcuggacgaugaagauagggaucggcgugcuccugaccugguuaggacuaaauucacgaaguacuucccuaagcaugacauguauugcuguuggccucgucacccuguaccuuggggugauggugcaggccgauucuggaugcgucaucaacuggaaaggccgcgaauugaagugugguucagggaucuucguuacaaaugaggugcacacuuggaccgaacaauauaaguuucaggcagacaguccgaaaagacugagcgccgcuauuggaaaggccugggaggagggcgugugcgguauaagguccgcaacgcggcucgaaaacaucauguggaaacagauuucuaacgagcugaaucauaucuuacuggaaaacgacaugaaguucacaguagucgugggcgauguugcugggauucuugcccagggcaagaagaugauccgcccucaacccauggaguacaaauauucguggaaaagcuggggcaaggcgaagauaaucggggccgacgugcagaauaccacuuuuauuaucgauggaccaaacaccccugaaugucccgacgaucagagagcuuggaauauuugggaggucgaggacuacggcuucgguaucuuuacaacuaacauaugguugaagcucagggauuccuauacccaggugugcgacuaccgucugaugucagcagccauuaaagauaguaaggcuguucacgccgacaugggguauuggaucgaaucugagaaaaaugaaacauggaagcuagcacgggcgagcuucauugaggugaagacguguaucuggccaaaaucccacacccuguggucaaacggaguacucgaaagcgagaugauaauccccaagauuuacggcgguccuaucucucaacauaauuaccgaccaggcuauuucacucagacagccgggccguggcaccugggaaaacuugaguuggauuuugaccugugcgaaggcaccacugucgugguggaugagcauugcgggaacagaggacccuccuuaaggacaaccacggucacuggcaagauuauccacgaaugguguugccgcaguuguacccucccuccacugcgguucaaaggugaggacgggugcugguacggaauggagauaagacccguuaaggaaaaggaggaaaaucuugugaaaagcaugguaucugcuggcuccggugagguggacucauuuagucugggcuugcucuguauuagcaucaugaucgaagaggucaugaggucgcgcuggucccgaaagaugcugaugacagggacccuagccguguucuuucugcucauuaugggacagcugacuuggaacgaucuuauccgguugugcauuaugguuggcgcaaaugcuucugaccguauggggaugggaacaaccuaucuggccuuaauggcaacauucaaaaugagaccuauguuugccgugggccuccuguucaggcgccuuacuagccgggagguccugcuacucaccauaggucugucauugguggcuaguguugaacugccaaacuccuuagaggaacucggggauggacuggcgaugggcaucaugauucuuaagcuguugacggacuuucaaucucaccagcucugggccacacugcuaagccugaccuucaucaaaacuaccuuuucccuucauuacgcauggaagacaauggcuauggugcucucaauugucagccuguuccccuugugucugaguacuaccucucagaagacgacaugguuaccgguacuccugggcucccuugggugcaaaccucugaccauguuuuugaucgccgagaauaagauauggggaagaaaaagcuggccacucaacgaagguaucauggccgugggcauuguuucgauccugcuaucaucucugcuuaagaacgaugugccccucgcugggccucugauugcaggaggcauguugaucgccuguuaugucauaagugguuccagcgcggacuuaucucuggagaaagcugccgaggugagcugggaagaggaagcagagcacuccggggccucacauaauauucucguagaagugcaggaugacggaacuaugaagaucaaagaugaggagagggacgauacacugaccauccuucugaaggcuacuuugcuagcagucaguggcguuuacccccugagcauuccagccacacucuucgugugguauuucuggcaaaagaaaaagcagcgaucuggcgugcugugggacaccccuucacccccagaagucgagcgcgcggugcuugaugacgggauauaccggaucaugcagagaggauuacuggguaggagccagguuggcguagggguguuucaagaaaacgucuuccacacgauguggcaugugacucguggagcuguucucauguaccagggcaaacgcuuggagccgaguugggccagcgugaagaaagaccugauuuccuauggugggggauggcggcuccagggcucuuggaauaccggcgaggaaguccaggugaucgcaguagagccugggaagaaccccaagaauguccaaacagccccaggaaccuuuaaaacaucggaaggugaggugggcgcuauugcccuggauuucaagcccgggacuagcggaucaccuaucguuaacagagaaggcaaaauagugggucuuuacgggaauggagucgugaccacguccggcacauauguuagugcaaucgcucaggccaaggcgucucaggagggcccacugcccgagauugaagacgagguguuuaggaaacgaaacuugacuaucauggaucuacacccugggagcggaaagacccggcgcuaccugccggccauugucagagaagcaaucaagaggaaacuccggacauuaauacuggcuccaacccgagugguagccuccgagauggcugaagcacuuaaggguaugcccauuagauaucaaacuaccgccgugaaaucagagcacacaggcaaggagaucguugaccugaugugccaugccacguucacuaugcgccucuugucuccugucagggugccaaauuacaacaugaucauuauggaugaagcucacuuuaccgaccccagcaguaucgcggcacguggguauauauccacacgggugggaaugggcgaggccgcugccauuuucaugaccgcaacuccuccggguagcgucgaagccuuuccccagucuaaugcuguaauccaggaugaggaaagagacauuccagagaggucauggaacuccggguacgaguggaucacagauuucccuggaaaaaccgugugguuuguucccaguauaaagagcggcaaugacauugcgaacugucugcgcaagaauggcaaacgagugauccagcucucgagaaagacguucgauacugaauaccagaagacaaagaacaacgacugggacuaugucgugaccaccgauaucucugagaugggggccaauuuccgggcagacaggguuauugauccacgccguugccugaaaccugugauccuuaaggacggacccgaaagagucauucuagcugguccaaugccggugacuguagccuccgcagcccagcggaggggccgcauagggcgaaaccauaauaaggagggagaucaguacaucuauaugggccagccucugaacaaugacgaggaucacgcucauuggacagaagccaaaauguuguuagacaacauuaauacccccgaggguaucaucccagcgcuguuugaacccgagagagaaaagagcgcagccauugauggggaguaccggcucaggggcgaggcucgcaaaacauucguggaacugaugagaaggggagaccuuccuguuuggcugucauauaaggucgccagugagggcuuucaauacucugaucggcguuggugcuucgacggggaacgcaacaaucaggugcucgaggaaaacauggauguggagauauggacuaaagagggagaacgaaagaaauugagaccaagguggcuggacgcucggacguauuccgacccccuagcacugcgcgaguuuaaggaguucgccgcugguagaaggagcgucucaggcgaucucauccuugagauugggaagcugccucagcacuuaacccagcgggcccaaaaugcauuggacaaccugguuaugcuccacaauagugaacagggaggccgagcguacagacaugccauggaggagcugccggauacaaucgaaacucuuaugcugcucgcuuugauugccgugcugaccggugggguaacauuauuuuuccuaagcggccgcggacugggcaaaaccuccaucgggcuccuuugugugauggcaucuagcguccuguuguggauggcuuccguggagccacacuggauagccgcaucaaucauucuggaauuuuuccucaugguucugcuuauccccgagccugacaggcagcggacuccccaggauaaccaacucgccuacguggucauuggacuguuguuuaugauccugacgguagcugcgaaugagauggguuuacuagaaaccacaaagaaagaccugggcauagggcauguggccguugagaaccaccaccaugcagcuaugcucgauguggaccuucacccagccucugccuggacucuguaugcagucgcuaccacaauuaucaccccuaugaugcgucauacuauugaaaacacaacggccaauaucaguuugaccgcgauagcuaaccaggccgcaauccugaugggacucgauaagggcuggcccauuucgaaaauggacaucggugugccacugcuugccuuagggugcuacagccaggucaauccucugacucucacagcugcaguguugaugcugguugcccacuaugcgauuaucggcccgggacuacaagcuaaggccaccagagaggcacagaagaggaccgccgcuggcauaaugaaaaaccccacaguggaugggauuguagccaucgaccuggauccaguggucuacgacgcaaaguucgaaaaacagcucggacagaucaugcuucugauuuuguguacuucccaaauccugcucaugcgcacgaccugggcucugugcgagucuauaacauuagccacuggcccucuuaccacacugugggaggguucacccgggaaguuuuggaauaccacuauugcgguuagcauggccaacaucuuccggggauccuaucucgcaggcgcuggucuagccuucagucugaugaaaucuuugggcgggggacgaagaggcacgggggcacagggagaaacacugggcgagaaguggaagaggcagcucaaucagcuuagcaaaucagaauuuaacaccuacaagcgcuccgguauuauggagguggaccggagugaagcuaaagaggggcugaagagaggagagacuaccaaacaugccgucagccguggcacagccaaguugaggugguucguggaacggaaucugguaaagccagaggguaaagugaucgaucucggcugugggcgcggaggcuggucuuauuacugcgcgggguuaaagaaaguuacugaagugaagggauacaccaaaggcgguccugggcacgaggaacccauaccgauggcuacauauggauggaaccuggucaaacuucacuccggcaaagacguguuuuucaucccaccugagaagugugauacgcugcuaugcgacauuggcgagucaagccccaauccaaccaucgaagaggggcgaacucucagaguccugaagaugguggaacccugguugaggggaaaccaauuuuguauuaaaauccugaauccuuacaugccgucgguuguagagacacucgagcagaugcagcggaagcaugguggcaugcuugugcgcaacccccugucuagaaauaguacccacgaaauguauugggucuccugcgggacuggaaacauugugagcgcaguuaauaugacaucaaggauguuacugaaccgauucaccauggcccaucggaaaccaacguacgagcgugauguggacuugggcgcugguaccagacacgucgccguggaaccugagguagcaaaccucgauaucauagggcagcgcauugaaaauaucaagcacgagcauaaauccacauggcacuaugacgaggauaaccccuacaagacuugggccuaucauggaucuuacgaagugaagccuagcggcagugcuuccagcaugguuaauggcgucgugaaacugcuaaccaagccaugggacgugauccccauggucacacaaauugcgaugacugauaccacaccuuuugggcagcagaggguuuucaaagagaagguggacacccggacuccaaaagccaagagaggaacggcacaaauaauggaaguaacagcuaaguggcuuugggguuuucugucucgcaacaaaaagcccaggaucuguacccgagaggaguucacucggaaagugagaucaaaugccgcaauuggcgccgucuuuguggacgagaaccaguggaauagugcuaaggaggccguugaagaugagagguucugggaccucgugcaccgcgaacgugagcugcauaaacaggggaagugcgcgaccugcgucuacaacaugaugggaaagcgggagaaaaaguugggcgaguuugguaaagcaaagggguccagagccaucugguauauguggcugggagcuagguuccucgaguucgaagcccuuggcuuuaugaaugaggaucacugguucagccgcgaaaacucucugucgggcguggagggggagggauuacacaaacuggguuacauuuugcgagacaucucaaagauaccgggcgggaauauguaugcagaugacacagcuggaugggauacgcggaucaccgaagacgaucuccagaacgaggccaaaauuacugacaucauggaaccugagcaugcucugcuagccaagagcauuuuuaaacuuacauaccaaaauaaaguaguuagagugcagaggccagcaaagaacggcaccgucauggaugugaucucccgcagagaccagcgggguaguggacaggugggaacuuauggccugaauacauucaccaacauggaagcgcaacucauaaggcagauggagucugagggcauuuuuagccccuccgaacuggagacaccuaacuuggccgggcgugucuuagauuggcuggaaaaacacggaguugagcgacucaagcgcauggcuaucucaggugacgacugugugguaaaaccaaucgaugacagauucgccacugcacuuaccgcucugaaugauaugggcaaggugcggaaggacauuccccagugggaaccgaguaaaggguggaacgauuggcagcaagucccuuuuugcucucaucacuuccaccagcuaauaaugaaggacggaagggagaucgugguucccugucgcaaucaggaugagcuggugggcagagcccgggucagccagggugcaggguggucccucagggaaacggccugcuugggaaaaucauacgcgcaaauguggcagcugauguauuuucaucgacgugaccuuagacuggcugccaacgcaauuuguagcgccgugccaguagauuggguuccuaccucucgcacaacuugguccauccacgcucaucaccaguggaugaccacagaggacaugcucaguguguggaaucgggucuggauugaagagaaccccuggauggaagauaagacucauaucagcucguggggcgacgugccauacuuaggcaaaagggaggaccaauggugcgggucccugauaggauugaccgccagagcaacgugggcuacaaauauccagguugccauuaaccaggugcgccggcugaucgguaaugagaacuaccucgauuauaugaccucuaugaagagguucaagaaugaaucagaccccgagggcgcgcuuugguga

SEQ ID NO: 13690 - RNA, 9879 nt, Artificial Sequence
  derived and/or modified CDS sequence (opt3) from DENV-1__FJ461331__SS-prME
agcgugaccaugcugcucaugcuuaugcccacugcacuggcuuuccacuugacuacgagaggaggggagccucauaugaucgucuccaagcaggaaaggggaaaaucuuuacuguuuaagaccucagccgguguuaacaugugcacauuaauugccauggaccucggagagcugugugaagauacuaugaccuacaaaugcccacggauuacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaggaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuauucaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaagcugaccgugguagucggcgauguggcugggauccuuggacagggcaaaaagaugauacgcccucaacccauggaguacaaauauucguggaaaagcugggggaaggccaaaaucauuggagcggacgcccagaauacuaccuucaucauugauggcccaaacacaccugaaugucccgacgaucagagagcuuggaauaucugggagguugaggacuacgguuuugggauauucacuaccaacauuugguugaagcucagggauuccuauacacaggugugcgaccaccgucugaugucagcagccaucaaagauaguaaggcuguccacgccgacaugggauacuggauugaaucugagaaaaaugaaacguggaagcuagcacgggcgagcuuuaucgaggugaagaccuguauauggccaaaaucccauacucuguggucaaacggcguucucgaaagcgagaugaucauucccaagaucuaugguggcccuauuucucaacacaauuaccgaccaggguacuucacacagaccgccggaccguggcaucugggcaaacuugaguuggauuucgaccugugcgaagggacuacagugguagucgaugagcacugcggaaacagaggccccuccuuaaggaccacgacugugaccgguaagaucauacacgaaugguguugccgcaguuguacacucccuccacugcgguuuagaggggaggacggaugcugguauggcauggagauuaggcccgugaaagaaaaggaggaaaaucuugucaagagcaugguuucugcugguuccggcgagguggacucauucagucugggguugcucuguaucagcaucaugauugaagagguaaugcgcucgcgauggucccggaaaaugcugaugaccggaacucuagccguguuuuuccugcucaucaugggccagcugacauggaacgaucuuauucguuugugcauaauggucggggcaaaugcuuuugacagaaugggaaugggcaccacauaccuggccuuaauggcaacuuucaagaugaggccuauguuugccgugggucuccuguuccgccggcuuaccucuagagagguucugcuacucacgaucgggcugagcuugguggcuucagucgaacugccaaacaguuuagaggaacucggagauggccuggcgaugggcauuaugauccuuaaacuguugacagacuuucaaucccaucagcucugggccacccugcuaucucugacuuucauuaagaccacauuuagccuucacuaugcauggaaaacuauggcuauggugcucuccaucguuucacuguuccccuugugucugagcaccacgagucagaagacaaccugguuaccggugcuccuggggucucuuggaugcaagccucugacuauguuuuugauagccgagaauaaaaucugggguaggaaguccuggccacucaacgaaggcauuauggccgucgggaucguaagcauucugcuaucgucacugcuuaaaaacgaugugccccucgcuggaccucugaucgcaggcgguauguugauagccuguuacguuauuucugggaguuccgcggacuuaagccuggagaaggcugccgaggugucuugggaagaggaagcagagcauagcggagccucccacaauauccucgucgaagugcaggaugacggcacaaugaaaaucaaggaugaggagcgagacgauacccugacuauucuucugaaagcuacauugcuagcaguaucaggcguguauccccugaguauaccagccacccucuucgucugguacuucuggcaaaagaagaaacagcgcagcgggguucugugggacacgccuucucccccagugguggaacgggcgguccuugaugacggaaucuauagaauuaugcagagggguuuacugggccguucccagguggggguuggaguauuucaagagaacguguuccauacuauguggcacgucacccgcggcgcugugcucauguaccaggguaagcgguuggaaccgucaugggccaguguuaaaaaggaccugaucagcuacgggggaggcuggagacucaggggcuccuggaauacaggggaggaggugcaggucauugcaguggaaccuggcaaaaaucccaagaauguacagaccgccccagguacauuuaagacucccgagggcgaagucggggcuaucgcccuggauuucaaaccuggaaccucuggcucgccaauagugaaccgagaggguaagaucguugggcuuuauggaaauggcguggucacgacaagcggcacuuacgugucagcaauugcucaagccaaagcgucccaggaagggccccugccugagaucgaggacgaaguuuuucggaagcgcaacuugaccauuauggaucuacacccgggaagugguaaaacaagaagguaucugccagccaucgugcgggaggcaauaaagcgaaagcucagaaccuuaauucuggcucccacucgcgucguggccucugaaauggcugaggcacuuaaaggcaugccuaucagguaccagaccacagccguaaagagcgaacauacggggaaagagaucguggaccugaugugccacgccacuuucaccaugcgucucuuguccccaguucggguccccaauuauaacaugauuaucauggaugaggcucauuuuacagacccuucaucuauagcggcaagaggauacauuagcaccagggugggcaugggugaagccgcugccaucuucaugacugcaacaccgcccgggaguguggaggccuuuccacaauccaaugcugucauucaggaugaggaacgcgacaucccugaacgaagcuggaacucuggacacgaguggauaaccgauuuccccggcaagacgguaugguuugugccaucaauuaaauccggcaaugacaucgcgaacugucugagaaagaaugggaagcggguuauccagcucaguaggaaaacuuucgauacagaguaucagaagaccaaaaacaacgacugggacuacguggucaccacugauauuagcgaaaugggagccaauuuccgcgcagaccgugugaucgauccuagacggugccugaagcccguuauucuuaaagacgguccagagagggugauacuagcuggcccgaugccugucacaguggccucggcagcccaacgccgagggagaaucggacggaaccauaauaaggaaggcgaucaguacauuuauaugggucagccccugaacaaugacgaggaucacgcucacuggaccgaggccaagauguuguuagacaacaucaauacaccagaagggaucauucccgcgcuguuugagccugaaagggagaaaucugcagccguagauggcgaauaccgccucagaggagaggcuaggaagacuuucguggagcugaugcggcguggcgaccuuccaguuuggcuguccuauaaagucgccagcgaaggguuucaguacucagaucgccgauggugcuucgacggagagagaaacaaucaagugcucgaagagaacauggauguggaaauauggacgaaggagggugagaggaaaaaguugcggccccgcuggcuggacgcuagaaccuauagugacccucuagcacugagggaauuuaaagaguucgccgcuggccggcgaucugucuccggggaucucauccuugaaauuggaaagcugccgcagcauuuaacacagagagcccagaaugcauuggacaaccugguuaugcuccacaauagcgagcaaggcggucgcgcguacaggcaugccauggaggaacugccagauacuaucgagacccuuaugcugcucgcuuugauugccgugcugacagggggcguaaccuuauuuuuccuaucaggacggggccuggggaagacaaguaucggacuccuuugugugauggcaagcuccguccuguuguggauggcuucuguggaaccccacuggauagccgcaagcaucauucuggaguuuuuccucaugguucugcuuaucccugaacccgaccgucagagaacgccacaggauaaccagcucgccuauguggucauuggucuguuguuuaugauccugaccguagcugcgaaugagaugggcuuacuagagacaacuaaaaaggaccuggggauaggacacguggccguugaaaaccaucaccaugcagcuaugcucgauguggaccuucacccugccuccgccuggacccuguacgcagucgcuacaaccauuaucacucccaugaugaggcauacaauugagaacacgaccgccaauaucucauugacugcgauagcuaaccaagccgcaauccugaugggccucgauaaagguuggccaauuucuaagauggacaucggggugccucugcuugccuuaggcugcuacagucaggucaauccgcugacacucaccgcugcaguguugaugcugguugcccacuaugcgauuaucggacccggccuacaggcuaaagccacccgcgaagcacaaaagcggacagccgcugggauaaugaagaacccaacuguggauggaauuguagccaucgaccuggauccuguggucuacgacgcaaaauucgagaagcagcucggccagaucaugcuucugauuuuguguacgucgcagauccugcucaugcgaaccacaugggcucugugcgaaagcauaacuuuagccaccgguccccuuacaacccugugggagggguccccaggaaaauuuuggaauacuacgauugcgguuucuauggccaacaucuucagaggcucauaucucgcaggagcuggccuagccuucagccugaugaagucccuaggggguggcaggcgcgggacaggagcacaaggcgagacccugggugaaaaauggaagcggcagcucaaucagcuuaguaagucugaguuuaacacuuacaaaagaagcgggauuauggaaguggaccguucagaggcuaaggaaggacugaaaaggggcgagaccacaaagcacgccgucucccgggguacugccaaauugcgcugguucguggagcgaaaucugguaaagccugaaggcaaggugaucgaucucggguguggaagaggcggguggaguuauuacugcgcgggacuaaagaagguuaccgaggugaaaggcuauacaaagggugggcccggacaugaggaaccgauaccaauggcuacguacggcuggaaccuggucaaacuucacagcggcaaggacguguuuuucaucccucccgaaaaaugugauacccugcuaugcgacauuggggagucuuccccaaaucccacuaucgaggaaggaaggacacuccggguccugaagaugguggagccuugguugcgcgguaaccaguuuuguauuaagauccugaauccguacaugcccucaguuguagaaacccucgagcaaaugcagagaaaacauggcgggaugcuugugaggaacccacugagccgaaauucgacucacgagauguauugggucucuugcggaacaggcaacauugugagugcaguuaauaugaccucccggauguuacugaaccguuucacgauggcccacagaaagccuaccuacgaacgcgauguggacuuggguacagggacuaggcaugucgcuguggagcccgaaguagccaaccucgauaucauaggacagcggauugagaauaucaaacacgaacauaagagcaccuggcacuaugacgaggauaacccuuacaaaacaugggcauaucauggcucauacgaggugaagccauccggcucugccagcaguaugguuaauggggucgugaagcugcuaacuaaacccugggacgugaucccuauggucacccagauugcuaugacagauaccacuccauuuggacaacagagaguuuucaaggaaaaaguggacacgcgcacacccaaggcgaaaagggguaccgcccagauaauggagguaacugcacgauggcuuuggggcuuucugucccggaacaagaagccgagaaucuguaccagggaagaguucacacgcaaagugcguagcaaugcugccauuggggcagucuuuguggacgaaaaccaauggaacucugccaaggaggcuguugaggaugaacgguucugggaccucgugcacagagagagggaacugcacaaacagggaaagugcgccacgugcgucuauaacaugaugggcaaacgcgagaagaaguugggugaauuugggaaagcgaagggaucacgagcaaucugguacauguggcugggcgcccgguuccucgaguucgaggcucuuggcuuuaugaaugaagaucauugguucaguagagagaacucccugagcgggguggaaggagaggguuuacacaaacugggcuacauuuugagggacaucucuaagauaccugggggaaauauguaugccgaugacaccgcaggcugggauacucgcaucacagaggacgaucuccagaacgaagcuaaaauuaccgacaucauggagccagaacaugcccugcuagcuaaggccauuuuuaaacuuacuuaccagaauaagguaguuagagugcaacggcccgcaaagaacgguacagucauggaugugaucucgaggcgugaccagcgagggucaggacaggugggcaccuauggccugaauacauucacuaacauggaggcgcagcucauacgccaaauggaaagcgaggggauauuuuccccuagugagcuggaaaccccaaacuuggccgagagagcuuuagauuggcuggaaaaauacggagucgagcggcucaagaggauggccaucucuggugacgacuguguugugaaacccaucgaugaccgcuucgcaacggcucuuaccgcccugaaugauaugggcaagguaagaaaagacauuccgcagugggaaccuagcaagggguggaacgauuggcaacaggugcccuuuugcucccaccacuuccaucaacuaauaaugaaggacggacgggagaucgucgugccauguaggaaucaggaugagcugguuggccgagcacgugugucacagggugccggguggagucucagagaaacagcgugcuugggaaaaucuuaugcucagauguggcaacugauguacuuucaccgccgggaccuuaggcuggccgcaaacgccauuuguagcgcugucccuguggauuggguacccacuuccagaaccacauggucaauccaugcccaccaucaguggaugacuaccgaggacaugcucagcguuuggaaucgcguguggauugaagagaacccauggauggaagauaagacgcacaucucuuccugggaggacguccccuauuuaggcaaacgggaggaccaguggugcggcagucugauaggguugacagcaagggcuaccugggccacuaauauccaaguggcgauuaaccagguucgaagacugaucggaaaugaaaacuaccucgauuacaugacaagcaugaagcgguucaaaaaugagucggacccugaaggugcucuuugguga

SEQ ID NO: 13691 - RNA, 9879 nt, Artificial Sequence
  derived and/or modified CDS sequence (opt3) from DENV-1__FJ410256__SS-prME
agcgugaccaugcugcucaugcuuaugcccacugcacuggcuuuccacuugacuacgagaggaggggaaccucauaugaucgucuccaagcaggaaagggggaaaucuuuacuguuuaagaccucagccgguguuaauaugugcacccuaauugccauggaccucggcgaguucugugaagauacuaugaccuacaaaugcccacggauaaccgaagcggaaccggacgauguggacuguuggugcaaugcuaccgauacuuggguaacguaugggaccuguagucagacgggagagcaccgccgagacaagcguagcguggcccuggcaccccaugucggccuuggucuggagacuagaaccgaaacauggauguccucugagggggccuggaaacagauccagaagguggaaacuugggcuuugaggcacccuggauuuaccguuauugcacucuuccuggcccaugcuaucggcacaucgauuacccagaagggcaucauauuuauccugcucauguuagugacgccaucaauggccaugcggugcgucgggauuggaagccgcgauuucguggagggucugaguggcgcgacuuggguagacguugugcuugagcacggguccugugucacaaccauggcaaaagauaagcccacuuuggacaucgaacugcuaaaaacagaggugaccaacccugccgugcucagaaagcugugcauugaagcuaaaaucucuaauacgaccacagauaguagguguccaacucaaggagaggccacccuugucgaagaacaggacacaaacuuuguuugccggcgcacuuucguggaucgaggcugggguaauggguguggacuguuuggcaagggcuccuugauaaccugcgcaaaguucaaaugcguaacaaagcucgaggggaaaauugugcaguacgaaaaccugaaguauucagucaucgugaccguucacacuggagaccagcaucaaguggguaaugagaguacggaacacggcacaaccgcuacuauuacaccccaggccccuagcacagagauccaguuaaccgacuacggggcgcugacucucgauuguucuccaagaacaggacuugacuuuaacgaaaugguccuguugacgaugaaagagaaguccuggcuagugcauaaacagugguuccuggaucucccgcugcccuggaccucaggcgccagcacaagccaagagacauggaauaggaaggaccuucugguaaccuuuaagacagcacacgcuaaaaagcaggaaguuguggucuuggguucucaggagggggccaugcacacugcucucaccggcgccacggaaauccaaaccuccggaacaacuaccauuuucgcaggccaucugaaaugccgguuaaagauggauaaacugacacuaaaggggaugagcuaugugauguguacuggaucguucaagcucgagaaagaagucgccgagacccagcacgguacggugcugguucagauaaaguacgagggcacagacgcuccuugcaaaaucccauuuucuacccaggaugaaaagggggugacucaaaacggacgucuuauuacagcgaaucccaucguaaccgacaaagagaagccugucaacauagaagcagagccacccuucggcgaguccuauauugugaucggugccggggaaaaggcuuugaaacugucaugguuuaagaaaggcaguagcaucggaaagauguucgaggccacugcacgcggcgccagaaggauggcuauucucggggauaccgccugggacuuuggauccaucgguggcguuuucacaucuguggggaaacugguccaucagauuuuuggaacggcauacggcgugcuuuucagcgguguaucauggaccaugaagauagggaucggcgugcuguugacuuggcucggacugaauagucgguccacuagcuuaucuaugaccuguauugcgguuggccuggucacacuauaccucggggugauggugcaggcugauucaggaugcgucaucaacuggaagggccgagaacugaaaugugguagugggaucuuuguuacuaaugaggugcacaccuggacggaacaguauaaguuccaagccgacagcccgaaacgccuuuccgcagccauuggaaaggcuugggaggagggcgugugcgguauaagaucuacaaccagguuggaaaacaucauguggaaacagauuucgaacgagcugaaucauauccuccuggaaaacgacaugaaguuuacuguagucgugggcgauguugccgggauuuuagcacagggcaagaagaugauccggccucagcccauggaguacaaguauagcuggaaauccuggggcaaggcuaaaauaaucggggccgacgugcaaaauaccacauucauuaucgauggaccaaacacuccugaaugucccgacgaucagcgcgcguggaauauuugggaggucgaggacuacggcuuugguaucuucaccacaaacauauggcugaaacuuagagauucauauacacaggugugcgaccacagguugaugagugccgcuauuaaagauucuaaggcaguucacgccgacaugggguacuggaucgaaagcgagaagaaugaaaccuggaaacucgcucgugccuccuucauugaggugaagacuuguaucuggccaaaaucacauacacuguggagcaacggaguacuagaaucugagaugauaauccccaagauuuauggcgguccuaucucccagcacaauuaccggccaggcuacuuuacccaaacugcagggccguggcaucugggaaaacucgagcuggauuucgaccuuugcgaaggcacaaccgucgugguggaugagcacugcgggaaccgaggacccaguuugagaacgacuaccgucacaggcaagauuauccacgaaugguguugcaggagcuguacccugccuccauuacgcuuuaagggugaggacgggugcugguauggaauggagauacggcccguuaaagaaaaggaggaaaaucucgugaaaucuaugguauccgcgggcucaggugagguggacaguuucagccugggccuucuguguauuucgaucaugaucgaagaggucaugagauccagguggucucgcaagauguugaugacugggacacucgccguguuuuuccugcuaauuaugggacagcugaccuggaacgaucucauccgacugugcauuaugguuggcgcuaaugccagcgaccggauggggaugggaacaacuuaccuugcauugauggcuaccuuuaaaaugcguccuauguucgccgugggccuguuauuuagaaggcucacgucacgcgagguccugcuucugacaauaggucuaagucucguggcauccguugaacugccaaacucuuuggaggaacugggggauggauuagccaugggcaucaugauucucaagcugcuuaccgacuuccagagccaucaacugugggcuacuuugcucucccugaccuuuaucaagacaacuuucucacuacacuaugcguggaaaaccauggccauggugcugagcauugucagucuuuuuccccucugucugucuacgacaucccagaagaccacuugguugccgguacuguuaggcagccucgggugcaaaccucugacaauguuccuuaucgcagagaauaagauauggggacggaaaucguggccacugaacgaagguaucauggcugugggcauuguuucaaucuugcucucuagucugcuaaagaacgaugugccccuggccgggccucuuauugccggaggcaugcucaucgcuuguuacgucauauccgguagcucugcagaccugagcuuggagaaagccgcggagguguccugggaagaggaagcugagcauucaggggccagucacaauauuuuaguagaagugcaggaugacggaaccaugaagaucaaggaugaggagagagacgauacucugacaauccuccugaaagcaacccuucuggccgucagcggcguuuaucccuugucuauuccagcuacgcuauucgugugguacuuuuggcagaagaaaaagcaaagguccggcgugcugugggacacuccuucacccccagaagucgagcgagcagugcucgaugacgggauauaucgcaucaugcagcggggacugcuugguagaagucagguuggcguagggguguuccaggaaaacgucuuucauaccauguggcacgugacaaggggagccguuuuaauguaccaaggcaaacgucuggagccgagcugggcguccgugaagaaggaccucauuucuuacggugggggauggcgcuugcagggcucguggaauaccggcgaggaaguccaggugaucgcuguagagccugggaaaaaccccaagaauguccagacagccccaggaacuuucaaaaccagcgaaggugaggugggcgcaauugcccuggauuuuaagcccgggacgucaggauccccuaucguuaaccgggaaggcaaaauagugggucucuaugggaauggagucgugacaacaaguggcaccuacguuucugcuaucgcccaagcaaaggcuagccaggagggcccacugcccgagauugaagacgagguguucagaaagaggaaccuuacaaucauggaucugcacccuggguccggaaaaacccgacgguauuugccggccauuguccgcgaagcgaucaagagaaaacuaaggacucugauacucgccccaacccgggugguagcaucagagauggcugaagccuuaaaggguaugcccauucgauaccagacaacggcugugaaaucugagcauacuggcaaggagaucguugaccugaugugccacgcaaccuuuacaaugagacuucugagcccuguccgcgugccaaauuauaacaugaucauuauggaugaagcccauuucaccgaccccaguuccaucgccgcuaggggguacauaagcacucgugugggaaugggcgaggcggcagccauuuuuaugacagcuaccccuccggguucugucgaagccuucccccaaucaaaugcaguaauccaggaugaggaacgggacauuccagagagauccuggaacaguggguaugaguggaucacggauuuuccuggaaagacugugugguucguucccagcauaaaaucgggcaaugacauugccaacugucucaggaagaauggcaaacgcgugauccaguugucucgaaagacauucgauaccgaauaccagaaaaccaagaacaacgacugggacuacgucgugacuacagauaucuccgagaugggggcuaauuuuagagcggaccggguuauugauccaaggcgcugccugaagccugugauccucaaagacggacccgaacgugucauucuggccgguccaaugccggugaccguagcaagcgcugcccaaagacggggcaggauagggcgcaaccacaauaaggagggagaucaguauaucuacaugggccagccucuuaacaaugacgaggaucaugcacacuggacagaagccaaaaugcuacuggacaacauuaauacucccgaggguaucaucccagcuuuguucgaacccgagcgagaaaagucagccgcgauugauggggaguauagauuacggggcgaggcaaggaaaacguuuguggaacugaugcgcagaggagaccucccuguuuggcugaguuacaaggucgccucugagggcuuccaguauuccgauaggcgguggugcuuugacggggaacguaacaaucaagugcuugaggaaaacauggauguggagauauggaccaaagagggagaacgcaagaagcugcgaccaagauggcucgacgcuaggacauacagcgaccccuuggcccugcgggaguucaaagaauuugcugcaggucgcagaucagucaguggcgaucuaauccuggagauugggaagcucccucagcaccuuacucagagggcccagaaugcucuggacaacuuaguuauguugcauaauagcgaacaaggaggccgggccuaucgacacgcaauggaggagcugccggauaccaucgaaacacucaugcugcuugcgcugauugccgugcucaccggugggguaacuuuguucuuucuguccggcagaggauuaggcaaaacgucuaucgggcuacuguguguggucgcuagcuccgugcuccuuuggauggccucaguugagccacauuggauagcagcuucuaucauucuggaguucuuuuugauggugcugcucauccccgagccugaccgccagaggacaccccaggauaaccagcuggccuacgucguaauuggacuucucuucaugauccugacaguggcagccaaugagauggguuugcuggaaacuaccaagaaagacuuaggcauagggcacguugcugcggagaaccaccaucacgccgcaaugcuagauguggaccugcauccagcuagugccuggacacucuacgccgucgcaaccacuauuaucacaccuaugaugcggcacacgauugaaaacaccacugcuaauaucucgcuuacagccauagcgaaccaagcugccauccugaugggauuggauaagggcuggcccauuagcaagauggacaucggugugccacugcucgcacuggggugcuauucccaggucaauccucuuaccuuaaccgccgcugugcugaugcucguugcacauuacgccauuaucggcccgggauugcaggcgaaagcuacacgugaggcccaaaagagaacugcagccggcauaaugaaaaaccccacgguggaugggauuguagcuaucgaccuggauccaguggucuaugacgccaaguuugaaaaacagcuaggacagaucaugcugcucauucuuuguaccucucagauccuguugaugaggacaacuugggcacugugcgagucaauaacccucgcuacaggcccucugaccacuuuaugggaggguagccccgggaaguucuggaauacgacaauugccguuuccauggcgaacaucuuccgcggaaguuaccuugccggcgcaggucuggcuuuuucucucaugaaaagccuaggcgggggacggcgaggcaccggggcccaaggagaaacucugggcgagaaauggaagagacaguugaaucagcugucaaaauccgaguucaacaccuauaagaggagugguauuauggagguggaccgcagcgaagcaaaagaggggcucaagcggggagagacaacuaagcacgcugucucuagaggcaccgccaaacuucguugguuuguggaaaggaaucugguaaagccagaggguaaagugaucgauuugggcugugggcggggaggcugguccuacuauugcgccgggcugaagaaaguuacagaagugaagggauacacgaaaggcgguccugggcacgaggaacccauaccgauggcgaccuacggauggaaccucgucaaguuacauucaggcaaggacguguucuuuaucccaccugagaaaugugauacucugcuuugcgacauuggcgagagcucgcccaauccaacaaucgaagaggggcgcacccugcgaguccuaaagaugguggaacccuggcucagaggaaaccaguucuguauuaaaauccugaauccuuauaugccgucuguuguagagacuuuggagcaaaugcagaggaagcacgguggcaugcuggugcggaacccccucagucgcaauuccacacaugaaauguacugggucagcugcgggaccggaaacauugugucagcuguuaauaugacguccagaaugcuucugaacagguuuaccauggcacaccgaaaaccaacauaugagcgggauguggacuuaggcgccgguacucgucacgucgcuguggaaccugagguagccaaccuggauaucauagggcagagaauugaaaauaucaagcaugagcacaagucuaccuggcauuacgacgaggauaaccccuauaaaacaugggcauaccacggaagcuaugaagugaagccuaguggcuccgccagcucuaugguuaauggcgucgugaaauugcucacuaagccaugggacgugauccccauggucacccagauugcuaugacagauaccacuccuuucgggcaacagcgcguuuuuaaagagaagguggacacgaggacaccaaaggcgaaacggggaaccgcccagauaauggaaguaacugcaaaguggcugugggguuuccuaucaagaaacaaaaagccccgcaucuguaccagggaggaauuuacacgaaaagugcggaguaaugcugccauuggcgcagucuucguggacgagaaccaauggaacuccgccaaggaggcuguugaagaugagagauuuugggaccuugugcauagggaacgcgagcugcacaagcaggggaaaugcgccacgugcgucuacaacaugaugggaaagcgugagaagaagcucggcgaguucgguaaagcgaaggggagccgggcaaucugguacauguggcugggagccagauucuuggaguuugaagcucugggcuucaugaaugaggaucacugguuuucuagggaaaacucgcucucaggcguggagggggagggacuucauaaacuggguuauauuuuacgcgacaucagcaagauaccgggcgggaauauguacgccgaugacaccgcaggaugggauacucgaaucacagaagacgaucugcagaacgaggcuaagauuaccgacaucauggaaccugagcacgccuugcucgcuaaauccauuuucaagcugacuuaucagaauaaaguaguucgggugcaaagaccagccaagaacggcacagucauggaugugaucaguaggcgcgaccagagagguucuggacaggugggaaccuacggccuaaauacauuuacuaacauggaagcacagcuuauacggcaaauggagagcgagggcauuuucucccccucagaacuggagaccccuaaccucgcggggaggguccuggauugguuggaaaaacauggagccgagcguuuaaagcgaauggcuaucaguggugacgacuguguugugaagccaaucgaugaccgcuuugccacggcacugaccgcucucaaugauaugggcaaaguaagaaaggacauuccccagugggaaccgucuaaaggguggaacgauuggcaacaggugccuuucugcagccaccacuuucaucaacuuauaaugaaggacggacgggagaucgucgugcccuguaggaaucaggaugagcugguuggccgcgccagagugucccagggugcaggguggucacuacgggaaacagccugccugggaaaaagcuaugcgcagauguggcaacucauguacuuccacaggcgagacuugcgucuggcugccaacgcaauuuguucugccgucccaguggauuggguaccuacuuccagaaccacauggaguauccaugcucaccaucaguggaugacuaccgaggacaugcuuagcguuuggaaucgcguguggauugaagagaaccccuggauggaagauaagacgcacaucucguccuggggcgacgucccauaucugggcaagcgggaggaccaguggugcgggucucucauaggauuaacagccagggcaaccugggcuacuaauauccaaguggccauuaaccagguuagacgccugaucgguaaugagaacuacuuggauuacaugacaucaaugaaacgguuuaagaaugaaagcgaccccgagggcgcgcugugguga

SEQ ID NO: 13692 - RNA, 9879 nt, Artificial Sequence
  derived and/or modified CDS sequence (opt3) from DENV-1__FJ410257__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagagcaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggaagcuucaaacuggagaaggaagucgcugagacccagcacgguacggugcuuguucagauaaaguacgagggcacagacgcgccuugcaaaaucccauucaccacucaagaugaaaagggggugacacagaacggacgcuugauuaccgcaaaucccaucguaacugacaaagagaagccugucaacauagaagccgagccacccuuuggcgagucguauauugugaucggugcuggggaaaaagcccugaagcucucuugguucaagaaaggcuccucaaucggaaagauguuugaggcaaccgccagaggcgcuaggcggauggccauucugggggauacagcaugggacuucggaaguaucgguggcguuuuuacgagcguggggaaacuuguccaucagauuuucggaaccgcguacggcgugcuguuuuccgguguaucuuggacuaugaagauagggaucggcguguugcucacauggcugggauuaaauagccgaucaaccagucuguccaugacauguauugcuguuggccuagucacucucuaccugggggugauggugcaggccgauagcggaugcgucaucaacuggaaaggccgcgaacuuaagugugguucugggaucuucguuaccaaugaggugcacacguggacagaacaauauaaguuucaggcagacucaccgaaaagauugagugccgcuauuggaaaggccugggaggagggcgugugcgguauaaggagcgcaacccggcuggaaaacaucauguggaaacagauuuccaacgagcucaaucauauccuguuagaaaacgacaugaagcugacuguagucgugggcgauguugcugggauucuuggacagggcaaaaagaugauccgcccucaacccauggaguacaaauauucuuggaagucgugggggaaggccaaaauaaucggagcggacgcccagaauaccacauucauuaucgauggcccaaacacuccugaaugucccgacgaucagagagcuuggaauauuugggagguggaggacuacgguuuugggaucuucaccacaaacauaugguugaagcucagggauagcuauacgcaggucugcgaccaccgucugauguccgcagccauuaaagauucaaaggcugugcacgccgacaugggauacuggaucgaaagugagaaaaaugaaaccuggaagcuagcacgggcgucuuuuauugagguuaagacuuguaucuggccaaaaagccauacacugugguccaacggcgugcucgaaucagagaugauaauccccaagauuuaugguggcccuaucagccaacacaauuaccgaccaggguacuucacccagacugccggaccguggcaucugggcaaacuugaguuggauuucgaccugugcgaagggacaaccguagucguggaugagcacugcggaaacagaggccccucuuuaaggacgacuaccgugacagguaagauuauccacgaaugguguugccgcuccuguacccucccuccacugcgguuuagaggggaggacggaugcugguauggcauggagauaaggcccgucaaagaaaaggaggaaaaucuuguuaagaguauggugagcgcugguucuggcgagguagacuccuucucacugggguugcucuguauuaguaucaugaucgaagaggugaugcgcagccgauggucgcggaaaaugcugaugacuggaacacuagccgucuuuuuccugcucauuaugggccagcugaccuggaacgaucuuauccguuugugcauuauggugggggcaaaugcuuccgacagaaugggaaugggcacaacuuaccuggccuuaauggcaaccuuuaagaugaggccuauguucgccguuggucuccuguuucgccggcuuacgucuagagaggugcugcuacucacaauagggcugagcuuggucgcuucaguggaacugccaaacaguuuagaggaacucggagauggccuggcgaugggcaucaugauucuuaaacuguugaccgacuuccaaucccaucagcucugggccacucugcuaucucugaccuuuaucaagacaacuuucagccuucacuaugcauggaaaaccauggcuaugguucucuccauugugucacuguuucccuugugucugagcacgacaagucagaagaccacuugguuaccgguccuccuggggucucuuggaugcaagccucugacaauguucuugaucgccgagaauaaaauaugggguaggaaguccuggccacucaacgaaggcaucauggccguagggauugugagcauccugcuaucgucacugcuuaaaaacgauguuccccucgcuggaccucugauugcaggcgguauguugaucgccuguuacgugauaucugggaguuccgcggacuuaagccuggagaaggcugccgaggucucuugggaagaggaagcagagcauagcggagccucccacaauauucucguggaaguacaggaugacggcaccaugaaaaucaaggaugaggagcgagacgauacucugacaauccuucugaaagcuaccuugcuagcagugucaggcgucuauccccugaguauuccagccacgcucuuuguuugguacuucuggcaaaagaagaaacagcgcagcggggugcugugggacacuccuucucccccagaaguggagcgggcgguccuugaugacggaauauauagaaucaugcagagggguuuacugggccguucccagguggggguuggaguauuccaagaaaacguguuucauaccauguggcacgucacacgcggcgcugugcucauguaccaggguaagcgguuggagccgucaugggccaguguuaaaaaggaccugauuagcuacgggggaggcuggagacucaggggcuccuggaauaccggggaggaagugcaggucaucgcaguggagccuggaaaaaaccccaagaauguacagacagccccagguacuuucaagacccccgaaggcgaggucggggcuauugcccuggauuuuaaaccuggaacgucuggcucgccaaucgugaaccgagaagguaagauaguugggcuuuauggaaauggcguggucacaacuagcggcaccuacgugucagcaaucgcucaagccaaagcgucccaggaggggccccugccugagauugaagacgagguuuuccggaagcgcaacuugacaaucauggaucuacacccgggaagugguaaaaccagaagguaucugccagccauugugcgggaagcaaucaagcgaaagcucagaacuuuaauacuggcucccacccgcgucguggccucugagauggcugaagcacuuaaaggcaugccuauuagguaccagacaacggccguaaagagcgagcauacugggaaagagaucguggaccugaugugccacgccaccuuuacaaugcgucucuuguccccaguucggguccccaauuauaacaugaucauuauggaugaagcucauuucaccgacccuucaucuaucgcggcaagaggauacauaagcacuagggugggcaugggugaggccgcugccauuuuuaugacagcaaccccgcccgggaguguggaagccuucccacaauccaaugcugucauccaggaugaggaacgcgacauuccugagcgaagcuggaacucuggauaugaguggaucacggauuuuucaggcaagacuguaugguucgugcccuccauaaaaaguggcaaugacauugcgaacugucugagaaagaaugggaagcggguuauccagcucagcaggaaaacauuugauaccgaauaccagaagaccaaaaacaacgacugggacuacguggucacuacagauaucucggagaugggagccaauuuccgcgcagaccgugugauugauccaagacggugccugaagccuguuauccuuaaagacggucccgaaagggugauucuagcuggcccaaugccggucaccguggccucugcagcccaacgccgagggagaauaggacggaacuauaauaaggagggcgaucaguacaucuauaugggucagccucugaacaaugacgaggaucacgcucauuggacagaagccaagauguuguuagacaacauuaauacucccgaggggaucaucccagcgcuguucgaacccgagagggaaaaauccgcagccguagauggcgaguaccgccucagaggagaggcuaggaagacguuuguggaacugaugcggcguggcgaccuuccuguuuggcugagcuauaaagucgccucagagggguuccaguacagugaucgccgauggugcuuugacggagaaagaaacaaucaagugcucgaggaaaacauggauguggagauuuggaccaaggagggugacaggaaaaaguugcggccacgcuggcuggacgcuagaacauauucugauccccuagcacugagggaacucaaagaguucgccgcuggccggcgauccgucagcggggaccuuauacuggaaaucggaaaguuaccucagcacuugacucagagagcccagaaugcacuggauaaccucguuaugcugcacaauucagagcaaggcggucgcgcguacaggcaugccauggaagagcuuccggacaccauugagacacugaugcucuuggcucugaucgccguguuaaccgggggcguaacucuauuuuuccugaguggacggggccucgggaagacgagcauuggacuucugugugugauggcauccucugucuugcuguggauggcuagcguggaaccacacuggaucgccgcauccauaauccucgaguuuuuccugaugguucuucucauucccgaaccugaucgucagagaaccccccaggacaaccagcuggccuacguggucaucgguuugcuguuuaugauuuuaacaguagcugcgaaugagaugggccuacuggagacuaccaaaaaggaucucgggaucggacauguggccguugaaaaccaccaccaugcagcuaugcuugacguggaucugcacccagccucagccuggacauuguaugcagucgcuaccacuauaauuacaccuaugaugaggcauacgaucgagaacaccacugccaauauuucucugacagcgaucgcuaaccaagccgcaauacucaugggccuggacaaagguuggcccaucaguaagauggauauuggggugccacuuuuagcccugggcugcuacucgcaggucaauccucucaccuugaccgcugcagugcugaugcuaguugcccacuaugcgaucauuggaccgggccugcaggcuaaagccacacgcgaagcacaaaagcggacugccgcugggaucaugaagaaccccacgguggacggaauaguagccauugaucucgacccaguggucuacgacgcaaaauucgagaagcagcuuggccagaucaugcuguugauccuguguaccagccagauucuccugaugcgaacaacuugggcuuuaugcgaauccaucacccuugccacagguccucugaccacucucugggaggggucucccggaaaauuuuggaauacgacaauagcgguuucaauggccaacauuuucagaggcagcuaucuagcaggugcuggccuggccuuuuccuugaugaagagucuggggggaggcaggcgcgggaccggagcacaaggcgagacucucggugaaaaauggaagcggcagcuuaaucagcugucuaagagcgaguucaacaccuacaaaagaucagggaucauggaaguggaucguuccgaggcuaaggaaggauugaaaaggggcgagacaacuaagcaugccgucagucgggguaccgccaaacugcgcugguucguggagcgaaaucucguaaagccagaaggcaaggugauugacuuaggguguggaagaggcggguggagcuauuacugcgcgggacugaaaaagguuacagaggugaaaggcuacacgaagggugggccuggacacgaagagcccaucccgauggcuaccuauggcuggaaccuugucaaacugcacucuggcaaggauguguuuuucauaccaccugaaaaaugugacacucuacucugcgauaucggggaguccucacccaauccaacaauugaggaaggaaggacccugcgggucuugaagaugguggagcccuggcugcgcgguaaccaguuuuguaucaagauucucaauccuuacaugccgagcguuguagaaacucuugagcaaaugcagagaaaacauggcgggaugcuggugaggaaccccuuaucgcgaaauucuacacacgagauguauugggucaguugcggaaccggcaacaucguguccgcaguuaauaugacgagccggaugcuguugaaccguuucaccauggcccauagaaagccaacauacgaacgcgacguggaucucgguacugggaccaggcacgucgcuguggagccugaaguagccaaccuggacauuaucggacagcggauagagaauauuaaacacgaacauaagucaacauggcacuaugaugaggacaaccccuacaaaacuugggcauaucauggcuccuacgaggugaagccuucuggcagcgccaguuccaugguuaauggggucgugaagcuacuuaccaaaccaugggaugugauccccauggucacacagaucgcuaugaccgacacuacgccuuuuggacaacagagaguuuucaaggaaaaaguggacacacgcaccccaaaggcgaaaagggguacugcccagauuauggagguaaccgcacgauggcuguggggcuuucucagccggaacaagaagcccagaauauguacaagggaagaguucacgcgcaaagugcguucuaaugcugccaucggggcagucuuuguggaugaaaaccaauggaauucagccaaggaggcuguugaggacgaacgguucugggaucuggugcacagagagagggaauugcauaaacagggaaagugcgccaccugcgucuacaacaugaugggcaaacgcgagaagaagcugggugaauuugggaaagcgaagggaagucgagcaauuugguauauguggcucggcgcccgguuccuugaguuugaggcucugggcuucaugaaugaagaccacugguucuccagagagaacagcuuaucugggguggaaggagagggucugcacaaauugggcuacauccucagggauauuucgaagaucccggggggaaauauguaugccgacgauacugcaggcugggacacacgcauaaccgaggaugaccugcagaacgaagcuaaaaucacugauauuauggagccugaacaugcccuacuugcuaaggccaucuuuaaacugacauaccagaauaagguaguuagagugcaacggccagcaaagaacgguaccgucauggacgugauuucaaggcgugaucagcgagggagcggacaggugggcacauauggccucaauacuuucaccaacauggaggcgcagcugauccgccaaauggaauccgaggggauauuuagucccucugaguuggaaacgccuaacuuagccgagagagcucuggacuggcucgaaaaauacggagucgagcggcuuaagaggauggccauuagcggugacgauuguguugugaaaccaaucgacgaucgcuucgcaaccgcucugacagcccuaaaugacaugggcaagguaagaaaagauaucccccagugggaaccguccaagggguggaacgacuggcagcaggugccuuuuugcucacaccauuuccaccaacugauuaugaaggauggacgggagauagucgugcccuguaggaaucaggacgagcucguuggccgagcacgugugagucagggugccggguggucuuugagagaaacugcgugccugggaaaaagcuaugcucagauguggcaacuuauguacuuucaccgccgggaucugaggcucgccgcaaacgccaucuguuccgcugucccaguggacuggguaccuaccucaagaacaacuuggagcauucaugcccaccaucaguggaugaccacggaggauauguuaucuguuuggaaucgcguguggaucgaagagaaccccuggauggaagacaagacacacauuuccaguugggaggacgucccauaccugggcaaacgggaggaucaguggugcggcagcuugaucgggcugaccgcaagggcuacuugggccacaaauauacaaguggcgaucaaccagguucgaagacucauuggaaaugaaaacuaucuugacuacaugaccucgaugaagcgguucaaaaaugaguccgaucccgaaggugcucugugguga

SEQ ID NO: 13693 - RNA, 9879 nt, Artificial Sequence
  derived and/or modified CDS sequence (opt3) from DENV-1__FJ461332__SS-prME
agcgugaccaugcugcucaugcuuaugcccacugcacuggcuuuccacuugacuacgagaggaggggagccucauaugaucgucuccaagcaggaaaggggaaaaucuuuacuguuuaagaccucagccgguguuaacaugugcacauuaauugccauggaccucggagagcugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaggaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuauucaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaagcugaccgugguagucggcgauguggcugggauccuuggacagggcaaaaagaugauacgcccucaacccauggaguacaaauauucguggaaaagcugggggaaggccaaaaucauuggagcggacgcccagaauacuaccuucaucauugauggcccaaacacaccugaaugucccgacgaucagagagcuuggaauaucugggagguugaggacuacgguuuugggauauucacuaccaacauuugguugaagcucagggauuccuauacacaggugugcgaccaccgucugaugucagcagccaucaaagauaguaaggcuguccacgccgacaugggauacuggauugaaucugagaaaaaugaaacguggaagcuagcacgggcgagcuuuaucgaggugaagaccuguauauggccaaaaucccauacucuguggucaaacggcguucucgaaagcgagaugaucauucccaagaucuaugguggcccuauuucucaacacaauuaccgaccaggguacuucacacagaccgccggaccguggcaucugggcaaacuugaguuggauuucgaccugugcgaagggacuacagugguagucgaugagcacugcggaaacagaggccccuccuuaaggaccacgacugugaccgguaagaucauacacgaaugguguugccgcaguuguacacucccuccacugcgguuuagaggggaggacggaugcugguauggcauggagauuaggcccgugaaagaaaaggaggaaaaucuugucaagagcaugguuucugcugguuccggcgagguggacucauucagucugggguugcucuguaucagcaucaugauugaagagguaaugcgcucgcgauggucccggaaaaugcugaugaccggaacucuagccguguuuuuccugcucaucaugggccagcugacauggaacgaucuuauucguuugugcauaauggucggggcaaaugcuuuugacagaaugggaaugggcaccacauaccuggccuuaauggcaacuuucaagaugaggccuauguuugccgugggucuccuguuccgccggcuuaccucuagagagguucugcuacucacgaucgggcugagcuugguggcuucagucgaacugccaaacaguuuagaggaacucggagauggccuggcgaugggcauuaugauccuuaaacuguugacagacuuucaaucccaucagcucugggccacccugcuaucucugacuuucauuaagaccacauuuagccuucacuaugcauggaaaacuauggcuauggugcucuccaucguuucacuguuccccuugugucugagcaccacgagucagaagacaaccugguuaccggugcuccuggggucucuuggaugcaagccucugacuauguuuuugauagccgagaauaaaaucugggguaggaaguccuggccacucaacgaaggcauuauggccgucgggaucguaagcauucugcuaucgucacugcuuaaaaacgaugugccccucgcuggaccucugaucgcaggcgguauguugauagccuguuacguuauuucugggaguuccgcggacuuaagccuggagaaggcugccgaggugucuugggaagaggaagcagagcauagcggagccucccacaauauccucgucgaagugcaggaugacggcacaaugaaaaucaaggaugaggagcgagacgauacccugacuauucuucugaaagcuacauugcuagcaguaucaggcguguauccccugaguauaccagccacccucuucgucugguacuucuggcaaaagaagaaacagcgcagcgggguucugugggacacgccuucucccccagugguggaacgggcgguccuugaugacggaaucuauagaauuaugcagagggguuuacugggccguucccagguggggguuggaguauuucaagagaacguguuccauacuauguggcacgucacccgcggcgcugugcucauguaccaggguaagcgguuggaaccgucaugggccaguguuaaaaaggaccugaucagcuacgggggaggcuggagacucaggggcuccuggaauacaggggaggaggugcaggucauugcaguggaaccuggcaaaaaucccaagaauguacagaccgccccagguacauuuaagacucccgagggcgaagucggggcuaucgcccuggauuucaaaccuggaaccucuggcucgccaauagugaaccgagaggguaagaucguugggcuuuauggaaauggcguggucacgacaagcggcacuuacgugucagcaauugcucaagccaaagcgucccaggaagggccccugccugagaucgaggacgaaguuuuucggaagcgcaacuugaccauuauggaucuacacccgggaagugguaaaacaagaagguaucugccagccaucgugcgggaggcaauaaagcgaaagcucagaaccuuaauucuggcucccacucgcgucguggccucugaaauggcugaggcacuuaaaggcaugccuaucagguaccagaccacagccguaaagagcgaacauacggggaaagagaucguggaccugaugugccacgccacuuucaccaugcgucucuuguccccaguucggguccccaauuauaacaugauuaucauggaugaggcucauuuuacagacccuucaucuauagcggcaagaggauacauuagcaccagggugggcaugggugaagccgcugccaucuucaugacugcaacaccgcccgggaguguggaggccuuuccacaauccaaugcugucauucaggaugaggaacgcgacaucccugaacgaagcuggaacucuggacacgaguggauaaccgauuuccccggcaagacgguaugguuugugccaucaauuaaauccggcaaugacaucgcgaacugucugagaaagaaugggaagcggguuauccagcucaguaggaaaacuuucgauacagaguaucagaagaccaaaaacaacgacugggacuacguggucaccacugauauuagcgaaaugggagccaauuuccgcgcagaccgugugaucgauccuagacggugccugaagcccguuauucuuaaagacgguccagagagggugauacuagcuggcccgaugccugucacaguggccucggcagcccaacgccgagggagaaucggacggaaccauaauaaggaaggcgaucaguacauuuauaugggucagccccugaacaaugacgaggaucacgcucacuggaccgaggccaagauguuguuagacaacaucaauacaccagaagggaucauucccgcgcuguuugagccugaaagggagaaaucugcagccguagauggcgaauaccgccucagaggagaggcuaggaagacuuucguggagcugaugcggcguggcgaccuuccaguuuggcuguccuauaaagucgccagcgaaggguuucaguacucagaucgccgauggugcuucgacggagagagaaacaaucaagugcucgaagagaacauggauguggaaauauggacgaaggagggugagaggaaaaaguugcggccccgcuggcuggacgcuagaaccuauagugacccucuagcacugagggaauuuaaagaguucgccgcuggccggcgaucugucuccggggaucucauccuugaaauuggaaagcugccgcagcauuuaacacagagagcccagaaugcauuggacaaccugguuaugcuccacaauagcgagcaaggcggucgcgcguacaggcaugccauggaggaacugccagauacuaucgagacccuuaugcugcucgcuuugauugccgugcugacagggggcguaaccuuauuuuuccuaucaggacggggccuggggaagacaaguaucggacuccuuugugugauggcaagcuccguccuguuguggauggcuucuguggaaccccacuggauagccgcaagcaucauucuggaguuuuuccucaugguucugcuuaucccugaacccgaccgucagagaacgccacaggauaaccagcucgccuauguggucauuggucuguuguuuaugauccugaccguagcugcgaaugagaugggcuuacuagagacaacuaaaaaggaccuggggauaggacacguggccguugaaaaccaucaccaugcagcuaugcucgauguggaccuucacccugccuccgccuggacccuguacgcagucgcuacaaccauuaucacucccaugaugaggcauacaauugagaacacgaccgccaauaucucauugacugcgauagcuaaccaagccgcaauccugaugggccucgauaaagguuggccaauuucuaagauggacaucggggugccucugcuugccuuaggcugcuacagucaggucaauccgcugacacucaccgcugcaguguugaugcugguugcccacuaugcgauuaucggacccggccuacaggcuaaagccacccgcgaagcacaaaagcggacagccgcugggauaaugaagaacccaacuguggauggaauuguagccaucgaccuggauccuguggucuacgacguuaaauucgagaagcagcucggccagaucaugcuucugauuuuguguacgucgcagauccugcucaugcgaaccacaugggcacugugcgaaagcauaacuuuagcuaccgguccccuuacaacccugugggagggguccccaggaaaauuuuggaauacuacgauugccgugucuauggcgaacaucuucagaggcucauaucucgccggugcaggccuagcuuucagccugaugaagucccuagggggaggcaggcgcgggacaggagcccaaggcgagacccugggugaaaaauggaagcggcagcucaaucagcuuaguaagucugaguuuaacacuuacaaaagaagcgggauuauggaagucgaccguucagaggcaaaggaaggacugaaaaggggcgagaccacaaagcacgcugugucccgggguacugccaaauugcgcugguucguagagcgaaaucuggugaagccugaaggcaagguuaucgaucucggguguggaagaggcggguggaguuauuacugcgccggacuaaagaaggugaccgaggucaaaggcuauacaaagggugggcccggacaugaggaaccgauaccaauggcgacguacggcuggaaccuggugaaacuucacagcggcaaggacgucuuuuucaucccucccgaaaaaugugauacccugcuaugcgacauuggggagucuuccccaaaucccacuaucgaggaaggaaggacacuccgggugcugaagaugguugagccuugguugcgcgguaaccaguuuuguauuaagauccugaauccguacaugcccucaguaguggaaacccucgagcaaaugcagagaaaacauggcgggaugcuugucaggaacccacugagccgaaauucgacucacgagauguauugggugucuugcggaacaggcaacauuguuagugcugugaauaugaccucccggauguuacugaaccguuucacgauggcacacagaaagccuaccuacgaacgcgaugucgacuuggguacagggacuaggcauguggccguagagcccgaaguggcuaaccucgauaucauaggacagcggauugagaauaucaaacacgaacauaagagcaccuggcacuaugacgaggauaacccuuacaaaacaugggccuaucauggcucauacgagguuaagccauccggcucugcaagcaguauggucaaugggguggugaagcugcuaacuaaacccugggacgucaucccuaugguuacccagauugccaugacagauaccacuccauuuggacaacagagaguguucaaggaaaaaguagacacgcgcacacccaaggcuaaaagggguaccgcgcagauaauggaggugacugcccgauggcuuuggggcuuucugucccggaacaagaagccgagaaucuguaccagggaagaguucacacgcaaaguccguagcaaugcagcuauuggggccguguuuguugacgaaaaccaauggaacucugcaaaggaggccguggaggaugaacgguucugggaccucguccacagagagagggaacugcacaaacagggaaagugcgcuacgugcguguauaacaugaugggcaaacgcgagaagaaguugggugaauuugggaaagccaagggaucacgagcgaucugguacauguggcugggcgcacgguuccucgaguucgaggcccuuggcuuuaugaaugaagaucauugguucaguagagagaacucccugagcgggguagaaggagaggguuuacacaaacugggcuacauuuugagggacaucucuaagauaccugggggaaauauguaugcugaugacaccgccggcugggauacucgcaucacagaggacgaucuccagaacgaagcaaaaauuaccgacaucauggagccagaacaugcucugcuagccaaggcuauuuuuaaacuuacuuaccagaauaagguugugagaguccaacggcccgccaagaacgguacagugauggaugugaucucgaggcgugaccagcgagggucaggacaggucggcaccuauggccugaauacauucacuaacauggaggcacagcucauacgccaaauggaaagcgaggggauauuuuccccuagugagcuggaaaccccaaacuuggcggagagagccuuagauuggcuggaaaaauacggaguugagcggcucaagaggauggcuaucucuggugacgacugugugguaaaacccaucgaugaccgcuucgccacggcacuuaccgcucugaaugauaugggcaaggugagaaaagacauuccgcagugggaaccuagcaagggguggaacgauuggcagcagguccccuuuugcucccaccacuuccaucaacuaauaaugaaggacggacgggagaucgugguuccauguaggaaucaggaugagcuggugggccgagcccgugucucacagggugcaggguggagucucagagaaacagccugcuugggaaaaucuuaugcgcagauguggcaacugauguacuuucaccgccgggaccuuaggcuggcugccaacgcaauuuguagcgccgugccuguagauuggguucccacuuccagaaccacauggucaauccaugcucaccaucaguggaugacuaccgaggacaugcucagcguguggaaucgcgucuggauugaagagaacccauggauggaagauaagacgcacaucucuuccugggaggacgugcccuauuuaggcaaacgggaggaccaguggugcggcagucugauaggguugacagccagggcaaccugggcuacuaauauccaaguugccauuaaccaggugcgaagacugaucggaaaugaaaacuaccucgauuacaugacaagcaugaagcgguucaaaaaugagucggacccugaaggugcgcuuugguga

SEQ ID NO: 13694 - RNA, 9879 nt, Artificial Sequence
  derived and/or modified CDS sequence (opt3) from DENV-1__FJ461333__SS-prME
agcgugaccaugcugcucaugcuuaugcccacagcccuggcuuuccacuugacuacgagaggaggggagccucauauggucguuuccaagcaagaaagaggaaaaucuuuacuguuuaagaccucagcgggugugaauaugugcacacugaucgccauggaccucggcgagcugugugaagauacuaugaccuacaaaugcccacggauuacagaggcggaaccggacgauguagacuguuggugcaaugcuaccgauacuugggugacauaugggaccuguagucaaacgggagagcaccgccgagacaagcguagcgucgcccuugcaccccaugugggccuggguuuggagacuagaaccgaaacauggauguccucugagggggccuggaaacagauacagaggguugaaacuugggcucuccggcacccuggauucaccgugaucgcacuguuucuggcccaugcuauuggcacaucgaucacccagaagggcauuaucuucauacucuuaaugcuggucacgccaucaauggccaugcgcugcguggggaucggaagcagagauuuuguagagggucuuaguggcgcgacuuggguugacguggucuuggagcacggguccugugugacaaccauggcaaaggauaaacccacucuggacauugaacugcucaagacagaggugaccaacccugccauccugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauaggguugggcgugcuccugacuugguuaggacuaaauucacgaaguacaucccuaagcaugaccuguaucgcuguuggccucgucacacuguaccuuggggugauggugcaggccgauucuggaugcgucauuaacuggaaaggccgcgaauugaagugugguucagggaucuucguuacuaaugaggugcacaccuggacggaacaauauaaguuucaggcagacaguccgaaaagacugagcgccgcuaucggaaaggccugggaggagggcgugugcgguauuagguccgcaacacggcucgaaaacguaauguggaaacagauaucuaacgagcugaaucauaucuuacuggaaaacgacaugaaguucaccgucgugguuggcgauguggcugggauucuugcccagggcaaaaagaugauccgcccucaacccauggagcacaaauacucguggaaaagcuggggcaaggcgaagauuaucggggccgacguccagaauacuaccuuuauaaucgauggaccaaacacaccugaaugucccgacgaucagagagcuuggaauauuugggagguggaggacuauggcuucgguaucuuuacuaccaacauuugguugaagcucagggauuccuacacacagguuugcgaccaccgucugaugucagcagccaucaaagauaguaaggcugugcaugccgacaugggguauuggauagaaucugagaaaaaugaaacguggaagcuagcacgggcgagcuucauugagguaaagaccuguaucuggccaaaaucccacacucuguggucaaacggaguccucgaaagcgagaugauuauccccaagauauacggcgguccuaucucucaacauaauuaucgaccaggcuacuucacacagaccgccgggccguggcaccugggaaaacuugaguuggauuuugaccugugcgaaggcacuacagugguggucgaugagcacugcgggaacagaggacccuccuuaaggaccacgacuguuaccggcaagauuauccaugaaugguguugccgcaguuguacacucccuccacugcgguucagaggugaggacgggugcugguacggaauggagauuaggcccgugaaagaaaaggaggaaaaucuuguaaagagcauggugucugcuggcuccggugaggucgacucauuuagucugggcuugcucuguaucagcauaaugauugaagaggugaugcgcucgcgauggucccggaaaaugcugaugaccgggacucuagccguuuuccugcuccugaucaugggacagcuuacauggaacgauuugauccgucugugcauuauggugggcgcaaaugcuucugacagaauggggaugggaaccacauauuuagcccucauggcaacuuuuaagaugaggccuauguucgccgucggccugcuuuuucgccggcugaccagcagagaggugcuacuccugacgaucgguuugucacugguugcuaguguggaauuaccaaacucccucgaggaacugggggauggacuugcgaugggcauuaugauacugaaauugcucacagacuuccaaucucaccagcugugggccacccuacugagccuuacuuuuaucaagaccacauucucccuccauuacgcauggaaaacuauggcuaugguccugucaauuguauccuuguuuccccuguguuuaaguaccacgucucagaagacaaccuggcucccggugcugcuuggcucccuggggugcaagccuuugacuauguuccucaucgccgagaauaaaauuuggggaaggcgaagcuggccacugaacgaagguaucauggccguuggcauagugucgauccuacugucaucucuucucaagaacgaugucccccuggcugggccuuugauugcaggaggcauguuaaucgccuguuaugugauuagugguuccagcgcggaccugucucucgagaaagcugccgagguaagcugggaagaggaagcagagcacuccggggccucacauaauauccugguggaaguccaggaugacggaacaaugaagauaaaagaugaggagcgcgacgauacccuuacuauucuguugaaggcuacacuacuggcaguuaguggcguguacccccucagcaucccagccacccuguuugugugguauuucuggcagaaaaagaagcagcggucuggcguccuuugggacacgccuucacccccagaaguggagagagcgguuuuagaugacgggaucuacaggauuaugcagcguggacugcucggucgcagccagguaggcgugggggucuuccaagaaaacguguuucacacuauguggcacguuacccggggagcuguguugauguaucagggcaaaagacuggagccgaguugggccagcgucaagaaagaccucauauccuacggugggggauggaggcugcagggcucuuggaauacaggcgaggaagugcagguaaucgcagucgagccugggaagaaccccaaaaaugugcaaaccgccccaggaacauucaagacucccgaaggugagguuggcgcuauugcccuugauuuuaagccugggaccucgggaagcccaaucgugaaccgagaaggcaaaauugucggucuguacgggaauggagugguuacgacaucaggcacuuauguguccgcaaucgcucaggccaaggcgagucaggagggccccuugccugagauagaagacgaggucuuccggaaacgcaaccuaaccaucauggaucugcauccggggucuggaaagacaagaagguaccucccagccauugugcgggaagcaaucaaacgaaaguuaagaacccugauucuugcucccacucgcguaguggccagcgagauggcugaagcacugaaggguaugccuaucagguaucaaaccacagccguuaaauccgagcacacgggcaaggagauagucgaccucaugugccaugccacuuuuaccaugcguuugcugucaccagugcgggugcccaauuacaacaugauuaucauggaugaagcucacuucacagacccuucuagcaucgcggcaagaggguauauuaguaccagggucggaaugggcgaggccgcugccaucuuuaugacugcaacaccgcccgguuccguagaagccuucccacagagcaaugcugugauacaggaugaggaacgcgacauuccugagcgaucuuggaacucaggguacgaguggaucaccgauuuucccggaaaaacgguuugguucgugccauccauuaagaguggcaaugacaucgcgaacugucucaggaaaaauggcaagcgggucauacagcugagcaggaagacuuuugauacagaauaucagaaaaccaagaacaacgacugggacuacgugguuaccacugauauuucggagaugggggccaauuuccgcgcagaccgugugaucgauccuagacggugccuuaaacccgucauccuaaaggacggaccagaaagggugauucuggcugguccgaugccuguaacaguggccucugcagcccagcgccgaggcagaaucgggcggaaccauaauaaagagggagaucaguacauuuauaugggccagcccuugaacaaugacgaggaucacgcucacuggaccgaagccaagauguuacuggacaacauaaauacaccagaggguaucauucccgcacucuucgaaccugagagggaaaaguccgcagccaucgauggggaguaccgccugagaggcgaggcuaggaaaacuuuuguugaacuuaugcggcguggagaccugccagucuggcucagcuauaagguggccucagagggcuuccaauacagugaucgccgauggugcuuugacggggaaagaaacaaucagguguuggaggaaaacauggaugucgagaucuggacgaaagagggagaaaggaagaaacugcggccccgcuggcuagacgcuagaaccuauucugacccucuggcacucagggaguucaaggaauuugccgcuggucggcgauccguuagcggcgaucuuauucuggagauagggaaauuaccgcagcauuugacacagagagcccaaaaugcacuggacaaccucgugaugcugcacaauucagaacagggaggccgcgcguacaggcaugccauggaggagcuuccagauacuaucgaaacccugaugcucuuggcucugauugccguauuaacagguggggugacccuauucuuucugaguggccggggacucggcaagacuagcaucgggcuucugugugucauggcauccucuguguugcuguggauggcuagcguugagccccacuggauugccgcauccaucauacucgaguucuuucugauggugcuucucaucccugagcccgaccgucagagaacgccacaggauaaccaacuggccuaugucguaauuggauugcuguucaugaucuuaaccguggcugcgaaugagaugggucuacuggaaacaacuaagaaagaccucggcauugggcacgccgcaguuggaaaccaucaccaugcugccaugcuugauguggaccugcacccugccucagcauggaccuuguacgcugucgccacaaccaucauaacucccaugaugaggcauacaauugagaacacgaccgcgaauaucucucugacugcuauugccaaccaggcagccauccucaugggccuggauaaggguuggccaauaaguaaaauggacaucggggugccucuuuuagcucugggcugcuacucgcaggucaauccgcucacauugaccgcagccgugcugaugcuaguugcgcacuaugcuauuaucggacccggccugcaagccaaggcaacccgcgaagcccagaaacggacagcugccgggauuaugaagaacccaacuguggauggaaucguagcaauagaccucgauccuguggucuacgacgcuaaguuugagaaacagcuuggccagauuaugcuguugauccuguguacgagccaaauccuccugaugcgaaccacaugggccuuaugcgaauccauuacucuugcgaccgguccccugacaacccucugggaggggucuccaggaaaguucuggaauacuacgaucgccguuucaauggcaaacauauuuagaggcagcuaucuagcuggugccggccuggcauucuccuugaugaaaagucuagggggaggcaggcgcgggacaggagcucagggcgagacccucggugaaaaguggaaacggcagcuuaaucagcugucuaagagcgaguucaacacuuacaagagaucagggauuauggaaguggaccguuccgaggccaaagaaggauugaagaggggcgagaccacaaaacacgccgucagucgggguacugcgaagcugcgcugguuuguggagcgaaaucucguaaaaccugaaggcaaggugaucgauuuaggguguggaagaggcggguggagcuauuacugcgcuggacugaagaaaguuaccgaggugaagggcuauacaaaaggugggcccggacaugaagaaccgauuccaauggcaacguacggcuggaaccuugucaagcugcacucuggcaaagacguguucuuuaucccucccgaaaagugugauacccuacucugcgacauaggggaguccucaccaaaucccacuaucgaggaaggaaggacacugcgggucuugaaaaugguggagccuuggcugcgcgguaaccaauucuguauuaagauccucaauccguacaugcccagcguuguagaaacccuugagcagaugcagagaaagcauggcgggaugcuggugaggaacccauuaucgcgaaauucuacucacgagauguauugggucaguugcggaacaggcaacauuguguccgccguuaauaugaccagccggaugcuguugaaccguuuuacgauggcucacagaaaaccuaccuacgaacgcgauguggaccucggugccgggacaaggcaugucgcaguggagcccgaaguagccaaccuggauaucauuggacagcggaucgagaauauaaagcacgaacauaaaucaacuuggcacuaugacgaggauaacccuuacaagaccugggcuuaucauggcuccuacgaggugaaaccaucuggcagcgcgaguuccaugguuaauggggucgugaagcuacuuacaaagcccugggacgugauuccuauggucacucaaaucgccaugaccgauacaaccccauucggacagcagagaguuuuuaaagaaaagguggacacucgcacgcccaaagcaaagagggguacagcucaaaucauggagguaaccgccaaauggcuguggggcuuccucagccgaaacaagaagccgcggauuuguacuagagaagaguuuaccaggaaagugcgcucuaaugcagccauaggggcugucuucguggacgaaaaccaguggaacucagccaaggaggcgguugaggaugaacguuuuugggaccuggugcaccgggagagagaauugcacaaacagggaaagugcgcaacaugcgucuauaacaugaugggcaaaagggagaagaagcugggugaguucgggaaagccaagggaagucgcgcuaucugguacauguggcucggcgcccgauuucuugaguucgaggcacugggcuucaugaaugaagaucauugguuuucccgggagaacagcuuaucugggguggaaggagagggucugcacaaauugggcuacauucucagagacaucucgaagauuccugggggaaauauguaugcugaugacacggccggcugggauaccaggaucacugaggacgaucugcagaacgaagcucgcauaacagacaucauggagccagaacaugcccuacuugcaaaaucaauuuucaagcugaccuaccaaaauaaaguaguuagagugcagcggcccgcgaagaacgguacugucauggaugugaucagcaggcgugaccagcgaggguccggacaggugggcacauauggccucaauaccuuuacaaacauggaggcccaacugauucgccagauggaaagugaggggaucuucucuccuagcgaguuggaaacuccaaacuuagcugagagaguccuggauuggcucgaaaaguacggaguugagcggcuuaaaaggauggccauauccggugacgacugugugguaaagcccauugaugaccgcuuugcaaccgcucugacggcccuaaaugauaugggcaaagugagaaaggacaucccgcagugggaaccuucaaaaggguggaacgauuggcagcaaguccccuucugcagucaccacuuucaucagcugaucaugaaggacggacgggagauugugguuccauguaggaaucaggaugagcucgugggccgagcacgugucucucagggugccggguggagcuugagagaaaccgcgugccugggaaaguccuaugcucaaauguggcagcuuauguacuuccaccgccgggaccugaggcucgccgcaaacgccauauguucagcugugccuguagauuggauccccacaagcagaacuaccuggucuauucaugcccaccaucaguggaugacaacugaggacauguuauccguuuggaaucgcguguggaucgaagagaacccauggauggaagauaaaacccacauuaguagcuggggcgacguccccuaucugggcaagcgggaggaccaauggugcgggucguugaucggacugacggcaagggcuacaugggccaccaaugugcagguugcgauaaaccaggugcgaagacucaucgguaaugagaacuaccuugauuacaugacuuccaugaaacgguuuaagaaugaaucugacccugagggcgcucugugguga

SEQ ID NO: 13695 - RNA, 9879 nt, Artificial Sequence
  derived and/or modified CDS sequence (opt3) from DENV-1__FJ410262__SS-prME
agcgugaccaugcugcuaaugcuuaugcccaccgcacuggcuuuccacuugacuacgagaggcggggaaccucauaugaucgucuccaagcaggaaaggggaaaaucuuuacuguuuaagaccucagccgguguuaacaugugcacacuaauugcaauggaccucggcgaguucugugaagauacuaugaccuacaaaugcccgcggauaacagaggcggaaccggacgauguggacuguuggugcaaugcuaccgauacuuggguaacauaugggaccuguagucaaacgggagagcaccgccgagacaagcguagcguggcacuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucggccuuugcgaagggacuacagucgugguggacgagcacugcggaaacagaggccccaguuugaggaccacgacugucaccgguaaaaucauucacgaaugguguugccgcagcuguacacugccuccauuacgguuuaagggggaggauggaugcugguauggcauggagaucagacccguuaaggaaaaagaggaaaaucucgugaagucuaugguauccgcugguucaggcgagguggacaguuucagccuggggcuucuguguauaucgauuaugaucgaagaggucaugaggucccgcuggucucgaaaaauguugaugaccggaacucucgccguguuuuuccugcuaaucaugggccagcugacauggaacgaccucauucggcugugcaucaugguuggggcaaaugcuagcgaucguaugggaaugggcaccacauaccuugccuugauggcaacuuuuaagaugagaccuauguucgccgugggucuguuauuuaggcgccucaccucacgggagguccugcuucugacgauugggcuaagucucguggcuuccguugaacugccaaacucuuuggaggaacugggagacggcuuagcgaugggcauaaugauccucaaacugcuuacagauuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuagggagccucggaugcaagccucugacuauguuccuuauugccgagaauaaaaucugggguagaaagucguggccacugaacgaaggcauaauggccguggggaucguuucaauuuugcucucuagucugcucaagaaugacgugccccuggcuggaccucuuaucgcaggcgguaugcucauugccuguuacgucaucuccgggagcucugcggaucugagcuuggagaaggcugccgagguguccugggaagaggaagcagagcauucaggagccagucacaauauauuaguagaagugcaggacgauggcacaaugaaaauuaaggacgaggagagggaugacacccugacuauccuccugaaggcuacacuucuggcagucagcggcguuuaucccuugucuaucccagccacccuauucgugugguacuuuuggcagaaaaagaaacaacgauccggggugcugugggauacgccuucacccccagaagucgagcgcgcggugcucgacgauggaauuuaucggauaaugcagagaggucugcuuggcaggagucagguugggguaggaguguuccaggaaaacgucuuucauacuauguggcacgugacccguggcgcuguuuuaauguaccaagguaagcgccuggagccgagcugggccuccgugaaaaaggaccucaucucuuacgggggaggcuggcgguugcagggcucguggaauacaggggaggaaguccaggugauugcaguagagccuggaaagaaccccaaaaauguccagaccgccccagguacauucaagacuagcgaaggcgaggugggggcuaucgcccuggacuuuaaacccggaaccucaggcuccccuauuguuaacagagaagguaagaucguggggcucuauggaaauggcgucgugacgacaaguggcacuuacguuucugcaauagcucaagccaaagcgagccaggaggggccacugcccgagaucgaagaugagguguucaggaagcgaaaccuuaccauuauggaccugcacccuggauccgguaagacacggcgcuauuugccggccaucgucagagaagcaauuaaaaggaagcuacggacccugauccucgcuccaacucgagugguagccucagagauggcugaagcauuaaaaggcaugcccauaagauaccagaccacagccgugaagucugagcauacggggaaagagauuguugaucugaugugccacgccacuuuuaccaugcgccuucugagcccugucagggugccaaauuauaacaugaucaucauggacgaagcucauuucacagaucccaguuccauugcggcacguggauacaucagcacccgggugggcaugggugaggccgcugccauauuuaugacugcaacaccuccggggucugucgaagccuucccccaaucaaaugcuguaauucaggacgaggaaagagauaucccagagagguccuggaacaguggauaugaguggauuaccgacuuuccuggcaagacggugugguucguucccagcaucaagucgggcaaugauauagcgaacugucuccgcaaaaaugggaagcgagugauucaguugucuagaaaaacuuucgacacagaauaccagaagaccaaaaacaacgauugggacuacgucgugaccacugacaucuccgagaugggagccaauuuucgggcagauaggguuaucgacccacgccguugccugaagccugugauucucaaggauggucccgaaagagucauccuggcuggcccaaugccggugacaguagccagcgcagcccaacggagggggcgcauuggacgaaaccacaauaaagagggcgaccaguauauauacaugggucagccucuuaacaaugaugaggaccaugcucacuggaccgaagccaagaugcuacuggauaacaucaauacacccgaggggauuaucccagcguuguucgaacccgagagagaaaaaucagcagccaucgacggcgaguaucgguuaaggggagaggcucgcaagacuuuuguggaacugaugagaaggggcgaucucccuguuuggcugaguuacaaagucgccucugagggguuccaguauuccgaccggcguuggugcuuugauggagaacgcaacaaucaagugcuugaggaaaacauggacguggagauuuggacgaaggagggugaacgaaagaaacugagaccaagguggcucgaugcucggaccuacagcgaccccuuggcacugcgcgaguucaaagaauuugccgcuggcagaaggucagucaguggggaccuaauacuggagaucggaaaacucccucagcaccuuacacagcgggcccagaaugcacuggauaacuuaguuauguugcauaauagcgaacaaggcggucgagcguauagacacgccauggaggagcugccggacacuauugaaacccucaugcugcuugcucugaucgccgugcucacagggggcguaaccuuguucuuucuguccggacgcggcuuagggaagacuucuauuggacuacugugugugauggcaagcuccguccuccuuuggauggcuucaguggagccacauuggaucgccgcaucuauaauccuggaguucuuuuugaugguucugcucauucccgagccugauaggcagcggacgccccaggacaaccagcuggccuacguggucaucggucuucucuucaugauucugaccguagcugcgaaugagaugggcuugcuggaaacaacuaaaaaggauuuagggaucggacacguggccguugagaaccaccaucacgcagcuaugcuagacguggaucugcauccagccagugccuggacccucuacgcagucgcuacaaccauaauuacuccuaugaugcgucacacaaucgaaaacacgaccgccaauauuucgcuuacugcgaucgcuaaccaagccgcaauacugaugggcuuggacaaagguuggcccaucagcaagauggauauuggggugccacugcucgcccugggcugcuauucccaggucaauccucuuacauuaaccgcugcagugcugaugcucguugcccauuacgcgaucauuggaccgggcuugcaggcuaaggccaccagagaggcacagaagaggacagccgcugggaucaugaagaaccccacuguggacggaauaguagccauugaucuggacccaguggucuaugaugcaaaauuugaaaagcagcuaggccagaucaugcugcucauccuuuguacgucucagauucuguugaugcgcaccacaugggcucugugcgagucaaucacucucgccaccgguccucugacaaccuuaugggaggggagccccggaaaauucuggaauacuacgauagcgguuuccauggccaacauuuuccggggcaguuaccuugccggugcuggccuggccuuuucucucaugaaaagccuagggggaggccgaagagggacaggagcacaaggcgaaacccugggugagaaguggaaaaggcaguugaaucagcugucaaaguccgaguucaacacuuauaaacgcagugggaucauggagguggaccggagcgaagcuaaggagggacucaaaagaggcgagaccacaaagcacgccgucucucgugguacugccaaacuuaggugguuuguggaacggaaucugguaaaaccagagggcaaggugauugacuugggguguggacgcggcgggugguccuacuauugcgcgggacugaaaaagguuaccgaagugaaaggcuacacaaagggugggccuggacacgaggaacccaucccgauggcuacguacggcuggaaccucgucaaauuacauucaggcaaggauguguucuuuauaccaccugagaagugugacacccugcuuugcgauaucggggagagcucgcccaauccaacuauugaagagggacgaacacugagaguccuaaaaaugguggaacccuggcucagggguaaccaguucuguaucaagauucugaauccuuauaugccgucuguuguagagaccuuggagcaaaugcagcggaaacacggcgggaugcuggugcgcaacccccucaguagaaauuccacucaugaaauguacugggucagcugcggaacaggcaacaucgugucagcaguuaauaugaccuccaggaugcuucugaaccgauuuacgauggcccaccggaagccaaccuaugagcgugacguggauuuaggugcugggacaagacacgucgccguggaaccugagguagcaaaccuggacauuaucggacagcgcauagaaaauauuaaacaugagcacaagucuacuuggcauuacgaugaggacaaccccuauaagaccugggccuaccacggcagcuaugaagugaaaccuaguggcuccgcuagcucuaugguuaauggggucgugaaguugcucacaaaaccaugggaugugauccccauggucacucagaucgcgaugaccgacacaaccccuuucggacaacagaggguuuuuaaggagaaaguggauacucggacgccaaaggccaagagagguacagcacagauuauggaaguaaccgcuaaauggcuguggggcuuccuaucacgcaacaagaaacccaggauauguacucgagaggaauuuacccggaaggugagaaguaaugccgcaaucggggccgucuucguggacgagaaccaauggaacuccgcuaaagaggccguugaagacgagagguuuugggaucuugugcaucgcgaacgugagcugcacaagcagggaaagugcgcgacaugcgucuacaacaugaugggcaaacgggaaaagaaacucggugaguucgggaaggcaaaaggaagcagagccauuugguacauguggcugggcgcuagguucuuggaguuugaagcccugggcuucaugaaugaggaccacugguuuucucgcgaaaacucgcucucagggguggagggagagggucuucauaagcugggcuauaucuuacgagauauuagcaaaaucccagggggaaauauguacgcagacgauacggcuggcugggacacccggauaacugaagaugaccugcagaacgaggccaagaucacagauauuauggaaccugagcacgcuuugcucgccaaguccaucuucaaacugaccuaucagaauaagguaguuagagugcaaaggccagccaagaacgguacugucauggacgugauuagucgcagagaucagcgggggucuggacaggugggcacauacggccuaaauaccuuuacaaacauggaagcgcagcuuaucaggcaaauggagagcgaggggauauucucccccucagaacuggagacuccuaaccucgccggacguguccuggacugguuggaaaagcaugguguugagcgauuaaaacgcauggcuauuaguggcgaugacugugugguaaagccaaucgacgauagauuugccaccgcacugacggcucucaaugacauggggaaggugcggaaagauaucccccagugggaaccgucuaagggauggaacgacuggcagcaggucccuuucugcagccaccacuuucaucaacuuauuaugaaagauggcagggagauagugguucccugucgcaaucaggacgagcugguggguagagcccgggucucccagggggcaggauggucacuaagggaaaccgccugccugggcaagagcuaugcgcagauguggcaacucauguacuuccaccgacgugauuugagacuggcugccaacgcaaucuguucugccgugccaguagacuggguuccuacaucccgcacuaccuggaguauucaugcucaccaucaguggaugacaacugaggauaugcuuagcguguggaaucgggucuggaucgaagagaaccccuggauggaagacaaaacccacauuucguccuggggcgaugugccauaucuggggaagagggaggaccaguggugcggaucucucaucgguuuaacggccagagcaacaugggcuaccaauauacaaguugccaucaaccaggugcgccggcugauuggcaaugagaacuacuuggacuacaugacuucaaugaagagguuuaaaaaugaaagcgaucccgagggggcgcugugguga

SEQ ID NO: 13696 - RNA, 9879 nt, Artificial Sequence
  derived and/or modified CDS sequence (opt3) from DENV-1__FJ410263__SS-prME
agcgugacaaugcugcucaugcuuaugcccacagcacuggcuuuccacuugacuacgcggggaggggaaccucauaugaucgucuccaagcaggaaaggggaaaaucuuuacuguuuaagaccucagccgguguuaacaugugcacacuaauugccauggaccucggcgaacugugugaagauauaaugacuuacaaaugcccacggaucaccgaaacagaaccggacgauguggacuguuggugcaaugcgaccgauacuugggugacauaugggaccuguagucaaacgggagagcaccgccgagacaagcguagcguggcucuugcaccccaugucggccuggguuuggagacuagaaccgaaacauggauguccucugagggggcauggaaacagauucagaggguggaaacuugggcccuccggcacccuggauucaccguuaucgcucuguuucuggcacaugccauuggcacaucgaucacccagaagggcauaaucuucauucucuuaaugcuggugacgccaucaauggcuaugcgcugcgucgggaucggaagcagagauuuuguggagggucuuaguggcgccacuuggguagacguuguguuggagcacggguccugugucacaaccauggcgaaggauaaacccacucuggacauugaacuacucaagacagaggugaccaacccugcagugcugaggaaacuuugcaucgaagccaagauaucuaauacgaccacagauagccgguguccaacucaaggagaggcuacccuggucgaagaacaggacgccaacuucguuugccgccgaacauuuguggauagaggcugggguaauggguguggauuguucggcaaaggcucccucauuacuugcgcaaaguuuaagugcguaaccaaacuggaggggaagaucgugcaguacgaaaacuuaaaauauucagucauugugacaguucacaccggagaccagcaucaaguggguaaugagaguacugaacacggcacgacagcuaccaucacuccccaggccccuaccacagagauccagcugaccgacuacggggcgcucacucuugauuguagcccaaggacaggacuggacuucaacgaaauggucuugcuaacgaugaaggagaaaucuuggcuggugcauaagcagugguuucucgaucugccgcuucccuggaccuccggcgccucaacuagccaagagacauggaaucggcaggaccuguugguaaccuucaaaacagcacacgcuaagaagcaggaaguugugguccucgguagucaagagggggccaugcacacugcucugaccggcgccacggaaauucagaccucuggaacaacuaccauauuugcaggccauuuaaaaugccgucugaagauggauaaacuaacacucaaggggauguccuaugugauguguacugggagcuucaaacuggagaaggaagucgccgagacccagcacgguacggugcuuguucagaucaaguacgagggcacagacgcuccuugcaaaauuccauucucgacccaagaugaaaagggggugacucagaacggacgcuugaucacagcgaaucccauaguaaccgacaaagagaagccugucaacauugaagcagagccacccuuuggcgagucuuauaucgugaucggugccggggaaaaagcucugaagcucuccugguucaagaaaggcucaaguauuggaaagauguuugaggccacugcaagaggcgccaggcggauggcuauccugggggauaccgccugggacuucggaagcauugguggcguuuuuacauccguggggaaacuuguccaucagauauucggaacggcauacggcgugcuguuuucugguguaagcuggaccaugaagaucgggauuggcguguugcucacuuggcugggauuaaauucacgaaguacaucccugagcaugaccuguaucgcgguuggccuagucacacucuaccugggggugauggugcaggcugauucuggaugcgucaucaacuggaaaggccgcgaacuuaagugugguucagggauuuucguuacuaaugaggugcacaccuggacggaacaauauaaguuucaggccgacaguccgaaaagauugagcgcagccauaggaaaggcuugggaggagggcgugugcgguaucagguccgccacacggcuggaaaacauuauguggaaacagaucucuaacgagcucaaucauauucuguuagaaaacgacaugaaguucaccguagucgugggcgauguugcagggauccuggcucagggcaagaagaugauacgcccucaacccauggaguacaaauauucguggaaaagcuggggcaaggccaagaucauuggggcggacgugcagaauacuaccuuuaucauugauggaccaaacacaccugaaugucccgacgaucagagagccuggaauaucugggaggucgaggacuacggcuucgguauauuuacuaccaacauuuggcuuaaguugagggauuccuauacacaggugugcgaccaccgucucaugucagcugcaaucaaagauaguaaggccguucacgcugacaugggguacuggauugaaucugagaaaaaugaaacguggaagcuggcccgggcauccuucaucgaggugaagaccuguauauggccaaaaucccauacucuauggucaaacggaguacuggaaagcgagaugaucauucccaagaucuauggcgguccuauuucucaacacaauuaccgaccaggcuacuucacacaggcggccgggccguggcaucucggaaaacuggagcuugauuuugacuugugcgaaggcaccacugucgugguggaugagcacugcgggaacagaggacccucccugaggacaaccacggucacuggcaagaucauacacgaaugguguugccgcaguuguaccuuaccuccacuccgguucagaggugaggacgggugcugguauggaauggagauuaggcccguuaaagaaaaggaggaaaaucugguaaagagcaugguaucugcuggcuccggugagguggacucauuuagucuuggccuguuguguaucagcaucaugauugaagaggucaugcgcucgcgauggucccggcguaugcucaugacagggacccuggccguguucuuucuacugaucaugggacagcucacuuggaacgaucugauuagacuuugcauaaugguuggcgcaaaugcuucugacaggauggggaugggaacaaccuacuuggcccugauggcaacauucaaaaugcgcccuauguuugccgugggcuuacucuuccggagacugacuagcagggagguccuucugcuaaccaucggucucucacugguggcuaguguugaauugccaaacucccuggaggaauuaggggauggacucgcgaugggcauuaugauccugaaacuucugacggacuuucaaucucaucaguugugggccacacuccugagccuaaccuucauuaaaacuaccuuuucccugcacuaugcauggaagacaauggcuauggugcuuucaaucgucagccucuucccccuguguuugaguacuaccucucagaaaacgacauggcugccgguauuacucggcucccuggggugcaagccucuuaccauguuucugauagccgagaauaagaucuggggacgacgcagcuggccauugaacgaagguauuauggccgugggcaucguuucgauucuccugucaucucuacugaaaaacgaugugccccuugcugggccucucaucgcaggaggcaugcugauagccuguuacgucauuagugguuccagcgcggacuugucuuuagagaaggcugccgaggugagcugggaagaggaagcagagcauuccggggccucacacaauauccugguagaagugcaggaugacggaacuaugaaaaucaaggaugaggagcgggacgauacacucaccauucugcuuaaagcuacucuguuggcagucaguggcguuuauccccuaagcauaccagccacacuguucgugugguacuucuggcaaaagaaaaagcagagaucuggcgugcucugggacaccccuucacccccagaagucgagagggcggugcuggaugacgggaucuaucguauuaugcagcgcggacuuuuaggucggagccagguuggcguagggguguuucaagaaaacgucuuccauacgauguggcacgugacuagaggagcuguucugauguaccagggcaagaggcucgagccgaguugggccagcgugaaaaaggacuugaucuccuacggugggggauggcgacugcagggcucuuggaauaccggcgaggaaguccaggugauugcaguagagccugggaaaaaccccaagaauguccaaacagccccaggaaccuuuaaaacacccgaaggugaggugggcgcuaucgcccucgauuucaagccugggacuucgggaagcccaauaguuaaccgggaaggcaagaucgugggucuguaugggaauggagucgugaccacgucaggcacauacguuuccgcaauugcucaggccaaagcgagucaggagggcccccuuccugagaucgaagacgagguguuucgcaagagaaaccugacuauuauggauuugcacccggggucuggaaaaaccaggcgguaucuaccagccaucguccgagaagcaauaaagagaaaacugcgcacacucauuuuagcucccaccagggugguagccagcgagauggcugaagcacugaaggguaugccuauccguuaccaaacuaccgccgugaaguccgagcauacaggcaaagagaucguugaccuuaugugccacgccacguucacuaugcggcugcucucaccagucagagugcccaauuauaacaugauuaucauggaugaagcucauuuuaccgacccuucuagcauagcggcaaggggguacauuaguacacgcgugggaaugggcgaggccgcugccaucuucaugaccgcaacuccgcccgguuccgucgaagccuuuccacagagcaaugcuguaauucaggaugaggaacgagacaucccugagagaucuuggaacucaggguaugaguggauaacagauuuccccggaaagaccgugugguuuguuccauccauuaaaaguggcaaugacaucgcgaacuguuugcggaagaauggcaaaagggugauccagcugagccgcaagacguucgauacugaauaccaaaagaccaagaauaacgacugggacuacgucgugaccaccgauauuucggagaugggggccaauuuccgugcagacagaguuaucgauccucggaggugccucaagcccgugauucugaaagacggaccagaacgcgucauacuugcugguccgaugccugugacuguagccucugcagcccagcgaagaggccggaucgggaggaaccacaauaaggagggagaucaguauauuuacaugggccagccccuaaacaaugacgaggaucaugcucacuggacagaagccaaaaugcuguuggacaacaucaauaccccagaggguaucauucccgcguuauuugaaccugagcgcgaaaaguccgcagccauagauggggaguauagacugaggggcgaggcucggaagacauucguggaacucaugcgucgcggagaccugccaguuuggcuuagcuacaaagucgccucagagggcuuucaauauagugaucgaagauggugcuucgacggggaaaggaacaaucaggugcuggaggaaaacauggauguggagaucuggacuaaggagggagaacggaaaaagcuccgccccagaugguuggacgcuaggacguacucugacccucuggcacuacgggaguuuaaagaguucgccgcuggucgaagauccgucagcggcgaucugauucucgagaucgggaaacuuccgcagcaccugacccagcgcgcccaaaaugcauuagacaacuugguuaugcugcauaauucagaacagggaggcagggcguaucggcacgccauggaggagcucccagauacaauugaaacucugaugcuucuggcucucaucgccguguugaccggugggguaacacuguuuuucuuaaguggccguggacuaggcaaaaccagcauagggcugcucugugugauggcauccucuguccuucuguggauggcuagcguggagccccauuggaucgccgcauccauuaucuuggaauuuuuccugaugguucuccugauuccugagcccgacagacagaggacuccacaggauaaccaacuugccuacguggucaucggacuccuguuuaugauauugacgguagcugcgaaugagaugggucuguuagaaaccacaaagaaggaccuaggcauugggcacguggccguugagaaccaccaucacgcagcuaugcuggauguggaccuccauccugccucagccuggacucuuuacgcagucgcuaccacaaucauuacccccaugaugcgccacacuaucgaaaacacaacggccaauauaucucugaccgcgaucgcuaaccaggccgcaauuuugaugggacuggauaaaggcuggccaaucaguaagauggacauuggugugccucuccuggcccuugggugcuauucgcaggucaauccguuaacucugacagcugcagugcucauguugguugcccauuacgcgaucauaggccccggacugcaagcuaaagccacccgggaggcacagaagcgaaccgccgcuggcauuaugaaaaacccaacaguggaugggaucguagccaucgaccuagauccuguggucuaugacgcaaaguucgaaaagcagcugggacagauuaugcuccuuauccuguguacuagccaaauauugcugaugagaacgaccugggcucucugcgaguccauuacacuggccacuggccccuuaaccacacuuugggaggguucuccagggaaauuuuggaauaccacuaucgcgguuucaauggccaacauuuucaggggaagcuaccuggcaggcgcuggucucgccuucucccuaaugaagagucugggcgggggacgccggggcacgggggcacagggagaaacauugggcgagaaauggaagagacagcugaaucagcucucuaaaagcgaauuuaacaccuauaagcguucagguaucauggagguggacagguccgaagcuaaggaggggcuuaaacggggagagacuaccaagcacgccgucagucgcggcacagccaaacugcgaugguucguggaaagaaauuugguaaagccugaggguaaagugauagaucugggcugugggaggggaggcuggagcuacuauugcgcggggcucaagaagguuacugaagugaaaggauacaccaagggcggucccgggcacgaggaaccgaucccaauggcuacauacggauggaacuuagucaaacugcauucuggcaaggacguguuuuucauuccucccgagaaaugugauacgcuucugugcgacaucggcgaguccucaccaaaucccaccauugaagaggggcggacucuacgcguccucaagaugguggaaccuuggcugagaggaaaccaauuuuguaucaaaauuuugaauccguauaugcccagcguuguagagacacuggagcagaugcagaggaagcacgguggcaugcucgugcgaaacccacuuucgagaaauucuacccaugaaauguacugggucaguugcgggacuggaaacaucguguccgcaguuaauaugacaagccguaugcuguuaaacagauucaccauggcccaccgcaagccuacguaugagagggauguggaccugggcgcugguacccggcacgucgccguggaacccgagguagcaaacuuggauauaauugggcagagaaucgaaaauaucaaacaugagcacaagucaacauggcauuacgacgaggauaacccuuauaaaacuugggccuaccacggauccuaugaagugaagccaucuggcagcgcuaguuccaugguuaauggcgucgugaaacuccugaccaagcccugggacgugauuccuauggucacacaaauagcgaugacugauaccacaccauuugggcagcagcgcguuuucaaggagaaaguggacaccaggacucccaaggccaaacgaggaacggcacaaaucauggaaguaacagcuaaguggcuaugggguuuucuuagccggaacaaaaagccgagaauuuguaccagggaggaguucacucgcaaggugcguucuaaugccgcaaucggcgccgucuuuguggacgagaaccaguggaacucagcuaaagaggccguugaagaugagcgguucugggaccuggugcauagagaaagggagcuccacaagcaggggaaaugcgcgaccugcgucuacaacaugaugggaaagcgcgagaaaaagcugggcgaguuugguaaggcaaaagggagucgagccauuugguacaugugguugggagcucgguuccuggaguucgaagcccucggcuuuaugaaugaggaucacugguucuccagagaaaacagccuuucuggcguggagggggagggacugcauaaguuagguuauauccugagggacauaucgaaaaucccuggcgggaauauguacgcagaugacacagcuggaugggauacgcgcauuaccgaagacgauuugcagaacgaggccagaaucacugacauuauggaaccagagcacgcucuccuggccaagucaaucuuuaaacuaacauaucaaaauaagguaguucgggugcagaggcccgccaaaaacggcaccgucauggaugugauaagccgucgagaccagcgcgguuccggacaggugggaacuuacggccuuaauacauucaccaacauggaagcgcaacugauuagacagauggagagugagggcaucuuuucuccuagcgaacucgagacaccaaaccuggccgaacgggucuuggauugguuagagaaguaugggguugaaaggcugaagcgcauggcuaucuccggagacgacugugugguaaaacccauugaugacagauucgccacugcacucaccgcucuuaaugauauggguaaggugcggaaagacauaccgcagugggagccuucaaagggcuggaacgauuggcagcaaguccccuuuugcagucaucacuuccaccagcugaucaugaaagacgggagggagauugugguuccaugucgaaaucaggaugagcuagugggacgugccagagucucucagggcgcagguuggagccugcgcgagacggccugccucgggaaguccuacgcgcaaauguggcaguugauguauuuucaucggagggaccugagacuugcugccaacgcaaucuguucagccgugccuguagauuggauucccaccagccgcacaacuuggucuauccacgcucaucaccaguggaugaccacagaagacaugcuguccguuuggaaucggguguggauagaggaaaacccauggauggaggauaagacucauaucaguagcuggggagacguccccuaccucggcaaaagggaggaccaauggugcggcucguuaauugggcugaccgcccgagcaacgugggcuacaaauauccagguggccauuaaccagguuagacgguugaucggaaaugaaaacuaccuggauuauaugaccuccaugaagagguucaaaaaugagucugacccugaaggugcgcucugguga

SEQ ID NO: 13697 - RNA, 9879 nt, Artificial Sequence
  derived and/or modified CDS sequence (opt3) from DENV-1__FJ410264__SS-prME
agcgugaccaugcugcucaugcuuaugcccaccgcacuggcuuuccacuugacuacgaggggaggggaaccucauaugaucguaaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuauucagaacggacgcuugaucacugcaaaucccauagugacagacaaagagaagccuguaaacauugaagccgagccacccuuuggcgagucuuauaucgucaucggugcuggggaaaaagcccugaagcucuccugguucaagaaaggcucaaguauuggaaagauguuugaggcaaccgccagaggcgcuaggcggauggccauccugggggauacugcaugggacuucggaagcguggguggcguuuuuaccuccguggggaaacuuguccaucagauuuucggaacagcguacggcgugcuguuuucugguguaagcuggacgaugaagauagggaucggcguguugcucaccuggcugggauuaaauucacgaaguacuucccugagcaugacauguauugcuguuggccuagucacccucuaccugggggugauggugcaggccgauucuggaugcgucaucaacuggaaaggccgcgaacuuaagugugguucagggaucuucguuacaaaugaggugcacacuuggaccgaacaauauaaguuucaggcagacaguccgaaaagauugagcgccgcuauuggaaaggccugggaggagggcgugugcgguauaagguccgcaacgcggcuggaaaacaucauguggaaacagauuucuaacgagcucaaucauauccuguuagaaaacgacaugaaguucacaguagucgugggcgauguuguggggauucuggcucagggcaaaaagaugauccgcccucaacccauggagcacaaauacucguggaaaagcuggggcaaggccaagauaaucggggcggacguccagaauaccacuuuuauuaucgauggaccaaacaccccugaaugucccgacgaucagagagccuggaauauuugggagguggaggacuauggcuucgguaucuuuacaacuaacauauggcuuaaguugagggauuccuacacccagguuugcgaccaccgucucaugucagcugcaauuaaagauaguaaggccgugcaugcugacaugggguauuggaucgaaucugagaaaaaugaaacauggaagcuggcccgggcauccuucauugagguaaagacguguaucuggccaaaaucccacacccuauggucaaacggaguccuggaaagcgagaugauaauccccaagauuuacggcgguccuaucucucaacauaauuaucgaccaggcuacuucacucagacagcggggccguggcaccucggaaaacuggagcuugauuuugacuugugcgaaggcaccacugugguggucgaugagcacugcgggaacagaggacccucccugaggacaaccacgguuacuggcaagauuauccaugaaugguguugccgcaguuguaccuuaccuccacuccgguucaaaggugaggacgggugcugguacggaauggagauaagacccgugaaggaaaaggaggaaaaucugguaaaaagcauggugucugccggcuccggugaggucgacucauuuagucuuggccuguuguguauuagcaucaugaucgaagaggugaugaggucgcgcuggucccgaaagaugcucaugacagggacccuggcuguuuuccuacugcucauuaugggacagcugacuuggaacgaucuuauccgguugugcauuauggugggcgccaaugcaucugaccguauggggaugggaacaaccuaucuggcuuuaauggccacauuuaaaaugagaccuauguucgcagucggccuccuguuuaggcgccuuacuagccgggaggugcugcuacucaccauaggucugucauugguugccaguguggaacugccaaacuccuuagaggaacucggggauggacuggcuaugggcaucaugauucuuaagcuguugacggacuuccaaucucaccagcucugggcgacacugcuaagccugaccuuuaucaaaacuacccuuucccuccauuacgccuggaagacaauggcaaugguccugucaauugucagcuuguucccccuguguuuaaguacuaccucucagaagacgacauggcucccggugcugcuuggcucccuggggugcaaaccuuugaccauguuucucaucacugagaauaagauauggggaagaaaaagcuggccacugaacgaagguaucauggcuguuggcguggucucgauucuacugucaucucuucucaagaacgaugugccccuggccgggccuuugaucgccggaggcauguuaauugcuuguuauguaaucagugguuccagcgcagaccugucucucgagaaagccgcggaggugagcugggaagaggaagcugagcacuccggggccucacauaauauacuggucgaaguucaggaugacggaacaaugaagauuaaagaugaggagagggacgauacccuuacuauccuguugaaggcaacacuacuggccgugaguggcguguacccccucagcaucccagcuacccuguucgucugguauuuuuggcaaaagaaaaagcagcgaucuggcgugcuuugggacacgccuucacccccagaaguugagcgcgcaguauuagaugacgggauuuaccggauaaugcagagaggacugcucgguaggagccaggugggcgucgggguguuccaagaaaacguuuuccacacuauguggcacgugacccguggagccgucuugauguaucagggcaaacgccuggagccgaguugggcgagcgugaagaaagaccucaucuccuacggugggggauggcggcugcagggcucuuggaauacaggcgaggaaguacaggucauugcuguggagccugggaagaaccccaagaauguucaaaccgccccaggaacauuuaaaacucccgaaggugaggugggcgcaaucgcccuugauuucaagccugggaccucgggaagcccaauugucaacagagaaggcaaaaucgugggucuguacgggaauggaguugugacgacaucaggcacuuaugucuccgcuauagcccaggcaaaggcuagucaggagggccccuugccugagaucgaagacgagguguuuaggaaacgaaaccuaaccauuauggaucugcauccggggucuggaaagacacggcgcuaccucccagccaucguaagagaagcgauuaagaggaaauuacggacccugauccuugcccccacucgagugguugcaagcgagauggcugaagcccugaaggguaugccuauaagauaucaaaccacagcugucaaauccgagcacacgggcaaggagauuguggaccucaugugccaugcaacuuucaccaugcgcuugcugucaccagugaggguccccaauuacaacaugaucaucauggaugaagcccacuuuacagacccuucuagcauugccgcucguggguauaucaguacccggguaggaaugggcgaggcggcagccauauucaugacugcuacaccgcccgguuccguggaagccuuuccacagagcaaugcaguuauucaggaugaggaaagagacaucccugagaggucuuggaacucaggguacgaguggauuaccgauuuccccggaaaaacggugugguuugucccauccaucaagaguggcaaugacauagccaacugucuccgcaagaauggcaaacgagugauucagcugagcagaaagacuuucgauacagaauaucagaaaaccaagaacaacgacugggacuacguugugaccacugauaucucggagaugggggcuaauuuucgggcggacagggucaucgauccucgccguugccuuaaacccgugauucuaaaggacggaccagaaagaguaauccuggccgguccgaugccugugacaguugcaucugcugcccagcggaggggccgcauugggcgaaaccauaauaaggagggagaucaguacauauauaugggccagcccuugaacaaugacgaggaucacgcacacuggaccgaagccaaaauguuacuggacaacaucaauacaccagaggguauuauccccgcucucuucgaaccugagagagaaaaguccgccgcgaucgauggggaguaccggcugaggggcgaggcacgcaaaacuuucgucgaacuuaugagaaggggagaccugccaguguggcucagcuauaagguggccucagagggcuuucaauacagugaucggcguuggugcuucgacggggaacgcaacaaucaggucuuggaggaaaacauggauguugagauuuggacgaaagagggagaacgaaagaaacugagacccagguggcuagacgcucggaccuauucugacccucuggcccuccgcgaguuuaaggaguucgcugcagguagaagguccgugagcggcgaucuuauacuggagaucgggaaguuaccgcagcauuugacacagcgggcccaaaaugcucuggacaaccucguaaugcugcacaauucagaacagggaggccgagccuacagacaugcaauggaggagcuuccagauacuauugaaacccugaugcucuuggcgcugaucgccguguuaacagguggggucacccuauuuuuccugaguggccgcggacucggcaaaacuagcauugggcuucugugugugauggcuuccucuguuuugcuguggauggccagcguggagccccacuggaucgcagcuuccauaauccucgaauuuuuccugaugguccuucucauuccugagcccgacaggcagcggacgccacaggauaaccaacuggccuauguagugaucggauugcuguuuaugauuuuaaccguugcagccaaugagaugggucuacuggaaacaacuaagaaagaccucggcaucgggcacguggcugucgagaaccaucaccaugcgaccaugcuugauguggaccugcacccugccucagcauggacauuguacgcugucgccaccacuauaauuacacccaugaugcgucauacgaucgaaaacaccacugccaauauuucucugacagcaaucgcuaaccaggccgcgauacucaugggacuggauaagggcuggccaaucaguaaaauggacauuggugugccucuuuuagcucuggggugcuacucgcagguuaauccgcucaccuugaccgccgcagugcugaugcuaguagcccacuaugcuaucauuggccccggacugcaagcaaaggccacaagagaggcgcagaagaggacugcugccggcaucaugaaaaacccaacgguggaugggauagucgcaauugaccucgauccuguuguguacgacgccaaguucgaaaaacagcuuggacagaucaugcuguugauccuguguaccagccaaauucuccugaugcgcacaacuugggcuuuaugcgaguccaucacccuugccacaggcccccugaccacucucugggaggguucuccagggaaguuuuggaauacgacaauagcagucucaauggcuaacauuuuccggggaagcuaucuagccggcgcgggucuggccuuuuccuugaugaaaagucugggcgggggacgaagaggcaccggggcacagggagaaacucucggcgagaaguggaagaggcagcuuaaucagcugucuaaaagcgaguucaacaucuacaagcgcucagguauuauggagguggaccgguccgaagcuaaagagggguugaagagaggagagaccacacgucacgccguaaguaggggcacugcaaaacugcggugguucguggaacgcaaucucguuaagccugaggguaaggugaucgauuuaggcugugggcgaggaggcuggagcuauuacugcgcugggcugaaaaaggucaccgaagugaaaggauauacaaagggcggucccgggcaugaggaaccgauaccaauggccacguacggauggaaccuugucaaacugcacucuggcaaggacguguuuuucaccccucccgagaaaugugauacucuacucugcgacaucggcgaguccucaccaaaucccacaauugaagaggggagaacccugaggguuuugaagaugguagaaccuuggcugcggggaaaccaauuuuguaucaagauucucaauccguacaugcccagcguggucgagacucuugagcagaugcagcgcaaacaugguggcaugcuggugagaaacccauuaucgagaaauucuacacacgaaauguauuggguuaguugcgggaccggaaacaucguguccgccgucaauaugacgagccgaaugcuguugaaccgguucaccauggcgcaccguaagccuacauacgagagagauguggaccucggcgcugguacucgccauguagcaguggaacccgagguugccaaccuggauauuaucgggcagaggauagaaaauauuaaacacgagcauaagucaaccuggcacuaugacgaggauaacccuuacaaaacaugggcuuaucauggauccuacgaagucaagccaucuggcagcgccaguuccauggugaauggcguggucaagcuacuuacuaaacccugggacguuaucccuauggugacccaaaucgcaaugacagauaccacuccauuugggcagcagcggguauucaaggagaaaguggacacgagaacacccaaggccaaacgcggaaccgcucaaauuauggaagucacugcgagguggcugugggguuuucucagccgaaacaagaagccgcggauauguaccagagaggaguucacaaggaaagugcgcucuaaugccgcaaucggcgcuguuuuuguggacgagaaccaguggaacucagccaaggaggcagucgaagaugagcguuucugggaccuggugcagaaagaacgggaguugcacaagcaggggaaaugcgccacgugcguauauaacaugaugggaaagagagaaaagaaacugggcgaguuugguaaggcuaaagggaguagggccauuugguacauguggcucggagcgcgcuuccuugaguuugaagcacugggcuucaugaaugaggaucacugguucucccgagaaaacagcuuaucuggcguugagggggagggacugcauaaguuggguuacauccuccgggacauuucgaaaaucccuggcgggaauauguaugccgaugacaccgcuggaugggauacuagaauaacagaagacgaucugcaaaacgaggccaagaucaccgacauuauggaaccagagcacgcacuacuugcuacuucaaucuuuaaacugacauaccagaauaagguggucagggugcagcgccccgccaagaacggcaccgugauggaugucauuagcagacgggaccagagggguuccgggcaaguuggaacauauggccucaauacuuucaccaacauggaagcucagcugauccgucagauggagagugagggcauauuuuugccuucugaauuagagacgccaaaccuggccgaacgagugcucgauuggcuugagaaauacgggguagaacgccugaagagaauggcaauuagcggagacgacuguguggucaaacccaucgaugaccgguucgcgaccgcccuaacagcucugaaugauauggguaaggugaggaaagacaucccgcagugggagccuuccaagggcuggaacgauuggcaacagguucccuuuugcucacaucacuuccaccagcucauuaugaaggacgggcgcgagauaguggucccauguagaaaucaggaugaauuggugggacgggccaggguaagucaaggcgcagguuggucucugcgagagacugcuugccuugggaaaagcuaugcccagauguggcagcugauguacuuucaucguagagaccuccgcuuagcagccaacgcgaucuguuccgcuguuccuguggauuggguccccaccucacggacaacuuggagcauucacgcccaucaccaauggaugaccacggaagacaugcugucuguguggaauaggguuuggaucgaggaaaacccauggauggaggauaagacacauguguccaguuggggagacguccccuauuugggcaaaagagaggaccaguggugcggcagccugauugggcucaccgcacgcgccacuugggcuucgaauauccagguggccauaaaccagguacggaggcuuaucggaaaugaaaacuaccuggauuacaugacauccaugaagcgauucaaaaaugagggugacccugaaggcgcacuaugguga

SEQ ID NO: 13698 - RNA, 9879 nt, Artificial Sequence
  derived and/or modified CDS sequence (opt3) from DENV-1__FJ410265__SS-prME
agcgugaccaugcugcucaugcuuaugcccaccgcccuggcuuuccacuugacuacgcggggaggggaaccucauaugaucgucuccaagcaggaaaggggaaaaucuuuacuguuuaagaccucagccgguguuaauaugugcacgcuaauugccauggaccucggcgaacugugugaagauacuaugaccuacaaaugcccacggauaacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguaccagcauuaugaucgaagaggucaugcgcucgcgauggucccggcguaugcucaugacugggacacuggccguguucuuucuacugaucaugggacagcucaccuggaacgaucugauuagacuuugcaucaugguuggcgcaaaugcuucugacaggauggggaugggaacaacuuacuuggcccugauggcaaccuucaaaaugcgcccuauguuugccgugggcuuacucuuccggagacugacgagcagggagguccuucugcuaacaauuggucucucacugguggcuaguguugaauugccaaacucccuggaggaauuaggggauggacucgcgaugggcauaaugauccugaaacuucugaccgacuuucaaucucaucaguugugggccacucuccugagccuaaccuucauuaaaacaacuuuuucccugcacuaugcauggaagaccauggcuauggugcuuucaaucgucagccucuucccccuguguuugaguacgacaucucagaaaaccacuuggcugccgguauuacucggcucccuggggugcaagccucuuacaauguuucugauugccgagaauaagaucuggggacgacgcagcuggccauugaacgaagguauaauggccgugggcaucguuucgauucuccugucaucucuacugaaaaacgaugugccccuugcugggccucucaucgcaggaggcaugcugauugccuguuacgucaucagugguuccagcgcggacuugucuuuagagaaggcugccgaggugagcugggaagaggaagcagagcauuccggggccucacacaauauacugguagaagugcaggaugacggaaccaugaaaauuaaggaugaggagcgggacgauacucucacaauccugcuuaaagcuacccuguuggcagucaguggcguuuauccccuaagcaucccagccacgcuguucgugugguacuucuggcaaaagaaaaagcagagaucuggcgugcucugggacacuccuucacccccagaagucgagagggcggugcuggaugacgggauuuaucguauaaugcagcgcggacuuuuaggucggagccagguuggcguagggguguuucaagaaaacgucuuccauaccauguggcacgugacaagaggagcuguucugauguaccagggcaagaggcucgagccgaguugggccagcgugaaaaaggacuugaucuccuacggugggggauggcgacugcagggcucuuggaauaccggcgaggaaguccaggugauugcaguagagccugggaaaaaccccaagaauguccaaacagccccaggaacuuuuaaaacccccgaaggugaggugggcgcuaucgcccucgauuucaagccugggacgucgggaagcccaauuguuaaccgggaaggcaagaucgugggucuguaugggaauggagucgugacaacuucaggcaccuacguuuccgcaauagcucaggccaaagcgagucaggagggcccccuuccugagaucgaagacgagguguuucgcaagagaaaccugacaauuauggauuugcacccggggucuggaaaaaccaggcgguaucuaccagccaucguccgagaagcaauuaagagaaaacugcgcacucucaucuuagcucccaccagggugguagccagcgagauggcugaagcacugaaggguaugccuauacguuaccaaacaacggccgugaaguccgagcauacuggcaaagagauuguugaccuuaugugccacgccaccuucacaaugcggcugcucucaccagucagagugcccaauuauaacaugaucaucauggaugaagcucauuuuaccgacccuucuagcauugcggcaaggggguacaucaguacucgcgugggaaugggcgaggccgcugccauauucaugacagcaaccccgcccgguuccgucgaagccuuuccacagagcaaugcuguaauucaggaugaggaacgagacaucccugagagaucuuggaacucaggguaugaguggauuacggauuuccccggaaagacugugugguuuguuccauccaucaaaaguggcaaugacauagcgaacuguuugcggaagaauggcaaaagggugauucagcugagccgcaagacauucgauaccgaauaccaaaagaccaaaaacaacgacugggacuacgucgugacuacagauaucucggagaugggggccaauuuccgugcagacagaguuaucgauccucggaggugccucaagcccgugauucugaaagacggaccagaacgcgucauccuugcugguccgaugccugugaccguagccucugcagcccagcgaagaggccggauugggaggaaccacaauaaggagggagaucaguauauauacaugggccagccccuaaacaaugacgaggaucaugcucacuggacagaagccaaaaugcuguuggacaacaucaauacuccagaggguauuauccccgcguuauuugaaccugagcgcgaaaaguccgcagccaucgauggggaguauagacugaggggcgaggcucggaagacguucguggaacucaugcgucgcggagaccugccaguuuggcuuagcuacaaagucgccucagagggcuuucaauauagugaucgaagauggugcuucgacggggaaaggaacaaucaggugcuggaggaaaacauggauguggagauuuggaccaaggagggagaacggaaaaagcuccgccccagaugguuggacgcuaggacauacucugacccucuggcacuacgggaguuuaaagaguucgccgcuggucgaagauccgucagcggcgaucugauacucgagaucgggaaacuuccgcagcaccugacucagcgcgcccaaaaugcauuagacaacuugguuaugcugcauaauucagaacagggaggcagggcguaucggcacgccauggaggagcucccagauaccauugaaacacugaugcuucuggcucucaucgccguguugaccggugggguaacucuguuuuucuuaaguggccguggacuaggcaaaacgagcauugggcugcucugugugauggcauccucuguccuucuguggauggcuagcguggagccccauuggaucgccgcauccauaaucuuggaauuuuuccugaugguucuccugauuccugagcccgacagacagaggaccccacaggauaaccaacuugccuacguggucaucggacuccuguuuaugauuuugacaguagcugcgaaugagaugggucuguuagaaacuaccaagaaggaccuaggcaucgggcacguggccguugagaaccaccaucacgcagcuaugcuggauguggaccuccauccugccucagccuggacacuuuacgcagucgcuaccacuauaauuacacccaugaugcgccacacgaucgaaaacaccacugccaauauuucucugacagcgaucgcuaaccaggccgcaauauugaugggacuggauaaaggcuggccaaucaguaagauggacauuggugugccucuccuggcccuugggugcuauucgcaggucaauccguuaacccugaccgcugcagugcucauguugguugcccauuacgcgaucauuggccccggacugcaagcuaaagccacacgggaggcacagaagcgaacugccgcuggcaucaugaaaaacccaacgguggaugggauaguagccauugaccuagauccuguggucuaugacgcaaaguucgaaaagcagcugggacagaucaugcuccuuauccuguguaccagccaaauuuugcugaugagaacaacuugggcucucugcgaguccaucacccuggccacaggccccuuaaccacucuuugggaggguucuccagggaaauuuuggaauacgacaauagcgguuucaauggccaacauuuucaggggaagcuaccuggcaggcgcuggucucgccuucucccuaaugaagagucugggcgggggacgccggggcaccggggcacagggagaaacuuugggcgagaaauggaagagacagcugaaucagcucucuaaaagcgaauuuaacaccuauaagcguucagguaucauggagguggacagguccgaagcuaaggaggggcuuaaacggggagagacaacuaagcacgccgucagucgcggcaccgccaaacugcgaugguucguggaaagaaauuugguaaagccugaggguaaagugauugaucugggcugugggaggggaggcuggagcuacuauugcgcggggcucaagaagguuacagaagugaaaggauacacgaagggcggucccgggcacgaggaaccgaucccaauggcuaccuacggauggaacuuagucaaacugcauucuggcaaggacguguuuuucauaccucccgagaaaugugauacucuucugugcgacaucggcgaguccucaccaaaucccacaauugaagaggggcggacccuacgcguccucaagaugguggaaccuuggcugagaggaaaccaauuuuguaucaaaauuuugaauccguauaugcccagcguuguagagacucuggagcagaugcagaggaagcacgguggcaugcucgugcgaaacccacuuucgagaaauucuacacaugaaauguacugggucaguugcgggaccggaaacaucguguccgcaguuaauaugacgagccguaugcuguuaaacagauucaccauggcccaccgcaagccuacauaugagagggauguggaccugggcgcugguacucggcacgucgccguggaacccgagguagcaaacuuggauauuaucgggcagagaauagaaaauauuaaacaugagcacaagucaaccuggcauuacgacgaggauaacccuuauaaaacaugggccuaccacggauccuaugaagugaagccaucuggcagcgcuaguuccaugguuaauggcgucgugaaacuccugacuaagcccugggacgugaucccuauggucacccaaaucgcgaugacagauaccacuccauuugggcagcagcgcguuuucaaggagaaaguggacacgaggacacccaaggccaaacgaggaaccgcacaaauuauggaaguaacugcuaaguggcuaugggguuuucuuagccggaacaaaaagccgagaauauguaccagggaggaguucacacgcaaggugcguucuaaugccgcaaucggcgccgucuuuguggacgagaaccaguggaacucagcuaaagaggccguugaagaugagcgguucugggaccuggugcauagagaaagggagcuccacaagcaggggaaaugcgcgacgugcgucuacaacaugaugggaaagcgcgagaagaagcugggcgaguuugguaaggcaaaagggagucgagccauuugguacaugugguugggagcucgguuccuggaguucgaagcccucggcuuuaugaaugaggaucacugguucuccagagaaaacagccuuucuggcguggagggggagggacugcauaaguuagguuauauccugagggacauuucgaaaaucccuggcgggaauauguacgcagaugacaccgcuggaugggauacucgcauaacagaagacgauuugcagaacgaggccaagaucaccgacauuauggaaccagagcacgcucuccuggccaaaucaaucuuuaagcuaacuuaucaaaauaaaguaguuagagugcagcggcccgcaaagaacggcacagucauggaugugauuagcaggcgugaccagcgagguuccggacaggugggaaccuacggccuuaauacauucacuaacauggaagcgcaacugauccgccagauggagagugagggcauauuuucuccuagcgaacucgagaccccaaaccuggccgaaagagcuuuggauugguuagagaaguauggggucgaacggcugaaaaggauggccauuuccggagacgacuguguugugaagcccaucgaugaccgcuucgcaacggcucucaccgcccuuaaugauauggguaaaguaagaaaggacaucccgcagugggagccuucaaaaggcuggaacgauuggcagcaagugcccuuuugcagucaucacuuccaccagcugauuaugaaggacgggcgggagauagucgugccauguaggaaucaggaugagcuaguuggacgagcacgugugucucagggcgccgguuggagccugagagagacagcgugccucgggaaguccuacgcucaaauguggcaguugauguauuuucaucgccgggaccugaggcuugccgcaaacgccaucuguucagcugucccuguggauuggauucccacuagcagaaccacauggucuauccacgcccaucaccaguggaugacuaccgaagacaugcuguccguauggaaucgcguuuggauugaggaaaacccauggauggaggauaaaacgcauaucaguagcuggggagacgugcccuaccucggcaagcgggaggaccaauggugcggcucguuaauagggcugacagcaagggcuaccugggccacuaauauccaggucgcgauuaaccaggugcgaagauugaucggaaaugaaaacuaccuggauuauaugacauccaugaaacgguucaagaaugagucugacccugaaggugcucucugguga

SEQ ID NO: 13699 - RNA, 9879 nt, Artificial Sequence
  derived and/or modified CDS sequence (opt3) from DENV-1__FJ461336__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaacaugugcacauugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaaacagagauuuuguggagggucuuagcggcgccacauggguagacguuguguuggagcacgggaguugugucaccacuauggcgaaggauaaacccacacuggacaucgaacuacucaagaccgaggugacgaauccugcagugcugaggaaacuuugcauugaagccaagaucuccaacaccacaacugauucucgguguccaacccaaggagaggcuacacuggucgaggaacaagacgccaauuucguuugccgccgaacuuuuguggauagaggcugggguaacggguguggauuguucggcaaaggcagccucauaaccugcgcaaaguuuaagugcguaacaaaacuggaggggaagauugugcaguacgaaaauuuaaaauauuccgucaucgugaccguucacacuggagaccagcaucaaguggguaacgagucaacggaacacggcacaaccgcuacuauuacaccccaagccccuaccaccgagauccagcugacugacuacggggcgcucacacuugauuguaguccaaggacgggacuggacuucaaugaaauggucuugcuaaccaugaaggagaaaagcuggcuggugcauaagcagugguuucucgaucugccgcuucccuggacuucuggcgccuccacaucacaagagaccuggaaccggcaggaccuguugguaacauucaaaacugcacacgcuaagaagcaggaaguugugguccucgguagccaagagggggccaugcacaccgcucugacgggcgccaccgaaauccagacaaguggaacuaccacaauuuuugcaggccauuuaaaaugccgucugaagauggauaaacuaacucucaaggggaugucuuaugugauguguaccggauccuucaaacuggagaaggaagucgccgagacgcagcacgguacagugcuuguucagauaaaguacgagggcaccgacgcuccuugcaaaaucccauucagcacucaagaugaaaagggggugacacagaauggacgcuugauuaccgcgaaccccaucguaacugacaaagagaagccugucaauauagaagcagagccacccuuuggcgagucguauauugugaucggugccggggaaaaagcucugaagcucucuugguucaagaaaggcuccucaaucggaaagauguuugaggccaccgcaagaggcgccaggcggauggcuauucugggggauacagccugggacuucggaaguaucgguggcguucuuacgagcguggggaaacugguccaucagauuuuuggaaccgcauacggcguguuguucuccgguguaucuuggacuaugaagauagggaucggcgugcuccugacaugguuaggacugaacagccgaucaaccagucuauccaugacauguauugcgguuggccucgucacucuguaccuuggggugauggugcaggcugauagcggaugcgucaucaauuggaaaggccgcgaauugaagugugguucugggaucuuuguuaccaacgaggugcacacguggacagaacaauauaaguuccaggccgacucaccgaaaagacugagugcagccauuggaaaggcuugggaggagggcgugugcgguauaaggagcgccacccggcucgaaaacaucauguggaaacagauuuccaaugagcugaaccauaucuuacuggaaaaugacaugaaguuuacuguagucgugggcgauguugcagggauucuugcucagggcaagaagaugauccgcccucaacccauggaguacaaauauucuuggaagucguggggcaaggccaaaauaaucggggcggacgugcagaacaccacauucauuaucgauggaccaaauacuccugaaugucccgacgaucagagagccuggaacauuugggaggucgaggacuacggcuuugguaucuucaccacaaauauaugguugaagcucagggauagcuauacacaggugugcgaccaccgucugauguccgcugcaauuaaagauucaaaggccguucacgcugacaugggguacuggaucgaaagugagaaaaacgaaaccuggaagcuagcccgggcaucuuuuauugaggugaagacuuguaucuggccaaaaagccauacacugugguccaauggaguacucgaaucagagaugauaauccccaagauuuauggcgguccuaucagccaacacaacuaccgaccaggcuacuucacccagacugcggggccguggcaucugggaaaacuugaguuggauuucgaccugugcgaaggcacaaccgucgugguggaugagcacugcgggaauagaggacccucuuuaaggacgacuaccgucacaggcaagauuauccacgaaugguguugccgcuccuguacccucccuccacugcgguuuagaggugaggacgggugcugguauggaauggagauaaggcccguuaaagaaaaggaggaaaaccuugugaagaguaugguaagcgccggcucuggugagguggacuccuucucacugggcuugcucuguauuaguaucaugaucgaagaggucaugcgcagccgauggucgcggaaaaugcugaugacugggacacuagcuguguuuuuccugcucauuaugggacagcugaccuggaaugaucuuauccguuugugcauuaugguuggcgccaacgcauccgacagaauggggaugggaacaacuuaccuggcuuuaauggccaccuuuaagaugaggccuauguucgcagugggccuccuguuucgccggcuuacgucuagagagguccugcuacucacaauaggucugagcuugguggccucaguugaacugccaaauaguuuagaggaacucggggauggacuggcuaugggcaucaugauucuuaaacuguugaccgacuuccaaucccaucagcucugggcgacucugcuaucucugaccuuuaucaagacaacuuucagccuucacuaugccuggaaaaccauggcaauggugcucuccauugucucacuguuucccuugugucugagcacgacaagucagaagaccacuugguuaccgguacuccugggcucucuugggugcaagccucugacaauguucuugaucgcugagaacaaaauauggggaaggcgauccuggccacucaacgaagguaucauggccgugggcauuguuagcauccugcuaucgucacugcuuaagaaugaugugccccucgccgggccucugauugcuggaggcauguugaucgcauguuacgucauaucugguaguuccgccgacuuaagccuggagaaagcggcugaggugucuugggaagaggaagccgagcauagcggggcaucccacaacauucucguagaagugcaggaugacggaaccaugaagaucaaagaugaggagcgcgacgauacucugacaauccuucugaaggccaccuugcuagcugucucaggcguuuauccccugaguauuccagcaacgcucuuugugugguacuucuggcagaaaaagaagcagcggagcggcgugcugugggacacuccuucucccccagaagucgggagagccgugcuugaugacggaauauauaggaucaugcagcgugguuuacugggccgcucccagguugggguaggaguguuccaagagaaugucuuucauaccauguggcacgugacacggggcgcgguucucauguaccaggguaaaagauuggaaccgucaugggcuagugugaagaaagaccugauuagcuacgggggaggcuggaggcuccagggcuccuggaacaccggggaggagguccaggugaucgccguagaaccuggaaagaaucccaaaaacguccaaacagcaccagguacuuucaagacccccgagggcgaagugggggccauugcucuggauuuuaagccuggaacgucuggcucgccaaucguuaaucgagaggguaaaauaguggggcuuuauggaaacggcgucgugacaacuagcggcaccuacguuucagccaucgcacaggcuaaggccucccaggaagggccccugccugagauugaggacgaaguguuccggaaacgcaauuugacaaucauggaucuacacccgggaagugguaagaccagaagguaucugccagcgauuguccgggaggccaucaaacgaaagcucagaacuuuaauacuggcacccacccgcgugguagcuucugaaauggccgaggcucuuaagggcaugccuauuagguaccaaacaacggcagugaaaagcgaacauacugggaaggagaucguugaccugaugugccacgccaccuuuacaaugcgucucuuguccccaguccgggugcccaacuauaauaugaucauuauggaugaggcccauuucaccgacccuucaucuaucgcugcgagaggauacauaagcacuagggugggcaugggugaagcagccgcuauuuuuaugacagccaccccgcccgggagugucgaggcauucccacaguccaacgccguaauccaggaugaagaacgcgacauuccugaacgaagcuggaacucuggauaugaguggaucacggauuuucccggcaaaacugugugguucguuccaucaauaaaguccggcaacgacauugcuaauugucugaggaaaaaugggaagcgggugauccagcucaguaggaagacauuugauaccgaguaccagaaaaccaagaacaaugacugggacuacgucgugacuacagauaucagcgaaaugggagcgaacuuccgcgccgaccguguuauugauccuagacggugccugaaacccgugauccuuaaggacgguccagagagggucauucuagcaggcccgaugccugugaccguagcuucggccgcacagcgccgagggagaauaggacggaaucacaacaaagaaggcgaucaguauaucuacaugggucagccccugaauaacgacgaggaucaugcccacuggacagaggcuaagauguuguuagacaauauuaacacuccagaagggaucauccccgcccuguucgagccugaaagggagaagucugcggcaauugauggcgaauaucgccucagaggagaggccaggaaaacguuuguggagcugaugcggcguggcgaccuuccaguuuggcuguccuacaaggucgcuagcgaaggguuccaauauucagaucgccgauggugcuuugacggagagagaaauaaccaggugcucgaagagaauauggauguggaaauauggaccaaagagggugagaggaagaaauugcggccccgcuggcuggacgccagaacauacagugacccucuagcucugagggaguucaaggaguuugcagccggccggcgaucugucuccggggaucucauccuugaaauuggaaaacugccgcagcacuuaacucagagagcucaaaacgccuuggacaaucugguuaugcuccauaacagcgagcagggcggucgcgcauauaggcacgcgauggaggaacugccagauaccaucgagacacuuaugcugcucgccuugauugcugugcugaccgggggcguaacuuuauucuuucuaucaggacggggccuggggaagacgaguaucggacuccuuugugugauggccagcuccguccuguuguggauggcaucuguggaaccccauuggauagcugccagcaucauucuggaguucuuucucaugguucugcuuaucccugaacccgaccgucagagaaccccacaggauaaucaacucgcauacguggucauuggucuguuguucaugauccugacaguagccgcuaacgagaugggcuuacuagagacuaccaagaaagaccuggggauaggacacguggcgguugaaaaccaccaucacgccgcaaugcucgauguggaccuucauccugcuuccgccuggacacuguacgccgucgcaaccacuauuaucacacccaugaugaggcacacgauugagaauaccacugcuaacaucucauugacagccauagcgaaucaggcugccauccugaugggccucgauaaggguuggccaauuucuaaaauggacaucggggugccucugcuugcauuaggcugcuauagucaggucaacccgcugacccucaccgccgcuguguugaugcugguugcacauuacgccauuaucggacccggccuacaagcgaaggcuacacgcgaagcccagaaacggacugcagccgggauaaugaagaauccaacgguggauggaauuguagcuaucgaccuggauccuguggucuaugacgccaaguuugagaaacagcucggccagaucaugcuucugauuuuguguaccucgcaaauccugcucaugcgaacaacuugggcacugugcgaaagcauaaccuuagcuacagguccccuuaccacucugugggagggguccccaggaaaguucuggaacacgacaauugccguuucuauggcgaauaucuuuagaggcucauaccucgccggugcaggccuagcuuucagccugaugaaaucccuagggggaggcaggcgcgggaccggagcccagggcgagacucugggugaaaaguggaaacggcagcucaaccagcuuaguaagucugaguucaauaccuauaagagaagcgggauuauggaaguggaccguucagaggcaaaagaaggacugaagaggggcgagacaacuaaacacgcugucucccgggguaccgccaaguugcgcugguuuguggagcgaaaccugguaaaaccugaaggcaaggugaucgaucucggguguggaagaggcggguggaguuacuauugcgccggauuaaagaaaguuacagaggugaagggcuacacgaaaggugggcccggacacgaggaaccgauaccaauggcgaccuacggcuggaaucuggucaaacuucauagcggcaaagacguguucuuuaucccucccgaaaagugugauacucugcuaugcgacauuggggagucuuccccaaaccccacaaucgaggaaggaaggacccuccggguccugaaaaugguggagccuugguugcgcgguaaucaauucuguauuaagauccugaacccguauaugcccucaguuguagaaacucucgagcagaugcagagaaagcacggcgggaugcuugugaggaauccacugagccgaaacucgacacaugagauguacugggucucuugcggaaccggcaauauugugagugcuguuaacaugacgucccggauguuacugaaccguuuuaccauggcacacagaaaaccuacauaugaacgcgauguggacuugggugccgggacuaggcacgucgcuguggagcccgaaguagccaaucucgauaucauaggacagcggauugagaacaucaagcaugaacacaaaagcaccuggcauuacgacgaggauaauccuuauaagacaugggcauaccacggcucauaugaggugaaaccauccggcucugccagcaguaugguuaacggggucgugaagcugcuaacuaagcccugggacgugaucccuauggucacccaaauugcuaugacagauaccacuccauucggacagcagagaguuuuuaaagaaaagguggacacgcgcacacccaaagcgaagagggguaccgcccaaauaauggagguaacugcaaaauggcuuuggggcuuccugucccgaaauaagaagccgcggaucuguaccagagaagaguuuacaaggaaagugcgcagcaacgcugccauuggggcagucuucguggacgaaaaucaguggaacucugccaaggaggcuguugaggaugaacguuuuugggaccucgugcaucgggagagagaacugcacaaacagggaaagugcgccacgugcgucuacaauaugaugggcaaaagggagaagaaguugggugaguucgggaaagcgaagggaucacgcgcaaucugguacauguggcugggcgcccgauuucucgaguucgaggcucuuggcuucaugaacgaagaucacugguuuagucgggaaaauucccugagcgggguggaaggagaggguuuacauaaacugggcuauauuuugagagacaucucuaacauaccugggggaaauauguacgccgaugacaccgcaggcugggauacuaggaucacagaggacgaucuccagaacgaagcucgcauuaccgacaucauggagccagaacacgcccugcuagcuaagucgauuuucaaacuuacuuaucaaaauaagguaguuagagugcagcggcccgccaaaaacgguacagucauggaugugaucucaaggcgugaccagcgagggagcggacaggugggcaccuacggccugaacacauuuacuaauauggaggcacaacucauacgccagauggaauccgaggggauuuucaguccuucugagcuggaaaccccaaacuuggcggagagagucuuagauuggcuggaaaaguauggaguugagcggcucaagaggauggccaucagcggugacgacugugugguaaaacccaucgaugaccgcuuugcuacggcccuuaccgcacugaaugauaugggcaaggugagaaaagacauuccgcagugggaaccuuccaagggguggaacgauuggcagcaaguccccuucugcucacaucacuuucaccagcuaauaaugaaagacggacgggagaucgugguuccauguaggaaucaggaugagcuggugggccgagcucgugucagucagggugccggguggucucucagagaaacagcaugcuugggaaagagcuacgcccaaauguggcagcugauguauuuccaucgccgggaccuuaggcuggcggcuaacgccauuuguuccgcagugccuguagauuggauccccacuucaagaaccacauggagcauucacgcccaucaccaguggaugacuaccgaggacaugcucucuguuuggaaucgcguguggaucgaagagaacccauggauggaagauaagacgcauauauccaguuggggcgacguccccuacuuaggcaaacgggaggaccaauggugcgggagccugaucggauugacagcuagggccaccugggcaacuaauauucagguggcuaucaaccagguucgaagacugauugguaaugagaacuaccucgauuauaugacaucgaugaagcgguuuaaaaaugaauccgacccugagggcgcccuuugguga

SEQ ID NO: 13700 - RNA, 9879 nt, Artificial Sequence
  derived and/or modified CDS sequence (opt3) from DENV-1__FJ410266__SS-prME
agcgugaccaugcugcuaaugcuuaugcccacagcacuggcuuuccacuugacuacgcggggaggggaaccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaagcgccuaccagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaagaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggcauccuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggcuccggugagguggacucauuuagucuuggccuguuguguauuagcaucaugaucgaagaggucaugaggucgcgcugguccaagaaaaugcucaugaccgggacucuggcuguguuccuacugcucauuaugggacagcugacauggaacgaucuuauccgauugugcauuaugguuggcgccaaugcaucugaccggauggggaugggaaccacauaucuggcuuuaauagccacuuuuaagaugcguccuauguucgcagugggccuccuguuuagaaggcuuaccagccgcgagguccugcuacucacgaucggucugucauugguggccaguguugaacugccaaacuccuuagaggaacucggggauggacuggcuaugggcauuaugauccuuaaacuguugacagacuuccaaucucaccagcucugggcgacccugcucagcuuuacuuucauuaagaccacacugucccuucauuacgccuggaagacuauggcaauggugcucucaaucgucagccuguuucccuugugucugaguaccacgucucagaaaacaaccugguuaccgguacuccugggcucccuugggugcaagccucugacuauguucuugauagcugagaauaaaaucuggggaagaaagagcuggccacucaacgaagguauuauggccgugggcguugugucgauccugcuaucaucucugcuuaaaaacgaugucccccucgccgggccucugauugcuggaggcauguugaucgcauguuaugugauaagugguuccagcgccgacuuaucucuggagaaggcggcugagguaagcugggaagaggaagccgagcacuccggggcaucacauaauauucucguggaaguccaggaugacggaacaaugaaaaucaaggaugaggagagagacgauacccugacuauccuucugaaggccacauugcuagcuguuaguggcguguacccccugagcauuccagcaacccucuuuguguggcacuucuggcagaagaagaaacagaggucuggcguccugugggacacgccuucacccccagaaguggagcgagccguucuugaugacgggauauaucgcaucaugcagcggggauuacuggguagaagccagguaggcgugggggucuuccaagaaaacguguuucacacuauguggcauguuaccaggggagcggugcucauguaccagggcaagcguuuggagccgaguugggcuagcgucaaaaaggaccugauuuccuauggugggggauggcgccuccagggcucuuggaauacaggcgaggaagugcagguaaucgccgucgagccugggaagaaccccaaaaaugugcaaaccgcaccaggaacauucaagacucccgaaggugagguuggcgccauugcucuggauuuuaaaccugggaccucgggaagcccaaucgugaaccgggaaggcaagauagucggucuuuacgggaauggagugguuacgacaucaggcacuuacguguccgccaucgcacaggcuaaagccagucaggagggcccccugccugagauugaagacgaggucuucagaaagaggaacuugaccaucauggaucuacacccggggucuggaaagacacgacgguaucugccagcgauugugcgcgaagccaucaaaagaaagcucaggaccuuaauacuggcacccacucggguaguggcuagcgagauggccgaagcucuuaaagguaugccuauucgauaccaaaccacagcaguuaaguccgagcauacgggcaaagagaucgucgaccugaugugccacgccacuuuuaccaugagacucuugucaccagugcgcgugcccaauuauaacaugaucauuauggaugaagcccauuucacagacccuucuagcaucgcugcgaggggguacauaaguacccgugucggaaugggcgaggcagccgcuauuuuuaugacugccacaccgcccgguuccguagaagcauucccacagagcaaugccgugauccaggaugaggaacgggacauuccugagagaucuuggaacucaggguaugaguggaucaccgauuuucccggaaagacgguuugguucgugccauccauaaagaguggcaaugacauugcuaacugucugaggaaaaauggcaagcgcgucauccagcucagccgaaaaacuuuugauacagaauaccaaaagaccaaaaacaacgacugggacuaugugguuaccacugauaucucggagaugggggcgaauuucagagccgaccgggugauugauccuaggcgcugccugaagcccgucauccuuaaggacggaccagaacgugugauucuagcagguccgaugccuguaacaguggcuucugccgcacagagacggggcaggauagggcgcaaccacaauaaagagggagaucaguacaucuacaugggccagccccugaacaaugacgaggaucacgcccauuggaccgaagcuaagauguuguuagacaacauuaauacaccagaggguaucauccccgcccuguucgaaccugagcgagaaaaauccgcggcaauugauggggaguauagacuccggggcgaggccaggaagacuuuuguugaacugaugcgcagaggagaccuuccagucuggcugagcuacaaaguggcuucagagggcuuccaauauagugauaggcgguggugcuuugacggggaacguaacaaucaggugcucgaggaaaacauggaugucgagauauggacgaaggagggagaacgcaaaaaguugcgacccagauggcuggacgccaggaccuacucugacccucuagcucugcgggaguucaaggaauuugcagccggucgcagauccguuagcggcgaucucauccuugagauugggaaacugccgcagcacuuaacacagagggcucaaaaugccuuggacaaccuggugaugcuccauaauucagaacagggaggccgggcauaucgacacgcgauggaggagcugccagauacuaucgaaacccuuaugcugcucgccuugauugcuguacugacagguggggugaccuuauucuuucuaaguggcagaggacugggcaagacuagcaucgggcuccuuugugucauggccuccucugugcuguuguggauggcaagcguugagccccacuggauagcugccuccaucauucuggaguucuuucucauggugcugcuuaucccugagcccgaccgccagaggacgccacaggauaaccaacucgcauacgucguaauuggacuguuguucaugauccugaccguggccgcuaaugagauggguuuacuagaaacaacuaaaaaggaccugggcauagggcauguugcgguggagaaccaccaucacgccaccaugcucgaugucgaccuucauccugcaucagcuuggacacuguaugccguggccaccacuauuaucacacccaugaugcggcacacgauugaaaacaccacugcaaauaucucuuugacagcuauagccaaccaggcggcuauccugaugggacucgauaaaggcuggccaauuaguaagauggacaucggugucccucugcuugccuuagggugcuacagccaggugaauccgcugacccucaccgcagccguuuugaugcugguggcucacuacgcaauuaucggccccggacuacaagccaaggcgacacgugaggcucagaaaagaacugccgcaggcauaaugaagaacccaacgguagaugggauuguggccaucgaccuggauccugucguuuaugacgcuaaauuugaaaagcagcucggacagaucaugcuucugauuuuguguaccagccaaauccugcucaugaggacaacuugggcccugugcgaguccauaaccuuagcaacaggcccccuuaccacucugugggaggguucuccagggaaauucuggaauacgacaauugcugugucaauggccaacaucuuucgcggaagcuaccucgcgggcgccggucuagcauucucccugaugaagaguuugggcgggggacggcgaggcaccggggcucagggagaaacucugggcgagaaguggaaaagacagcucaaucagcuuucuaagagcgaguucaacaccuauaaaaggucagguauuauggaggucgaccgcuccgaagccaaggaggggcugaaacggggagagacaacuagacaugcagugagucguggcaccgcuaaguugaggugguuuguagaacggaaucuggugaagccugaggguaaaguuaucgaucucggcugugggcgcggaggcuggagcuacuauugcgccggguuaaagaaagugacagaagucaagggauacacgaaaggcggucccgggcacgaggaaccgauaccaauggccaccuauggauggaaccuggugaaacuucauucuggcaaagacgucuucuuuacuccucccgagaagugugauacacugcuaugcgacaucggcgaguccucaccaaaucccaccauugaagaggggcgaacucucagagugcugaagaugguugaaccuugguugaggggaaaccaauucuguaucaaaauucugaauccguacaugcccagcguaguggagacacucgagcagaugcagcggaagcacgguggcaugcuuguccgcaacccacugucgagaaauucuacccacgaaauguacugggugaguugcgggacgggaaacaucguuuccgcggugaauaugaccagcaggauguuacugaaccgauuuacaauggcucaucggaaaccuacuuaugagcgugaugucgacuugggcgcagguaccagacacguggccguagaacccgagguggcuaaccucgauauuaucgggcagcgcauagaaaauauuaagcaugagcacaaaucaacauggcauuacgacgaggauaacccuuauaagacuugggccuaccacggauccuaugaaguuaagccaucuggcagcgcaaguuccauggucaauggcguggugaaacugcuaaccaagcccugggacgucaucccuaugguuacacaaaucgccaugaccgauacuacgccauucgggcagcagaggguguuuaaagagaagguagacacacggacccccaaagcuaagagaggaacugcgcaaauuauggaagugaccgccaaguggcuuugggguuuccugagccgcaacaaaaagccgaggauauguacacgagaggaauuuacgcggaaagucagaucuaaugcagcuaucggcgccguguucguugacgagaaccaguggaacucagcaaaggaggccguggaagaugagagguuuugggaccucguccagaaagaacgcgagcugcacaagcaggggaagugcgcuaccugcguguacaacaugaugggaaaacgugaaaagaaauugggcgaguucgguaaggccaaagggagucgggcgauuugguauauguggcugggagcaagauuucucgaguucgaagcccuuggcuucaugaaugaggaucauugguuuuccagggaaaacagccugucuggcguagagggggagggauuacacaagcuggguuacaucuugcgcgacauuucgaaaaucccuggcgggaauauguacgcugaugacacugccggaugggauacacgaauaaccgaagacgaucuccaaaacgaggcaaagaucacugacauuauggaaccagagcaugcucugcuagccacaucaaucuucaaacuuaccuaucagaauaaaguugugcggguccagagacccgcuaagaacggcacagugauggaugugauuagcaggcgcgaccagagagguuccgggcaagucggaacuuacggccugaauaccuuuacgaacauggaagcccagcucauccggcagauggagagugagggcauauuccugccuggggaauuggagaccccaaacuuagcagaaaggguucuggauuggcucgagaaauauggaguggaacgucuuaagcgaauggcgauuucuggugacgacuguguagugaaacccaucgaugaccgcuuugccacagcucugacugcccuaaaugauaugggcaaggucagaaaggacaucccgcagugggagccuagcaaaggguggaacgauuggcaacaggugcccuucugcucccaccacuuucaucagcugauuaugaaggacggacgggagauaguugugccauguaggaaucaggaugaacucgucggccgcgcaagagugucacaaggugcuggguggaguuugcgggagaccgccugccugggaaaaucuuacgcacagauguggcagcuuauguauuuccacaggcgagaccugcgucucgccgcgaacgcuaucuguagcgccguaccuguugauugggugcccacauccagaacuaccuggucaauucaugcacaccaucaauggaugacgacagaagacauguuaagcgucuggaaucgcguguggaucgaggaaaacccauggauggaggauaagacccacguuucuuccuggggcgacgugcccuaccugggcaaacgggaggaccaguggugcgggaguuugauuggacugacugccagggcuacaugggccagcaauauccaggucgcaauaaaccaggugagacgccucaucgguaaugaaaacuaucuugauuacaugaccucgaugaagcgguuuaagaaugagggcgacccugaaggggcucugugguga

SEQ ID NO: 13701 - RNA, 9879 nt, Artificial Sequence
  derived and/or modified CDS sequence (opt3) from DENV-1__FJ410269__SS-prME
uccgugaccaugcugcucaugcuuaugcccacagcacuggcuuuccacuugacuacgaggggaggggaaccucauaugaucgucaccaagcaggaaaggggaaaauccuuacuguuuaagacaucugccgguguuaauaugugcacuuuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguugacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuauucagaacggacgcuugaucacugcaaaucccauagugacagacaaagagaagccuguaaacauugaagccgagccacccuuuggcgagucuuauaucgucaucggugugggggaaaaagcucugaagcucuccugguucaagaaaggcucaaguauuggaaagauguuugaggccaccgcaagaggcgccaggcggauggcuauccugggggauacugccugggacuucggaagcauugguggcguuuuuaccuccguggggaaacuuguccaucagauauucggaacagcauacggcgugcuguuuucugguguaagcuggacgaugaagaucgggauuggcguguugcucaccuggcugggauuaaauucacgaaguacuucccugagcaugacauguaucgcgguuggccuagucacccucuaccugggggugauggugcaggcugauucuggaugcgucaucaacuggaaaggccgcgaacuuaagugugguucagggauuuucguuacaaaugaggugcacacuuggaccgaacaauauaaguuucaggccgacaguccgaaaagauugagcgcagccauaggaaaggcuugggaggagggcgugugcgguaucagguccguaacgcggcuggaaaacauuauguggaaacagaucucuaacgagcucaaucauauucuguuagaaaacgacaugaaguucacagucgugguuggcgauguggucgggauccuggcccagggcaagaagaugauacgcccucaacccauggagcacaaauacucguggaaaagcuggggcaaggcaaaaaucauuggggcugacgugcagaauaccacuuuuaucauugauggaccaaacaccccugaaugucccgacgaucagagagccuggaauaucugggagguugaggacuauggcuucgguauauuuacaacuaacauuuggcuuaaguugagggauuccuacacccaggcgugcgaccaccgucucaugucagccgcuaucaaagauaguaaggcagugcaugccgacaugggguauuggauugaaucugagaaaaaugaaacauggaagcuggcucgggccagcuucaucgagguaaagacguguauauggccaaaaucccacacccuauggucaaacggaguccuggaaagcgagauggugauccccaagauuuacggcgguccuaucucucaacauaauuaucgaccaggcuacuucacucagacagcagggccguggcaccucggaaaacuggagcuugauuuugacuugugcgaaggcaccacuguggucguugaugagcacugcgggaacagaggacccucccugaggacaaccacggugacuggcaagauuauccaugaaugguguugccgcaguuguaccuuaccuccacuccgguucaaaggugaggacgggugcugguacggaauggagauaagacccguaaaggaaaaggaggaaaaucuggugaaaagcauggucucugcgggcuccggugagguggacucauuuagucuuggccuguuguguauuagcaucaugaucgaagagguuaugaggucgcgcuggucccgaaagaugcucaugacagggacccuggccguguuccuacugcucauuaugggacagcugacuuggaacgaucuuauccgguugugcauuauggucggcgcuaaugccucugaccguauggggaugggaacaaccuaucuggcauuaauggcuacauuuaaaaugagaccuauguucgccgugggccuccuguuuaggcgccuuacuagccgggagguucugcuacucaccauaggucugucauugguggcaagugucgaaaucccaaacucccuggaggaauuaggggauggacucgccaugggcauuaugauccugaaacuucugacggacuuccaaucucaccaguugugggcuacacuccugagccuaaccuuuauuaaaacuacccugucccuucauuacgcguggaagacaauggccaugguacucucaaucgugagccuguuccccuugugucugaguacuaccucucagaagacgacaugguuaccgguucuccugggcucccuugggugcaaaccucugaccauguuuuugauagcagagaauaagaucuggggaagaaaaagcuggccacucaacgaagguauuauggcugugggcgucgugucgauccugcuaucaucucugcuuaagaacgauguaccccucgccgggccucugauugccggaggcauguugaucgcuuguuaugugauaagugguuccagcgcagacuuaucucuggagaaagccgcggaggucagcugggaagaggaagcugagcacuccggggccucacauaauauucucguugaagugcaggaugacggaacuaugaagaucaaagaugaggagagggacgauacacugaccauccuucugaaggcaacuuugcuagccgugaguggcgucuacccccugagcauuccagcuacacucuucgugugguauuuuuggcaaaagaaaaagcagcgaucuggcguucugugggacaccccuucacccccagaaguagagcgcgcagugcuugaugacgggauauaccggaucaugcagagaggauuacuggguaggagccaggucggcguggggguuuuccaagaaaacguguuccacacgauguggcacgucacucguggagccgugcucauguaucagggcaaacgcuuggagccgaguugggcgagcguaaagaaagaccugauuuccuacggugggggauggcggcuccagggcucuuggaauaccggcgaggaaguccaggugaucgcuguugagccugggaagaaccccaagaaugugcaaacagccccaggaaccuuuaaaacacccgaaggugaggucggcgcaauugcccuggauuucaagccugggacuucgggaagcccaaucgugaacagagaaggcaaaauaguuggucuuuacgggaauggaguggucaccacgucaggcacauauguguccgcuaucgcccaggcaaaggcuagucaggagggcccccugccugagauugaagacgagguauuuaggaaacgaaacuugacuaucauggaucuacauccggggucuggaaagacccggcgcuaccugccagccauugugagagaagcgaucaagaggaaacuccggacauuaauacuggcccccacccgaguugucgcaagcgagauggcugaagcccuuaaggguaugccuauuagauaucaaacuaccgcugugaaauccgagcacacaggcaaggagaucguggaccugaugugccaugcaacguucacuaugcgccucuugucaccagucaggguacccaauuacaacaugaucauuauggaugaagcccacuuuaccgacccuucuagcaucgccgcucguggguauauaaguacacgggugggaaugggcgaggcggcagccauuuucaugaccgcuacuccgcccgguuccguugaagccuuuccacagagcaaugcagugauccaggaugaggaaagagacauuccugagaggucuuggaacucaggguacgaguggaucacagauuuccccggaaaaaccgucugguuugugccauccauaaagaguggcaaugacauugccaacugucugcgcaagaauggcaaacgaguuauccagcucagcagaaagacguucgauacugaauaucagaaaaccaagaacaacgacugggacuacguggucaccaccgauaucucggagaugggggcuaauuuucgggcggacagggugauugauccucgccguugccugaaacccguaauccuuaaggacggaccagaaagagugauucuagccgguccgaugccuguuacugucgcaucugcugcccagcggaggggccgcauagggcgaaaccauaauaaggagggagaucaguacaucuauaugggccagccccugaacaaugacgaggaucacgcacacuggacagaagccaaaauguuguuagacaacauuaauaccccagaggguaucauccccgcucuguucgaaccugagagagaaaaguccgccgcgauugauggggaguaccggcucaggggcgaggcacgcaaaacauucguggaacugaugagaaggggagaccuuccaguguggcugagcuauaaggucgccucagagggcuuucaauacagugaucggcguuggugcuucgacggggaacgcaacaaucagguucucgaggaaaacauggauguggagauauggacuaaagagggagaacgaaagaaauugagacccagguggcuggacgcucggacguauucugacccucuagcccugcgcgaguuuaaggaguucgcugcagguagaagguccguaagcggcgaucucauccuugagauugggaagcugccgcagcauuuaacccagcgggcccaaaaugcuuuggacaaccuggugaugcuccacaauucagaacagggaggccgagccuacagacaugcaauggaggagcugccagauacaaucgaaacucuuaugcugcucgcguugauugccguccugaccgguggggugacauuauuuuuccuaaguggccgcggacugggcaaaaccagcaucgggcuccuuuguguuauggcuuccucugugcuguuguggauggccagcgucgagccccacuggauagcagcuuccaucauucuggaauuuuuccucaugguacugcuuaucccugagcccgacaggcagcggacuccacaggauaaccaacucgccuaugugguuauuggacuguuguuuaugauccugacgguggcagccaaugagauggguuuacuagaaaccacaaagaaagaccugggcauagggcacgucgcuguggagaaccaucaccaugcgacuaugcucgaugucgaccuucacccugccucagcauggacccuguacgcuguggccacaaccauuaucacucccaugaugcgucauacaauugaaaacacgaccgccaauaucucuuugacugcaauagcuaaccaggccgcgauccugaugggacucgauaagggcuggccaauuaguaaaauggacaucgguguuccucugcuugcuuuagggugcuacagccaggugaauccgcugacacucaccgccgcaguauugaugcugguggcccacuaugcuauuaucggccccggacuacaagcaaaggccaccagagaggcgcagaagaggacagcugccggcauaaugaaaaacccaacugucgaugggauuguugcaaucgaccuggauccuguggucuacgacgccaaguucgaaaaacagcucggacagaucaugcuucugauuuuguguacgagccaaauccugcucaugcgcaccacaugggcucugugcgaguccauaacuuuagccaccggcccccuuacaacccugugggaggguucuccagggaaguuuuggaauacuacgauugcagugucaauggcuaacaucuuccggggaagcuaucucgccggcgcgggucuagccuuuucccugaugaaaaguuugggcgggggacgaagaggcacaggggcacagggagaaacccugggcgagaaguggaagaggcagcucaaucagcuuucuaaaagcgaguucaacauuuacaagcgcucagguaucauggagguagaccgguccgaagcuaaagaggggcugaagagaggagagacuacccgucacgccgugaguaggggcacagcaaaauugcggugguucguugaacgcaaucuggugaagccugaggguaaggucauagaucucggcugugggcgaggaggcuggagcuauuacugcgcugggcuaaagaaggugacugaagucaaaggauauaccaagggcggucccgggcaugaggaaccgaucccaauggccacauacggauggaaccuggugaaacuucacucuggcaaggacguauuuuucacgccucccgagaaaugugauacccugcuaugcgacauuggcgaguccucaccaaaucccacuaucgaagaggggagaacacucaggguacugaagaugguggaaccuugguugcggggaaaccaauuuuguauuaagauccugaauccguacaugcccagcgucguggagacccucgagcagaugcagcgcaaacaugguggcaugcuuguuagaaacccacugucgagaaauucuacucacgaaauguauugggugaguugcgggacaggaaacauugucuccgccgugaauaugaccagccgaauguuacugaaccgguucacgauggcgcaccguaagccuaccuacgagagagauguagacuugggcgcugguacacgccauguggcaguugaacccgaggucgccaaccucgauaucauagggcagaggauugaaaauaucaaacacgagcauaagucaacuuggcacuaugacgaggauaacccuuacaaaaccugggcuuaucauggauccuacgaagugaagccaucuggcagcgccaguuccauggugaauggcgucguuaagcugcuaacaaaacccugggacgugaucccuaugguaacucaaauugcaaugaccgauacaaccccauuugggcagcagcggguguucaaggagaaagucgacacuagaacgcccaaggccaaacgcggaacagcucaaauaauggaagugaccgcgagguggcuuugggguuuucugagccgaaacaagaagccgcggaucuguacuagagaggaguucaccaggaaaguucgcucuaaugccgcaauuggcgcuguguuugucgacgagaaccaguggaacucagccaaggaggcaguggaagaugagcguuucugggaccucguacagaaagaacgggagcugcacaagcaggggaaaugcgccacaugcguuuauaacaugaugggaaagagagaaaagaaauugggcgaguuugguaaggcuaaagggaguagggccaucugguacauguggcugggagcgcgcuuccucgaguuugaagcacuuggcuucaugaaugaggaucacugguucucccgagaaaacagccugucuggcguggagggggagggauuacauaagcuggguuacauuuugcgggacaucucgaaaauaccuggcgggaauauguaugccgaugacacggcuggaugggauaccagaaucacugaagacgaucuccaaaacgaggccaagauuacagacaucauggaaccagagcacgcacugcuagcuaccucaauuuuuaaacuuacuuaccagaauaaggucgugagggugcagcgccccgccaagaacggcacagucauggauguuaucagcagacgggaccagagggguuccgggcaagugggaaccuauggccugaauacauucacuaacauggaagcucagcucauacgucagauggagagugagggcauuuuucugccuucugaauuggagaccccaaacuuagccgaacgaguacuggauuggcucgagaaacaugggguggaacgccuuaagagaauggcaaucagcggagacgacugugucgugaaacccaucgaugaccgguucgcgacggcccugaccgcucuaaaugauauggguaagguuaggaaagacauuccgcagugggagccuuccaagggcuggaacgauuggcaacaggugcccuuuugcucacaccacuuccaucagcugauaaugaaggacgggcgcgagaucgucgugccauguagaaaucaggaugaacucguaggacgggccaggguuagucaaggcgcagguuggucuuugcgagagacagcuugccuggggaaaagcuacgcccagauguggcagcuuauguauuuucaccguagagaccugcgccucgcagccaacgcgauuuguuccgcugugccugucgauugggugcccacuucacggaccacauggagcauccaugcccaccaucaauggaugacuaccgaagacauguuaucuguuuggaauaggguguggauugaggaaaacccauggauggaggauaagacgcacgucuccaguuggggagacgugcccuaccugggcaaaagagaggaccaguggugcggcagcuugaucgggcugacagcacgcgccaccugggcuucgaauauacagguagccaucaaccaggugcggaggcucauuggaaaugaaaacuaucuugauuacaugacuuccaugaagcgauucaaaaaugagggugacccugaaggcgcacugugguga

SEQ ID NO: 13702 - RNA, 9879 nt, Artificial Sequence
  derived and/or modified CDS sequence (opt3) from DENV-1__FJ410273__SS-prME
agcgugaccaugcugcucaugcuuaugcccacagcacuggcuuuccacuugacuacgagaggaggggagccucauaugaucgucuccaagcaggaaaggggaaaaucuuuacuguuuaagaccucagccgguguuaauaugugcacacuaauugccauggaccucggcgagcugugugaagauacuaugaccuacaaaugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuagcaccgagauccagcugacagacuacggggcccucacccuugauuguucuccaaggacuggacuggacuucaacgaaauggucuugcuaacaaugaaggagaaauccuggcuggugcauaagcagugguuucucgaucugccgcuucccuggacgucaggcgcaagcaccagucaagagacuuggaaucggcaggaccuguugguaacauucaaaaccgcucacgccaagaagcaggaaguugugguccucgguucucaagagggggcuaugcacacagcccugacuggcgcaaccgaaauccagacguccggaaccacaacuauuuuugccggccauuuaaaaugccgucugaagauggauaaacuaacccucaaggggaugagcuaugugauguguacaggaucguucaaacuggagaaggaagucgcugagacucagcacgguaccgugcuuguucagauaaaguacgagggcacggacgcgccuugcaaaaucccauucucuacacaagaugaaaagggggugacccagaacggacgcuugauuacugcaaaucccaucguaacagacaaagagaagccugucaacauagaagccgagccacccuuuggcgaguccuauauugugaucggugcuggggaaaaagcccugaagcucucaugguucaagaaaggcaguagcaucggaaagauguuuguugcaaccgccagaggcgcuaggcggauggccauucugggggauacugcaugggacuucggauccaucgguggcguguuuaccucugucgggaaacuugugcaucagauuuucggaacagcguacggcguacuguuuagcggugugucauggacgaugaagauagggaucggcguuuugcucaccuggcugggauuaaauagucgauccacuagccugucuaugacauguauugcugucggccuagugacccucuaccugggggugaugguccaggccgauucaggaugcguuaucaacuggaaaggccgcgagcuuaagugugguagugggaucuucgugacaaaugaagugcacacuuggaccgagcaauauaaguuucaggcagacagcccgaaaagauuguccgccgcuauuggaaaggccugggaagagggcguaugcgguauaaggucugcaacgcggcuggagaacaucauguggaaacagauuucgaacgaacucaaucauauccuguuagagaacgacaugaaguucacagucgugguuggcgauguggcugggauucugacccagggcaagaaaaugauccgcccucaacccauggaauacaaauauagcuggaaguccuggggcaaggccaaaauaaucggggcggacguccagaauacuaccuuuauuaucgauggaccaaacacaccugagugucccgacgaucagagagccuggaauauuugggaaguggaggacuacggcuucgguaucuuuacuaccaacauauggcuuaaguugagggauucauauacacagguuugcgaccaccgucucaugagugcugcaauuaaagauucuaaggccgugcacgcugacaugggguacuggaucgagagcgagaagaaugagacguggaagcuggcccgggcauccuucauugaaguaaagaccuguaucuggccaaaaucacauacucuauggagcaacggaguccuggagucugaaaugauaauccccaagauuuauggcgguccuaucucccaacacaauuaccgaccaggcuacuucacacagaccgcggggccguggcaucucggaaaacuggagcuugauuuuaacuugugcgagggcacuacagugguggucgacgaacacugcgggaauagaggacccagucugaggaccacgacuguuaccggcaagauuauccacgagugguguugccgcagcuguacauuaccuccacuccgguucaaaggugaagaugggugcugguauggaauggagauaagacccgugaaggagaaggaagagaaccugguaaaaucuaugguguccgccggcucaggugaagucgacaguuuuagccuuggccuguuguguauuucgaucaugaucgaggaagugaugaggucccgcuggucucgaaagaugcucaugaccgggacucuggcuguuuucuuucuacugauuaugggacagcucacauggaaugaccugauccggcuuugcauuauggugggcgccaacgcaagcgaucguauggggaugggaaccacauacuuggcucugauggccacuuucaaaaugagaccuauguuagcagucggccuccuguuuaggcgccuuaccucacgggaggugcugcuacucacgauaggucugaguuugguugccuccguggagcugccaaauucuuuagaagaacucggggacggacuggcuaugggcaucaugauucuuaagcuguugacagauuuccaaagccaucagcucugggcgacccugcuaucccugacuuuuaucaaaaccacauauucacuucacuacgccuggaagacuauggcaaugguccucagcauuguaagucuguuccccuugugucugucuaccacgucccagaagacaaccugguuaccggugcuccugggcagccuugggugcaaaccucugacuauguuuuugaucgcugaaaacaagauauggggaagaaaaucguggccacucaacgaggguaucauggccguuggcauugugucaauccugcuaucuagucugcuuaagaaugacgucccccucgccgggccucugauugcuggaggcauguugaucgcauguuaugugauauccgguagcucugccgauuuaagccuggaaaaagcggcugagguauccugggaggaagaggccgaacauucaggggcaagucacaacauucucguggagguccaggacgauggaacaaugaagaucaaagacgaagagagggaugacacccugacuauccuucugaaggccacauugcuagcuguuagcggcguguacccccugucuauuccagcaacccucuucgugugguauuuuuggcaaaagaaaaagcagcgauccggcguccugugggauacgccuucacccccagagguggaacgcgccguucuugacgaugggauauaccggaucaugcagagaggauuacuggguaggagucagguaggcgugggggucuuccaagagaauguguuccauacuauguggcacguuacccguggagcggugcucauguaccagggcaaacgcuuggaaccgagcugggcuuccgucaagaaagaccugauuucuuauggugggggauggcggcuccagggcucguggaacacaggcgaggaggugcagguaaucgccgucgaaccugggaagaaucccaagaacgugcaaaccgcaccaggaacauuuaaaacuagcgagggugaaguuggcgccauugcucuggacuucaagcccgggaccucaggauccccuaucgugaauagagagggcaaaauagucggucuuuacgggaacggagugguuacgacaaguggcacuuaugugucugccaucgcacaggcuaaggccagccaggaaggcccacugcccgagauugagaaugaagucuuuaggaaacgaaacuugaccaucauggaucuacacccuggguccggaaagacacggcgcuaccugccggcgauugugagagaggccaucaagaggaaacuccggaccuuaauacuggcaccaacucgaguaguggcuucagaaauggccgaggcucuuaaggguaugcccauuagauaucaaaccacagcaguuaaaucugaacauacgggcaaggagaucgucgaccugaugugccacgccacuuucaccaugcgccucuugagcccugugagggugccaaauuacaacaugaucauuauggaugaggcccauuuuacagaccccaguuccaucgcugcgcguggguauauaagcacccgggucggaaugggcgaagcagccgcuauuuucaugacugccacaccuccggguucuguagaggcauuuccccagucaaaugccgugauccaggaugaagagagagacauuccagaaagguccuggaacaguggguacgaguggaucaccgauuucccuggaaaaacgguuugguuugugcccagcauaaagucgggcaaugacauugcuaacugucugcgcaagaacggcaaacgagucauccagcucucuagaaagacuuucgauacagaguaccagaaaaccaagaauaacgacugggauuaugugguuaccacugacaucuccgaaaugggggcgaauuuucgggccgacagggugauugauccacgccguugccugaaaccugucauccuuaaggacggacccgagagagugauucuagcagguccaaugccgguaacaguggcuagcgccgcacagcggaggggccgcauagggcgaaaccacaauaaggaaggagaucaguacaucuauaugggccagccucugaacaaugacgaggaucaugcccacuggaccgaggcuaaaauguuguuagacaacauuaauacacccgaagguaucaucccagcccuguucgagcccgaaagagagaagucagcggcaauugauggggaauaccggcucaggggcgaggcccgcaaaacuuucguugagcugaugagaaggggagaccuuccugucuggcugaguuauaagguggcuucugaaggcuuucaauacuccgaucggcguuggugcuucgacggggagcgcaacaaucaggugcucgaagagaacauggaugucgaaauauggacgaaagagggagagcgaaagaaauugagaccaagguggcuggacgcccggaccuauagcgauccccuagcucugcgcgaauuuaaggaguucgcagccgguagaaggucaguuaguggcgaccucauccuugaaauugggaagcugccucagcacuuaacacagcgggcucaaaaugccuuggacaaccuggugaugcuccauaauagcgagcagggaggccgagcauacagacacgcgauggaggaacugccggauacuaucgagacccuuaugcugcucgccuugauugcuguacugacagguggggugaccuuauuuuuccuauccggccgcggacugggcaaaacuucuaucgggcuccuuugugucauggccagcuccgugcuguuguggauggcaucaguugaaccacauuggauagcugccucuaucauucuggaguuuuuccucauggugcugcuuauccccgaaccugacaggcagcggacgccccaggauaaccaacucgcauacgucguaauuggacuguuguuuaugauccugaccguggccgcuaacgagauggguuuacuagagacaacuaagaaagaccugggcauagggcacguugcgguggaaaaucaccaucacgccgcaaugcucgaugucgaccuucauccagcuagugccuggacccuguaugccguggcaacaaccauuaucacuccuaugaugcgucacacaauugagaacacgaccgcuaauaucucguugacugccauagcgaaccaggcugccauccugaugggacucgauaagggcuggcccauuagcaaaauggacaucggugucccacugcuugcauuagggugcuacucccaggugaauccucugacacucaccgccgcuguuuugaugcugguggcacauuaugccauuaucggcccgggacuacaagcgaaggcuaccagagaagcccagaagaggacagcagccggcauaaugaaaaaccccacuguagaugggauuguggcuaucgaccuggauccagucguuuacgacgccaaguucgagaaacagcucggacagaucaugcuucugauuuuguguacgucucaaauccugcucaugcgcaccacaugggcacugugcgaaucaauaacuuuagcuaccggcccucuuacaacccugugggaggguagccccgggaaguuuuggaauacuacgauugccguguccauggcgaacaucuuccggggaaguuaucucgccggcgcaggucuagcuuuuucucugaugaagucauugggcgggggacgaagaggcacaggggcccagggagagacccugggcgaaaaguggaagaggcagcucaaucagcuuagcaaauccgaguucaacacuuacaagcgcagugguauuauggaagucgaucggagcgaggcaaaagaagggcugaagagaggagagaccacaaaacacgcugugucucguggcacugccaaguugaggugguucguagagcggaaucuggugaagccagaagguaaaguuaucgaccucggcugugggcgcggaggcugguccuauuacugcgccggguuaaagaaagugaccgaggucaagggauacacaaaaggcgguccugggcacgaggagcccauaccgauggcgacguauggauggaaccuggugaaacuucauucaggcaaagacgucuuuuucaucccaccugaaaagugugauacccugcuaugcgacauuggcgagagcucgcccaauccaacuaucgaggaagggcgaacacucagagugcugaagaugguugagcccugguugaggggaaaccaauuuuguauuaaaauccugaauccuuacaugccgucuguaguggaaacccucgagcagaugcagcggaagcacgguggcaugcuuguccgcaacccccugaguagaaauuccacucaugagauguauugggugagcugcgggacaggaaacauuguuucagcugugaacaugaccuccaggauguuacugaaucgauucacgauggcacaccggaaaccaaccuacgaacgugaugucgacuugggcgccgguacaagacacguggcuguagagccugaaguggccaaccucgauaucauagggcagcgcauugagaauaucaagcaugaacacaaaucuacuuggcauuaugacgaggauaaccccuacaagaccugggcauaucacggaagcuacgagguuaagccuaguggcuccgccagcucuauggucaauggcguggugaaacugcuaacaaagccaugggacgucauccccaugguuacucaaauugcuaugaccgauacaaccccuuuugggcagcagaggguguucaaagaaaagguagacacucggacgccaaaagcgaagagaggaacagcccaaauaauggaggugaccgcaaaguggcuuugggguuuucugucacgcaacaaaaagcccaggaucuguacucgagaagaguucacccggaaagucagaaguaaugcugccauuggcgcaguguuuguugaugaaaaccaguggaacuccgccaaggaggcuguggaggacgaaagguucugggaccucguccaucgcgagcgugaacugcacaaacaggggaagugcgccacaugcguguacaacaugaugggaaagcgggagaaaaaguugggcgaauuugguaaagcgaaggggagcagagcaaucugguauauguggcugggagccagguuccucgaguuugaggcucuuggcuucaugaaugaagaucacugguucucucgcgagaacucgcugucaggcguagaaggggagggauuacauaaacuggguuacauuuugcgagacaucagcaagauaccgggcgggaauauguaugccgaugacacggcaggaugggauacccggaucacugaggacgaucuccagaacgaagcuaaaauuacagacaucauggagccugaacacgcccugcuagcuaaguccauuuuuaaacuuaccuaccaaaauaaaguugugagaguccagaggccagccaagaacggcacugugauggaugugaucagucgcagagaccagcgggguucugggcaggucggaacauauggccugaacaccuucacaaauauggaggcacaacucauaaggcagauggaaagcgagggcauauuuucccccucagagcuggaaacuccuaacuuggcggggcguguuuuagauuggcuggagaaacauggaguggaacgacucaagcgcauggccaucaguggugacgauuguguagugaaaccaaucgacgacagauucgcuaccgcccuuacggcacugaaugauaugggcaagguccggaaggacauuccccagugggagccgucuaaaggguggaacgauuggcagcaagugccuuuuugcagccaccacuuccaucagcuaauaaugaaggacggaagggaaaucguugugcccugucgcaaucaggaugagcuggucggcagagcucgggugucccagggugccggguggucacucagggagaccgcaugcuugggaaaaagcuacgcccaaauguggcagcugauguauuuucaccgacgugaccuuagacuggcggcuaacgccauuuguucugcaguaccaguugauugggugccuacaucccgcacuaccuggaguauccaugcccaccaucaguggaugacaacugaagacaugcucagcgucuggaaucggguguggauugaggaaaaccccuggauggaggauaagacccacaucucguccuggggcgacguuccauacuuaggcaaaagggaagaucaauggugcgggucucugauaggauugacggcuagagccacaugggcaaccaauauccagguggcuauuaaccagguccgccggcugaucgguaaugagaacuaccucgacuauaugacuucaaugaagagguucaagaaugagagcgaccccgaaggcgcccuuugguga

SEQ ID NO: 13703 - RNA, 9879 nt, Artificial Sequence
  derived and/or modified CDS sequence (opt3) from DENV-1__FJ410276__SS-prME
agcgugaccauguuccugaugcucaugcccacggcccuugcuuuucaccugacuacgcggggaggggaaccucauaugaucgucuccaagcaggaaagggggaaaucuuuguuauucaagaccucagccgguguuaauaugugcacacugauugccauggaccuaggagaacucugugaagauacuaugaccuacaaaugcccacggauaacagagaccgaaccggacgauguggacuguuggugcaaugcgacugauacauggguaaccuaugggacguguagucaaacuggggagcaccgccgagacaagcguagcguggcucuggcaccccaugucggccuuggucuggagaccagaacagaaacuuggauguccucugagggggcauggaaacagauccagaggguggaaaccugggccuugcggcacccuggauuuacaguuauugcucucuuccuggcacaugccaucggcaccucgauuacgcagaagggcaucauauuuauccugcucauguuagugacuccaucaauggcuaugcgcugcgucgggauuggaagcagagauuucguggagggucugaguggcgccacauggguagacguugugcuugagcacggguccugugucaccacuauggcgaaggauaaacccacauuggacaucgaacugcuaaagaccgaggugacgaacccugcagugcucaggaaacugugcauugaagccaagaucucuaauaccacaacugauagccgguguccaacccaaggagaggcuacacuugucgaagaacaggacgccaacuuuguuugccgccgaacuuucguggauagaggcugggguaauggguguggacuguuuggcaaaggcuccuugauaaccugcgcaaaguucaagugcguaacaaaacucgaggggaagauugugcaguacgaaaaccugaaauauucagucaucgugaccguucacacuggagaccagcaucaaguggguaaugagaguacggaacacggcacaaccgcuacuauuacaccccaagccccuaccaccgagauccaguuaacugacuacggggcgcugacacucgauuguagcccaaggacgggacuugacuuuaacgaaaugguccuguugaccaugaaggagaaaucuuggcuagugcauaagcagugguuccuggaucucccgcugcccuggacuuccggcgccucaacaagccaagagaccuggaaucggcaggaccuucugguaacauuuaaaacugcacacgcuaagaagcaggaaguuguggucuuggguagucaagagggggccaugcacaccgcucucacgggcgccaccgaaauccagacaucuggaacuaccacaauuuucgcaggccaucugaaaugccguuuaaagauggauaaacugacucuaaaggggauguccuaugugauguguaccggcagcuucaaacucgagaaggaacuggccgagacgcagcacgguacaguccuugugcagauaaaguacgagggcaccgacgcuccuugcaaaaucccauuuuugacucaagaugaaaaggggguuacacagaacggacgccugauuaccgcgaaucccaucgugacugacaaagagaagccuguaaacauagaagcagagccacccuucggcgagucguauauugucaucggugccggggaaaaagcucucaagcugucuugguuuaagaaaggcuccucaaucggaaagauguucgaggccaccgcaagaggcgccaggcggauggcuauucuuggggauacagccugggacuuuggaaguaucgguggcguguucacgagcguugggaaacuggugcaucagauuuuuggaaccgcauacggcgucuuguucuccggugugucuuggacuaugaagauagggaucggcguacuccugacaugguuaggacugaauagccgaucaaccagucuauccaugacauguauugcggugggccucguuacucuguaccuuggggucauggugcaggcugauagcggaugcgugaucaacuggaaaggccgcgaauugaagugugguucugggaucuuugucaccaaugagguucacacguggacagaacaauauaaguuccaggccgacucaccgaaaagacugagugcagccauuggaaaggcuugggaggagggcgugugcgguauaaggagcgccacccggcucgaaaacaucauguggaaacagauuuccaacgagcugaaucauaucuuacuggaaaacgacaugaaguuuacugugguagucggcgauguggcagggauucuugcucagggcaaaaagaugauccgcccucaacccauggaguacaaauauucuuggaagucguggggcaaggccaaaauaaucggggcggacguucagaauaccacauucauuaucgauggaccaaacacuccugaaugucccgacgaucagagagccuggaauauuugggagguggaggacuacggcuuugguaucuucaccacaaacauaugguugaagcucagggauagcuauacgcaggucugcgaccaccgucugauguccgcugcaauuaaagauucaaaggccgugcacgcugacaugggguacuggaucgaaagugagaaaaaugaaaccuggaagcuagcccgggcaucuuucauugagguuaagacuuguaucuggccaaaaagccauacacugugguccaacggagugcucgaaucagagaugauaauccccaagauuuauggcgguccuaucagccaacacaauuaccgaccaggcuacuuuacccagacugcggggccguggcaucugggaaaacuugaguuggauuucgaccugugcgaaggcacaaccguagucguggaugagcacugcgggaacagaggacccucuuuaaggacgacuaccgugacaggcaagauuauccacgaaugguguugccgcuccuguacccucccuccacugcgguuuagaggugaggacgggugcugguauggaauggagauaaggcccgucaaagaaaaggaggaaaaucuuguuaagaguauggugagcgccggcucuggugagguagacuccuucucacugggcuugcucuguauuaguaucaugaucgaagaggugaugcgcagccgauggucgcggaaaaugcugaugacugggacacuagcugucuuuuuccugcucauuaugggacagcugaccuggaacgaucuuauccguuugugcauuauggugggcgccaaugcauccgacagaauggggaugggaacaacuuaccuggcuuuaauggccaccuuuaagaugaggccuauguucgcaguuggccuccuguuucgccggcuuacgucuagagaggugcugcuacucacaauaggucugagcuuggucgccucaguggaacugccaaacaguuuagaggaacucggggauggacuggcuaugggcaucaugauucuuaaacuguugaccgacuuccaaucccaucagcucugggcgacucugcuaucucugaccuuuaucaagacaacuuucagccuucacuaugccuggaaaaccauggcaaugguucucuccauugugucacuguuucccuugugucugagcacgacaagucagaagaccacuugguuaccgguccuccugggcucucuugggugcaagccucugacaauguucuugaucgcugagaauaaaauauggggaaggcgauccuggccacucaacgaagguaucauggccguaggcauugugagcauccugcuaucgucacugcuuaagaacgauguuccccucgccgggccucugauugcuggaggcauguugaucgcauguuacgugauaucugguaguuccgccgacuuaagccuggagaaagcggcugaggucucuugggaagaggaagccgagcauagcggggcaucccacaauauucucguggaaguacaggaugacggaaccaugaagaucaaagaugaggagcgcgacgauacucugacaauccuucugaaggccaccuugcuagcugugucaggcgucuauccccugaguauuccagcaacacucuucguuugguacuuuuggcagaaaaagaagcagcggagcggcgugcugugggacacuccuucucccccagaaguggagagagccguccuugaugacgggauauauaggaucaugcagcguggauuacugggucgcucccaggugggcguugggguauuccaagaaaacguguuucauaccauguggcacgucacacggggagcggugcucauguaccagggcaaaagauuggagccgucaugggcuaguguuaagaaagaccugauuagcuacggugggggauggaggcuccagggcuccuggaauaccggcgaggaagugcaggucaucgccguggagccugggaagaaccccaaaaauguacaaacagcaccaggaacuuucaagacccccgaaggugaggucggcgccauugcucuggauuuuaagccugggacgucuggaucgccaaucgugaaccgagaaggcaaaauaguuggucuuuaugggaauggaguggucacaacuagcggcaccuacgugucagccaucgcacaggcucgggccucccaggagggcccccugccugagauugaagacgagguuuuccgcaagagaaacuugacaaucauggaucuacacccggggaguggaaaaaccaggcgguaucugccagcgauugugcgagaagccaucaagagaaaacuccgcacuuuaauacuggcacccaccagggucguggcuucugagauggccgaagcucuuaaggguaugccuauucguuaccaaacaacggcaguaaagagcgagcauacuggcaaagagaucguggaccugaugugccacgccaccuuuacaaugcggcucuuguccccaguuagaguccccaauuauaacaugaucauuauggaugaagcccauuucaccgacccuucaucuaucgcugcgaggggguacauaagcacucgcgugggaaugggcgaggcagccgcuauuuuuaugacagccaccccgcccgguaguguggaagcauucccacaguccaaugccgucauccaggaugaggaacgagacauuccugagagaagcuggaacucuggguaugaguggaucacggauuuucccggaaagacuguaugguucgugccaucaauaaaauccggcaaugacauugcuaacugucugcggaagaauggcaaaaggguuauccagcucagucgcaagacauucgauaccgaauaccaaaagaccaaaaacaacgacugggacuacguggucacuacagauaucagcgagaugggggcgaauuuucgugccgacagagugauugauccucggaggugccugaagcccguuauccuuaaagacggaccagaacgcgugauucuagcagguccgaugccugucaccguggcuucggccgcacagcgaagaggccggauagggaggaaccacaauaaggagggagaucaguauaucuacaugggccagccccugaacaaugacgaggaucaugcccacuggacagaagcuaaaauguuguuagacaacauuaauacuccagaggguaucauccccgcccuguucgaaccugagcgcgaaaagucugcggcaauugauggggaguauagacucaggggcgaggcccggaagacguuuguagaacugaugcgucgcggagaccuuccaguguggcuguccuacaaaguugcuagcgagggcuuccaauauucagaucgaagauggugcuuugacggggaaaggaacaaucagguccucgaggaaaacauggauguggagauauggaccaaggagggagaacggaaaaaguugcgccccagauggcuggacgccaggacauacagugacccucuagcucugcgggaguucaaagaauuugcagccggucgaagaucuguguccggcgaucucauccuugagauugggaagcugccgcagcacuuaacucagcgcgcucaaaaugccuuggacaaccuggucaugcuccauaauagcgaacagggaggcagggcauaucggcacgcgauggaggagcugccagauaccaucgaaacacuuaugcugcucgccuugauugcuguucugaccgguggggugacuuuauucuuucuaucaggccguggacugggcaaaacgaguaucgggcuccuuuguguaauggccagcuccgugcuguuguggauggcaucugucgagccccauuggauagcugccagcaucauucuggaguucuuucucauggugcugcuuaucccugagcccgacagacagaggaccccacaggauaaccaacucgcauacguugugauuggacuguuguucaugauccugacagucgccgcuaaugagauggguuuacuagaaacuaccaagaaggaccugggcauagggcacguagcgguggagaaccaccaucacgccgcaaugcucgauguugaccuucauccugcuuccgccuggacacuguacgccguggcaaccacuauuaucacacccaugaugcgccacacgauugaaaacaccacugcuaauaucucauugacagccauagcgaaccaggcugccauccugaugggacucgauaaaggcuggccaauuucuaagauggacaucggugucccucugcuugcauuagggugcuauagucaggugaauccgcugacccucaccgccgcugucuugaugcugguggcacauuacgccauuaucggccccggacuacaagcgaaagcuacacgggaggcccagaagcgaacugcagccggcauaaugaaaaacccaacgguugaugggauuguggcuaucgaccuggauccuguaguguaugacgccaaguuugaaaagcagcucggacagaucaugcuucugauuuuguguaccucgcaaauccugcucaugagaacaacuugggcacugugcgagagcauaaccuuagcuacaggcccccuuaccacucugugggaggguuccccagggaaauucuggaauacgacaauugccgucucuauggcgaacaucuucaggggaucauaccucgccggcgcaggucuagcuuuuagccugaugaaguccuugggcgggggacgccggggcaccggggcccagggagaaacucugggcgagaaauggaagagacagcucaaucagcuuaguaaaucugaguucaacaccuauaagcguagcgguauuauggagguugacaggucagaagcaaaggaggggcugaaacggggagagacaacuaagcacgcugugucccgcggcaccgccaaauugcgaugguuugucgaaagaaaucuggugaagccugaggguaaaguaaucgaucucggcugugggaggggaggcuggaguuacuauugcgccggguuaaagaaggugacagaaguuaaaggauacacgaagggcggucccgggcacgaggaaccgauaccaauggcgaccuacggauggaaccuggugaaacuucauagcggcaaggacgucuucuuuaucccucccgagaaaugugauacucugcuaugcgacauuggcgagucuuccccaaaucccacaaucgaagaggggcggacccuccgcgugcugaagauggucgaaccuugguugagaggaaaccaauucuguauuaaaauccugaauccguauaugcccucagugguugagacucucgagcagaugcagaggaagcacgguggcaugcuuguacgaaacccacugagcagaaauucgacacaugaaauguacugggugucuugcgggaccggaaacauugucagugcugugaauaugacgucccguauguuacugaacagauuuaccauggcacaccgcaagccuacauaugagagggauguugacuugggcgccgguacucggcacguggcugucgaacccgagguggccaaccucgauaucauagggcagagaauugaaaauaucaaacaugagcacaagagcaccuggcauuacgacgaggauaacccuuauaaaacaugggcauaccacggaucauaugaaguaaagccauccggcucugccagcaguauggugaauggcguugucaaacugcuaacuaagcccugggacgugaucccuauggugacccaaauugcuaugacagauaccacuccauucgggcagcagcgcgucuuuaaggagaaaguugacacgaggacacccaaggcgaaacgaggaaccgcccaaauaauggaagugacugcaaaguggcuuugggguuuccugucccggaacaaaaagccgagaaucuguaccagggaggaauuuacacgcaagguacguagcaaugcugccauuggcgcaguguucgucgacgagaaccaguggaacucugccaaagaggcuguggaagaugagcgguuuugggaccucguucauagagaaagggagcugcacaagcaggggaaaugcgccacgugcguguacaacaugaugggaaagcgcgagaaaaaguugggcgaguucgguaaggcgaaagggucacgagcaaucugguacauguggcugggagcccgguuccucgaguuugaagcucuuggcuucaugaaugaggaucacugguuuaguagagaaaacucccugagcggcgucgagggggagggauuacauaagcuggguuauauuuugagggacaucucuaaaauaccuggcgggaauauguacgccgaugacaccgcaggaugggauacucgcaucacagaagacgaucuccagaacgaggcuagaauuaccgacaucauggaaccagagcacgcccugcuagcuaagucgauuuucaaacuuacuuaucaaaauaaggugguacggguucagaggcccgccaaaaacggcacagugauggaugucaucucacgucgagaccagcgcgguagcggacaggugggaaccuacggccugaauacauuuacuaacauggaagcacaacucauaagacagauggaguccgagggcauuuucaguccuucugaacuggagaccccaaacuuggcggaacggguguuagauuggcuggagaaguauggggucgaaaggcucaagcgcauggccaucagcggagacgacuguguugugaaacccaucgaugacagauuugcuacggcccuuaccgcacugaaugauauggguaagguacggaaagacauuccgcagugggagccuuccaagggcuggaacgauuggcagcaagugcccuucugcucacaucacuuucaccagcuaauaaugaaagacgggagggagaucgucgugccaugucgaaaucaggaugaacugguuggacgugcuagagugagucagggcgccgguuggucucuccgcgagacagcaugcuugggaaagagcuacgcccaaauguggcagcugauguauuuccaucggagggaccuuagacuggcggcuaacgccauuuguuccgcagucccuguggauuggauccccacuucacgcaccacauggagcauucacgcccaucaccaguggaugacuaccgaagacaugcucucuguauggaaucggguuuggaucgaggaaaacccauggauggaggauaagacgcauauauccaguuggggagacgugcccuacuuaggcaaaagggaggaccaauggugcggcagccugaucggguugacagcucgagccaccugggcaacuaauauucaggucgcuaucaaccaggugagacggcugauuggaaaugaaaacuaccucgauuauaugacaucgaugaagagguuuaaaaaugaguccgacccugaaggugcccuuugguga

SEQ ID NO: 13704 - RNA, 9879 nt, Artificial Sequence
  derived and/or modified CDS sequence (opt3) from DENV-1__FJ410278__SS-prME
agcgugaccaugcugcucaugcuuaugcccaccgcccuggcuuuccacuugacuacgagaggaggggaaccucauaugaucgucuccaagcaggaaaggggaaaaucuuuacuguuuaagaccucagccgguguuaauaugugcacacuaauugccauggaccucggagaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuaaucacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaagaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccaggcggccgggccguggcaucucggaaaacuggagcuugauuuugacuugugcgaaggcacuacaguagucguggaugagcacugcgggaacagaggacccucccugaggaccacgacugugaccggcaagaucauacacgaaugguguugccgcaguuguacauuaccuccacuccgguucagaggugaggacgggugcugguauggaauggagauuaggcccgucaaagaaaaggaggaaaaucugguuaagagcauggugucugcuggcuccggugagguagacucauuuagucuuggccuguuguguaucagcaucaugauugaagaggugaugcgcucgcgauggucccggcguaugcucaugaccgggacucuggccgucuucuuucuacugaucaugggacagcucacauggaacgaucugauuagacuuugcauaauggugggcgcaaaugcuucugacaggauggggaugggaaccacauacuuggcccugauggcaacuuucaaaaugcgcccuauguuugccguuggcuuacucuuccggagacugaccagcagggaggugcuucugcuaacgaucggucucucacuggucgcuaguguggaauugccaaacucccuggaggaauuaggggauggacucgcgaugggcauuaugauccugaaacuucugacagacuuucaaucucaucaguugugggccacccuccugagccuaacuuucauuaaaaccacauuuucccugcacuaugcauggaagacuauggcuaugguucuuucaaucgugagccucuucccccuguguuugaguaccacgucucagaaaacaaccuggcugccggucuuacucggcucccuggggugcaagccucuuacuauguuucugauagccgagaauaagaucuggggacgacgcagcuggccauugaacgaagguauuauggccguaggcaucgugucgauucuccugucaucucuacugaaaaacgauguuccccuugcugggccucucaucgcaggaggcaugcugauagccuguuacgugauuagugguuccagcgcggacuugucuuuagagaaggcugccgaggucagcugggaagaggaagcagagcauuccggggccucacacaauauccugguggaaguacaggaugacggaacaaugaaaaucaaggaugaggagcgggacgauacccucacuauucugcuuaaagcuacacuguuggcagugaguggcgucuauccccuaagcauaccagccacccuguucguuugguacuucuggcaaagaaagaaacagaggucuggcgugcucugggacacgccuucacccccagaaguggagcgugcgguccuggaugacgggaucuaucgcauuaugcagcggggacuuuuagguagaagccaggugggcguugggguauuucaagaaaacguguuccauacuauguggcacgucaccaggggagcugugcugauguaccagggcaagcgacucgagccgaguugggccagcguuaagaaagacuugaucuccuacggugggggauggcggcugcagggcucuuggaauacaggcgaggaagugcaggucauugcaguggagccugggaagaaccccaaaaauguacaaaccgccccaggaacauuuaagacucccgaaggugaggucggcgcuaucgcccucgauuucaaaccugggaccucgggaagcccaauagugaaccgcgaaggcaagaucguuggucuguaugggaauggaguggucacgacaucaggcacuuacguguccgcaauugcucaggccaaggcgagucaggagggcccccuuccugagaucgaagacgagguuuuuagaaaaaggaaccugaccauuauggauuugcacccggggucuggaaagacacggcgauaucuaccagccaucgugagagaagcaauaaaacgcaagcugaggacccucauuuuagcucccacucgugucguggccagcgagauggcugaagcacugaaagguaugccuauccgguaccaaaccacagccguaaaguccgagcauacgggcaaggagaucguggaccuuaugugccacgccacuuucaccaugagacugcucucaccaguuaggguccccaauuauaacaugauuaucauggaugaagcucauuuuacagacccuucuagcauagcggcacgcggguacauuaguacccgagugggaaugggcgaggccgcugccaucuucaugacugcaacaccgcccgguuccguggaagccuuuccacagagcaaugcugucauucaggaugaggaaagagacaucccugagcggucuuggaacucaggguaugaguggauaaccgauuuccccggaaaaacgguaugguuugugccauccauuaagaguggcaaugacaucgcgaacuguuugaggaaaaauggcaagcgcguuauccagcugagccguaaaacuuucgauacagaauaccaaaagaccaagaacaacgacugggacuacguggucaccacugauauuucggagaugggggccaauuucagagcagaccgggugaucgauccuaggcgcugccucaaacccguuauucugaaggacggaccagaacgagugauacuugcugguccgaugccugucacaguggccucugcagcccagagacggggcaggaucgggcgcaaccacaauaaagagggagaucaguauauuuacaugggccagccccuaaacaaugacgaggaucaugcucacuggaccgaagccaagaugcuguuggacaacaucaauacaccagaggguaucauucccgcguuauuugaaccugagagagaaaaauccgcagccauagauggggaguauaggcugcggggcgaggcucguaagacuuucguagaacucaugcgccgaggagaccugccaguguggcuuagcuacaagguugccucagagggcuuucaauauagugauagaagguggugcuucgacggggaacggaacaaucagguccuggaggaaaacauggauguggagaucuggacgaaagagggagaacgcaagaaacucagacccaggugguuggacgcucggaccuacucugacccucuggcacuacgagaguuuaaggaguucgccgcugguagacgcuccgugagcggcgaucugauucucgagaucgggaaacuuccgcagcaccugacacagagggcccaaaaugcauuagacaacuuggucaugcugcauaauucagaacagggaggccgggcguaucgucacgccauggaggagcucccagauacuauugaaacccugaugcuucuggcucucaucgccguuuugacagguggggugacccuguuuuucuuaaguggcagaggacuaggcaagacuagcauagggcugcucuguguaauggcauccucugugcuucuguggauggcuagcgucgagccccauuggaucgccgcauccauuaucuuggaauuuuuccugauggugcuccugauuccugagcccgacaggcagcgcacgccacaggauaaccaacuugccuacguugugaucggacuccuguuuaugauauugaccgucgcugcgaaugagaugggucuguuagaaacaacuaaaaaggaccuaggcauugggcacguagccguggagaaccaccaucacgcagcuaugcuggauguugaccuccauccugccucagccuggacccuuuacgcaguggcuacaaccaucauuacucccaugaugcggcacacaaucgaaaacacgaccgccaauauaucucugacugcgaucgcuaaccaggccgcaauuuugaugggacuggauaagggcuggccaaucaguaaaauggacauuggugucccucuccuggcccuugggugcuauagccaggugaauccguuaacacugaccgcugcaguccucauguugguggcccauuacgcgaucauaggccccggacugcaagcuaaggccacccgagaggcacagaaaagaacagccgcuggcauuaugaagaacccaacuguugaugggaucguggccaucgaccuagauccuguaguguaugacgcaaaauucgaaaagcagcugggacagauuaugcuccuuauccuguguacgagccaaauauugcugaugaggaccacaugggcucucugcgaguccauuacucuggccaccggccccuuaacaacccuuugggaggguucuccagggaaguuuuggaauacuacgaucgcggucucaauggccaacauuuuccgcggaagcuaccuggcaggcgcuggucucgccuucucccuaaugaaaagucugggcgggggacggagaggcacaggggcacagggagaaaccuugggcgagaaguggaaacgucagcugaaucagcucucuaagagcgaauuuaacacuuauaaaaggucagguaucauggagguugaccgguccgaagcuaaggaggggcuuaagcgcggagagaccacaaaacacgccgugagucgaggcacugccaagcugagaugguucgucgaaaggaauuuggugaaaccugaggguaagguaauagaucugggcugugggcggggaggcuggagcuacuauugcgcggggcucaaaaaggugaccgaaguuaagggauacacaaaaggcggucccgggcacgaggaaccgaucccaauggcuacguacggauggaacuuagugaagcugcauucuggcaaagacgucuuuuucauuccucccgagaagugugauacccuucugugcgacaucggcgaguccucaccaaaucccacuauugaagaggggcgcacacuaagagugcucaaaauggucgaaccuuggcugaggggaaaccaauuuuguaucaagauuuugaauccguauaugcccagcgugguugagacccuggagcagaugcagcgaaaacacgguggcaugcucguacggaacccacuuucgcguaauucuacucaugaaauguacugggugaguugcgggacaggaaacaucgucuccgcagugaauaugaccagcagaaugcuguuaaaccgcuucacgauggcccacaggaagccuaccuaugagcgggauguugaccugggcgcugguacaagacacguggccgucgaacccgagguggcaaacuuggauauaauugggcagcgcaucgaaaauaucaagcaugagcacaaaucaacuuggcauuacgacgaggauaacccuuauaagaccugggccuaccacggauccuaugaaguaaaaccaucuggcagcgcuaguuccauggugaauggcguugucaagcuccugacaaaacccugggacgugauuccuauggugacucaaauagcgaugaccgauacaaccccauuugggcagcagagggucuucaaggagaagguugacacucgaacgcccaaagccaagcggggaacagcacaaaucauggaagugaccgcuaaauggcuaugggguuuucuuagcagaaacaagaaaccgaggauuuguacucgcgaggaguucacccguaagguacggucuaaugccgcaaucggcgccguguuugucgacgagaaccaguggaacucagcuaaggaggccguggaagaugagagauucugggaccugguucauagggaacgcgagcuccacaaacaggggaagugcgcgacaugcguguacaacaugaugggaaaacgagaaaagaaacugggcgaguuugguaaggcaaaggggagucgggccauuugguacaugugguugggagcuagauuccuggaguucgaagcccucggcuuuaugaaugaggaucacugguucuccagggaaaacagccuuucuggcgucgagggggagggacugcauaaauuagguuauauccugcgcgacauaucgaagaucccuggcgggaauauguacgcagaugacacggcuggaugggauaccagaauuacugaagacgauuugcagaacgaggcccggaucacagacauuauggaaccagagcacgcucuccuggccaaaucaaucuuuaagcuaaccuaucaaaauaaagugguaaggguucagcgucccgcaaagaacggcacugugauggaugucauaagccgacgcgaccagagagguuccggacaggugggaacauacggccuuaauaccuucacaaacauggaagcgcaacugauucggcagauggagagugagggcaucuuuucuccuagcgaacucgagacuccaaaccuggccgaaaggguguuggauugguuagagaaauauggggucgaacgccugaagagaauggcuaucuccggagacgacuguguugugaagcccauugaugaccgguucgccaccgcacucacggcucuuaaugauauggguaaaguaaggaaggacauaccgcagugggagccuucaaaaggcuggaacgauuggcagcaagugcccuuuugcagucaucacuuccaccagcugaucaugaaggacgggcgagagauugucgugccaugucguaaucaggaugagcuaguuggcagagcccgcgugucucagggcgcagguuggagccugcgggagaccgccugccucgggaaauccuacgcgcaaauguggcaguugauguauuuucauaggagagaccugcgccuugcugccaacgcaaucuguucagccgucccuguggauuggauucccacaagccggacuaccuggucuauccacgcucaucaccaguggaugacaacugaagacaugcuguccguauggaauaggguuuggauagaggaaaacccauggauggaggauaagacccauaucaguagcuggggagacgugcccuaccucggcaagcgagaggaccaauggugcggcucguuaauugggcugacggccagagcaacaugggcuaccaauauccaggucgccauuaaccaggugcggagguugaucggaaaugaaaacuaccuggauuauaugacuuccaugaaacgcuucaagaaugagucugacccugaaggugcgcucugguga

SEQ ID NO: 13705 - RNA, 9879 nt, Artificial Sequence
  derived and/or modified CDS sequence (opt3) from DENV-1__FJ410279__SS-prME
agcgugaccaugcugcucaugcuuaugcccacagcacuggcuuuccacuugacuacgagaggaggggaaccucauaugaucgucuccaagcaggaaagggggaaaucuuuacuguuuaagaccucagccgguguuaauaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuuacaguagucgugggcgauguugcugggauuuuagcccagggcaagaagaugauccgcccucaacccauggaguacaaauauagcuggaaguccuggggcaaggcgaaaauaaucggggccgacgugcagaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaagauucuaaggcuguucacgccgacaugggguacuggaucgaaagcgagaaaaaugaaacauggaagcucgcacgggcguccuucauugaggugaagacguguaucuggccaaaaucacauacccuguggagcaacggaguacuagaaucugagaugauaauccccaagauuuauggcgguccuaucucccaacacaauuaccgaccaggcuacuuuacucagacagccgggccguggcaucugggaaaacucgagcuggauuucgaccuuugcgaaggcaccacugucgugguggaugagcacugcgggaacagaggacccaguuugaggacaaccacggucacuggcaagauuauccacgaaugguguugccgcagcuguacccugccuccauuacgguuuaaaggugaggacgggugcugguauggaauggagauaagacccguuaaggaaaaggaggaaaaucucgugaaaucuaugguauccgcuggcucaggugagguggacaguuucagccugggccuucuguguauuucgaucaugaucgaagaggucaugaggucccgcuggucucgaaagauguugaugacagggacccucgccguguuuuuccugcuaauuaugggacagcugacuuggaacgaucucauccggcugugcauuaugguuggcgcaaaugcuagcgaccguauggggaugggaacaaccuaccuugccuugauggcaacauuuaaaaugagaccuauguucgccgugggccuguuauuuaggcgccucacuucacgggagguccugcuucugaccauaggucuaagucucguggcuuccguugaacugccaaacucuuuggaggaacugggggauggauuagcgaugggcaucaugauucucaagcugcuuacggacuuccaaagccaucagcugugggccacauugcucucccugaccuuuaucaaaacuaccuucucacuacacuaugcauggaagacaauggcuauggugcugagcauugucagucuuuuuccccucugucugucuacuaccucccagaagacgacaugguugccgguacuguuaggcagccucgggugcaaaccucugaccauguuccuuaucgccgagaauaagauauggggaagaaaaucguggccacugaacgaagguaucauggccgugggcauuguuucaaucuugcucucuagucugcuaaagaacgaugugccccuggcugggccucuuauugcaggaggcaugcucaucgccuguuacgucauauccgguagcucugcggaccugagcuuggagaaagcugccgagguguccugggaagaggaagcagagcauucaggggccagucacaauauuuuaguagaagugcaggaugacggaacuaugaagaucaaagaugaggagagggacgauacacugaccauccuccugaaggcuacucuucuggcagucagcggcguuuaucccuugucuauuccagccacacuauuccugugguacuuuuggcaaaagaaaaagcagcgauccggcgugcucugggacaccccuucacccccagaaguggagcgcgcgguccuggaugacgggauauaucggaucaugcagagaggacuuuuagguaggagucaggugggcguugggguauuccaagaaaacguguuucauacgauguggcacgucacucguggagcugugcugauguaccagggcaaacgccucgagccgagcugggccuccguuaagaaagacuugauuucuuacggugggggauggcggcugcagggcucguggaauaccggcgaggaagugcaggucaucgcaguggagccugggaagaaccccaagaauguacaaacagccccaggaaccuucaaaacaagcgaaggugaggucggcgcuauugcccucgauuuuaagcccgggacuucaggauccccuaucgugaacagagaaggcaaaauaguuggucuguaugggaauggaguggucaccacgaguggcacauacgugucugcaaucgcucaggccaaggcgagccaggagggcccacuucccgagauugaagacgagguuuucaggaaacgaaaccugacuaucauggauuugcacccuggguccggaaagacccggcgcuaucuaccggccauugugagagaagcaaucaagaggaaacugcggacacucauauuagcuccaacccgagucguggccucagagauggcugaagcacugaaggguaugcccauuagauaccaaacuaccgccguaaaaucugagcauacaggcaaggagaucguggaccuuaugugccacgccacguuuacuaugcgccugcucagcccuguuagggucccaaauuauaacaugaucauuauggaugaagcucauuucaccgaccccaguuccaucgcggcacguggguacauaagcacacgggugggaaugggcgaggccgcugccauuuuuaugaccgcaacuccuccggguucuguggaagccuucccccagucaaaugcugucauccaggaugaggaaagagacauuccagagagguccuggaacaguggguaugaguggaucacagauuuuccuggaaaaaccguaugguucgugcccagcauaaagucgggcaaugacauugcgaacuguuugcgcaagaauggcaaacgaguuauccagcugucuagaaagacguucgauacugaauaccagaagaccaagaacaacgacugggacuacguggucaccaccgauaucuccgagaugggggccaauuuucgggcagacagggugauugauccacgccguugccucaaaccuguuauccugaaggacggacccgaaagagugauucuugcugguccaaugccggucacuguggccagcgcagcccagcggaggggccgcauagggcgaaaccacaauaaggagggagaucaguauaucuacaugggccagccucuaaacaaugacgaggaucaugcucacuggacagaagccaaaaugcuguuggacaacauuaauacccccgaggguaucaucccagcguuauucgaacccgagagagaaaagucagcagccauugauggggaguaucggcugaggggcgaggcucgcaaaacauuuguagaacucaugagaaggggagaccugccuguguggcuuaguuacaagguugccucugagggcuuccaauauuccgaucggcguuggugcuuugacggggaacgcaacaaucagguccuggaggaaaacauggauguggagauauggacuaaagagggagaacgaaagaaacucagaccaaggugguuggacgcucggguguacagcgacccccuggcacuacgcgaguucaaggaauuugccgcugguagaaggucagucaguggcgaucugauccucgagauugggaaacuuccucagcaccugacgcagcgggcccaaaaugcauuagacaacuugguuaugcugcauaauagcgaacagggaggccgagcguauagacacgccauggaggagcucccggauaccaucgaaacacugaugcuucuggcucucauugccguguugacuggugggguaacccuguucuuuuuauccggccgcggacuaggcaaaacaucuaucgggcugcucugugugauggcaagcuccguccuucuguggauggcuucaguggagccacauuggauagccgcaucuaucauuuuggaguucuuucugaugguucuccugauccccgagccugacaggcagcggacaccccaggauaaccaacuugccuacguggucauuggacuccuguucaugaucuugacuguagcugcgaaugagaugggucuguuagaaacgaccaagaaagaccuaggcauagggcacguggccguugagaaccaccaucacgcagcuaugcuggauguggaccuccauccagccagugccuggacacuuuacgcagucgcuacuaccauuaucacaccuaugaugcgucacaccauugaaaacacuacagccaauaucucgcugacggcgauagcuaaccaggccgcaaucuugaugggacuggauaagggcuggcccauuagcaaaauggacaucggugugccacuccuggcccuugggugcuauucccaggucaauccuuuaacccugacugcugcagugcucauguugguugcccauuacgcgauuaucggcccgggacugcaagcuaaggccacaagagaggcacagaagaggaccgccgcuggcauaaugaaaaaccccaccguggaugggauuguagccaucgaccuagauccaguggucuaugacgcaaaguuugaaaaacagcugggacagaucaugcuccuuauucuguguacaucucaaaucuugcugaugcgcacuacgugggcucucugcgagucaauaacccuggccacaggcccuuuaacuacccuuugggaggguagccccgggaaguucuggaauacaaccauugcgguuuccauggccaacaucuuccggggaaguuaccuggcaggcgcuggucucgccuuuucucuaaugaaaagccugggcgggggacgaagaggcacuggggcacagggagaaacguugggcgagaaguggaagaggcagcugaaucagcucucaaaauccgaguucaacacauauaagcgcagugguauuauggagguggaccggagcgaagcuaaagaggggcuuaagagaggagagaccacuaaacacgccgucucucguggcaccgccaagcugaggugguuuguggaacggaauuugguaaagccagaggguaaagugaucgaucugggcugugggcgcggaggcugguccuacuauugcgcggggcucaagaaaguuacagaagugaagggauacacuaaaggcgguccugggcacgaggaacccauaccgauggcuaccuacggauggaacuuagucaagcugcauucaggcaaagacguguucuuuaucccaccugagaagugugauacacuucugugcgacauuggcgagagcucgcccaauccaacgaucgaagaggggcgaacccuaagaguccucaagaugguggaacccuggcugaggggaaaccaauucuguauuaaaaucuugaauccuuauaugccgucuguuguagagacucuggagcagaugcagcggaagcacgguggcaugcucgugcgcaacccccuuaguagaaauuccacacaugaaauguacugggucagcugcgggaccggaaacauugugucagcaguuaauaugacuuccaggaugcuguuaaaccgauuuacaauggcccaccggaaaccaaccuaugagcgugauguggaccugggcgcugguacgagacacgucgccguggaaccugagguagcaaacuuggauaucauagggcagcgcauugaaaauaucaagcaugagcacaaaucuaccuggcauuacgacgaggauaaccccuauaagacaugggccuaccacggaagcuaugaagugaagccuaguggcuccgcuagcucuaugguuaauggcgucgugaaacuccugacuaagccaugggacgugauccccauggucacccaaauugcgaugacagauacuaccccuuucgggcagcagaggguuuuuaaagagaagguggacacacggaccccaaaagccaagagaggaacugcacaaauaauggaaguaacggcuaaguggcuaugggguuuccuuucacgcaacaaaaagcccaggaucuguacacgagaggaauuuacccggaaagugagaaguaaugccgcaauuggcgccgucuucguggacgagaaccaguggaacuccgcuaaggaggccguugaagaugagagguuuugggaccuggugcaucgcgaacgugagcuccacaaacaggggaagugcgcgacuugcgucuacaacaugaugggaaagcgggagaaaaagcugggcgaguucgguaaagcaaaggggagcagagccaucugguacaugugguugggagcuagguuccuggaguuugaagcccucggcuucaugaaugaggaucacugguuuucucgcgaaaacucgcuuucaggcguggagggggagggacugcauaaauuagguuauauucugcgagacaucagcaagauaccgggcgggaauauguacgcagaugacaccgcuggaugggauacacggaucacggaagacgauuugcagaacgaggccaaaauuaccgacaucauggaaccugagcacgcucuccuggccaaguccauuuucaagcuaacuuaucaaaauaaaguaguuagagugcagaggccagcaaagaacggcacagucauggaugugaucagucgcagagaccagcgggguucuggacaggugggaaccuacggccuuaauacuuuuacaaacauggaagcgcaacugauaaggcagauggagagcgagggcauuuucucccccucagaacucgagaccccuaaccuggccgggcgugucuuggauugguuagaaaaacauggaguugagcgacugaagcgcauggcuaucaguggugacgacugugugguaaaaccaaucgaugacagauuugccacagcacucacugcucuuaaugauaugggcaaggugcggaaggacauuccccagugggaaccgucuaaaggguggaacgauuggcagcaagucccuuucugcagccaccacuuucaucagcugauaaugaaggacggaagggagaucgugguucccugucgcaaucaggaugagcuagugggcagagcccgggucucccagggugcaggguggucacugagggaaaccgccugccucggaaaaagcuaugcgcaaauguggcaguugauguacuuccaccgacgugaccugagacuugcugccaacgcaauuuguucugccgugccaguagauuggguuccuacgucccgcaccacauggaguauccaugcucaccaucaguggaugacuaccgaggacaugcugagcguguggaaucgggucuggauugaagagaaccccuggauggaagauaagacacacaucucguccuggggcgacgugccauaucucggcaaaagggaggaccaauggugcgggucuuuaauaggacugacugccagagcaaccugggcuacgaauauccagguugccauuaaccaggugcgccgguugaucgguaaugagaacuaccuggauuacaugacaucaaugaagagguuuaagaaugaaagcgaccccgagggcgcgcucugguga

SEQ ID NO: 13706 - RNA, 9879 nt, Artificial Sequence
  derived and/or modified CDS sequence (opt3) from DENV-1__FJ410283__SS-prME
uccgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacgcugauugccauggaccucggcgagcugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaacuugccgagacgcagcacggaacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccgcagggaaacugguucaucagauuuucggaaccgcguacggcguguuguuuucuggugucagcuggacuaugaagauagggaucggcgugcuccugacaugguuaggacuaaauucacgaaguaccucccuaagcaugacauguauugcuguaggccucgugacucuguaccuugggguuaugguccaggccgauucuggaugcgugaucaacuggaaaggccgcgaauugaagugugguucagggaucuucgugaccaaugagguccacacguggacagaacaauauaaguuucaggcagacaguccgaaaagacugagcgccgcuauuggaaaggccugggaggagggcguuugcgguauaagguccgcaacccggcucgaaaacaucauguggaaacagauuucuaacgagcugaaucauaucuuacuggaaaacgacaugaaguucacuguggugguaggcgaugucgcugggauucuugcccagggcaagaagaugauccgcccucaacccauggaguacaaauauucguggaaaagcuggggcaaggcgaagauaaucggggccgacgugcagaauaccacauuuauuaucgauggaccaaacacuccugaaugucccgacgaucagagagcuuggaauauuugggagguugaggacuacggcuucgguaucuuuaccacaaacauaugguugaagcucagggauuccuauacacaggugugcgaccaccgucugaugucagcagccauuaaagauaguaaggcuguccacgccgacaugggguacuggaucgaaucugagaaaaaugaaaccuggaagcuagcacgggcgagcuucauugaggugaagacuuguaucuggccaaaaucccauacacuguggucaaacggaguucucgaaagcgagaugauaauccccaagauuuauggcgguccuaucucucaacacaauuaccgaccaggcuacuucacccagacugccgggccguggcaucugggaaaacuugaguuggauuuugaccugugcgaaggcacaaccgugguagucgaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgugaaagaaaaggaggaaaaucuugucaagagcaugguuucugcuggcuccggugagguggacucauuuagucugggcuugcucuguauuagcaucaugaucgaagagguaaugcgcucgcgauggucccggaaaaugcugaugacugggacacuagccguguucuuucugcucauuaugggacagcugaccuggaacgaucuuauccguuugugcauuauggucggcgcaaaugcuucugacagaauggggaugggaacaacuuaccuggccuuaauggcaaccuucaagaugaggccuauguuugccgugggccuccuguuccgccggcuuacgagcagagagguucugcuacucacaauaggucugucauugguggcuagugucgaacugccaaacuccuuagaggaacucggggauggacuggcgaugggcaucaugauucuuaaacuguugaccgacuuucaaucucaucagcucugggccacucugcuaagccugaccuucaucaagacaacuuuuucccuucacuaugcauggaaaaccauggcuauggugcucucaauuguuagccuguuccccuugugucugaguacgacaucucagaagaccacuugguuaccggugcuccugggcucccuugggugcaagccucugacaauguuuuugaucgccgagaauaaaauauggggaaggcgaagcuggccacucaacgaagguaucauggccgucggcauuguaucgauccugcuaucaucucugcuuaagaacgaugugccccucgcugggccucugauugcaggaggcauguugaucgccuguuacguuauaagugguuccagcgcggacuuaucucuggagaaagcugccgaggugagcugggaagaggaagcagagcauuccggggccucacacaauauucucgucgaagugcaggaugacggaaccaugaagaucaaagaugaggagcgcgacgauacucugacaauccuucugaaggcuaccuugcuagcaguaaguggcguguauccccugagcauuccagccacacucuucgucugguacuucuggcagaagaagaagcagcggucuggcguucugugggacacuccuucacccccagaaguggagagagcggugcuugaugacgggauauauaggaucaugcagcguggauuacugggucgcagccaggucggcguggggguuuuucaagaaaacguauuccauaccauguggcacgugacacggggagcuguccucauguaccagggcaaaagauuggagccgaguugggccagcgugaagaaagaccugauuuccuacggugggggauggaggcuccagggcucuuggaauaccggcgaggaaguucaggugaucgcagucgagccugggaagaaccccaaaaaugugcaaacagccccaggaacuuuuaagacccccgaaggugagguaggcgcuauugcccuggauuucaagccugggacgucgggaagcccaaucgucaaccgagaaggcaaaauagugggucuuuaugggaauggaguugugacaacuucaggcaccuacgucuccgcaaucgcucaggccaaggcgagucaggagggcccccugccugagauugaagacgagguguuucggaaacgcaacuugacaaucauggaucuacacccggggucuggaaagaccagaagguaucugccagccauuguucgggaagcaaucaaacgaaagcucagaacuuuaauacuggcucccacccgcguggucgccagcgagauggcugaagcacuuaaggguaugccuauuagguaccaaacaacggccgugaaauccgagcauacuggcaaggagaucguagaccugaugugccacgccaccuucacaaugcgucucuugucaccagugcggguucccaauuauaacaugaucauuauggaugaagcucauuuuaccgacccuucuagcaucgcggcaagaggguacauaaguacuagggucggaaugggcgaggccgcugccauuuucaugacagcaaccccgcccgguuccguggaagccuuuccacagagcaaugcugugauccaggaugaggaacgcgacauuccugagcgaucuuggaacucaggguaugaguggaucacggauuuccccggaaaaacugucugguuuguaccauccauaaagaguggcaaugacauugcgaacugucugaggaaaaauggcaagcgggugauccagcucagcaggaagacauucgauaccgaauaccagaaaaccaagaacaacgacugggacuacguugugacuacagauaucucggagaugggggccaauuuccgcgcagaccgugucauugauccuagacggugccugaaacccgugauccuuaaggacggaccagaaaggguuauucuagcugguccgaugccugugaccgucgccucugcagcccagcgccgaggcagaauagggcggaaccacaauaaagagggagaucaguauaucuacaugggccagccccugaacaaugacgaggaucaugcucacuggacagaagccaagauguuguuagacaacauuaauacuccagaggguaucauccccgcgcuguuugaaccugagagggaaaaguccgcagccauugauggggaguaucgccucagaggcgaggcuaggaaaacguucguggaacugaugcggcguggagaccuuccaguauggcugagcuacaagguggccucagagggcuuucaauauagugaucgccgauggugcuucgacggggaaagaaacaaucagguucucgaggaaaacauggaugucgagauauggaccaaagagggagaaaggaagaaauugcggccccgcuggcuggacgcuagaacauacucugacccucuagcacugagggaguuuaaggaguucgccgcuggucggcgauccgugagcggcgaucucauccuugagauugggaaacugccgcagcacuuaacucagagagcccaaaaugcauuggacaaccuggugaugcuccauaauucagaacagggaggccgcgcguauaggcacgccauggaggagcugccagauaccaucgaaacacuuaugcugcucgcuuugauugccguccugaccggugggguuacuuuauuuuuccuaaguggccggggacugggcaagacgagcaucgggcuccuuugugugauggcauccucuguacuguuguggauggcuagcguggagccccauuggauagccgcauccaucauucuggaauuuuuccucaugguccugcuuaucccugagcccgaccgucagagaaccccacaggauaaccaacucgccuacgugguuauuggacuguuguuuaugauccugacaguggcugcgaaugagauggguuuacuagaaacuaccaagaaagaccugggcauagggcacgucgccguagagaaccaccaucacgcagcuaugcucgauguggaccuucauccugccucagccuggacacuguacgcaguugcuaccacuauuaucacacccaugaugaggcacacgauugaaaacaccacugccaauaucucuuugacagcgauagcuaaccaggccgcaauccugaugggacucgauaagggcuggccaauuaguaaaauggacaucggugugccucugcuugccuuagggugcuauucgcaggucaauccgcugacccucaccgcugcaguguugaugcuggucgcccauuacgcgauuaucggccccggacuacaagcuaaggccacacgcgaggcacagaaacggacugccgcuggcauaaugaagaacccaacgguggaugggauuguugccaucgaccuggauccugugguauaugacgcaaaguucgaaaaacagcucggacagaucaugcuucugauuuuguguaccagccaaauccugcucaugcgaacaacuugggcucugugcgaguccauaaccuuagccacaggcccccuuaccacucugugggaggguucuccagggaaguuuuggaauacgacaauugcggugucaauggccaacaucuucagaggaagcuaccucgcaggcgcuggucuagccuucucccugaugaaaaguuugggcgggggaaggcgcggcaccggggcacagggagaaacucugggcgagaaguggaaacggcagcucaaucagcuuucuaagagcgaauuuaacaccuauaagagaucagguauuauggaggucgaccguuccgaagcuaaagaggggcugaagaggggagagacaacuaaacacgccguuagucggggcaccgccaaguugcgcugguucguggaacgaaaucuggucaaaccugaggguaaggugaucgaucucggcugugggagaggaggcuggagcuacuauugcgcgggguuaaagaaaguaacagaagugaagggauacacgaaaggcggucccgggcacgaggaaccgauaccaauggcuaccuacggauggaaccugguuaaacuucauucuggcaaagacguguuuuucaucccucccgagaagugugauacucugcuaugcgacauuggcgaguccucaccaaaucccacaaucgaagaggggaggacccuccggguccugaaaaugguggaaccuugguugcgcggaaaccaauuuuguauuaagauccugaauccguauaugcccagcgucguggagacucucgagcagaugcagagaaagcacgguggcaugcuuguuaggaacccacugucgcgaaauucuacacaugaaauguacuggguaaguugcgggaccggaaacauuguguccgcagucaauaugacgagccggauguuacugaaccguuucaccauggcccacagaaaaccuacauaugagcgcgauguggacuugggcgcugguacuaggcacguugccguggaacccgaggucgcaaaccucgauaucauagggcagcggauugaaaauaucaagcaugagcacaaaucaaccuggcauuacgacgaggauaacccuuauaagacaugggccuaccacggauccuaugaagugaaaccaucuggcagcgcuaguuccaugguaaauggcgugguuaagcugcuaacuaagcccugggacgucaucccuauggugacccaaauugcgaugacagauaccacuccauuugggcagcagagaguguucaaagagaaggucgacacgcgcacacccaaagccaagaggggaaccgcacaaauaauggaaguuacugcuaaauggcuuugggguuuucugagccgaaacaagaagccgcggaucuguaccagagaggaguucacaaggaaagugcgcucuaaugccgcaauuggcgccguauuuguggacgagaaccaguggaacucagcuaaggaggccgucgaagaugagcguuucugggaccucgugcaucgggaaagagagcugcacaaacaggggaagugcgcgacgugcguuuacaacaugaugggaaaaagggaaaagaaguugggcgaguuugguaaagcaaaggggagucgcgccaucugguacauguggcugggagcucgauuccucgaguucgaagcccuuggcuuuaugaaugaggaucacugguucucccgggaaaacagccugucuggcguggagggggagggauuacauaaacuggguuauauuuugagagacaucucgaagauaccuggcgggaauauguacgcagaugacaccgcuggaugggauacuaggaucacagaagacgaucuccagaacgaggcccgcauuaccgacaucauggaaccagagcacgcucugcuagccaaaucaauuuuuaaacuuacuuaucaaaauaaagucgugagaguacagcggcccgcaaagaacggcacaguuauggaugugaucagcaggcgugaccagcgagguuccgggcaggucggaaccuacggccugaauacauucacuaacauggaagcgcaacucauacgccagauggagagugagggcauauuuucuccuagcgaacuggagaccccaaacuuggccgaaagaguguuagauuggcuggggaaguauggaguggagcggcucaaaaggauggcuaucuccggugacgacugugucguuaagcccaucgaugaccgcuucgccacggcacuuaccgcucugaaugauaugggcaaagugagaaaggacauuccgcagugggaaccuucaaaaggguggaacgauuggcagcaaguacccuuuugcagucaucacuuccaccagcuaauaaugaaggacggacgggagaucguggucccauguaggaaucaggaugagcuggugggccgagcccguguuucucagggugcaggguggagccucagagaaacagccugcuugggaaaguccuacgcgcaaauguggcagcugauguauuuucaucgccgggaccuuaggcuggcugccaacgcaauuuguucagccgugccugucgauuggauccccacuagcagaaccacauggucuauucacgcucaucaccaguggaugacuaccgaggacaugcucuccguguggaaucgcguauggaucgaagagaacccauggauggaagauaaaacgcauauaaguagcuggggcgacguucccuacuuaggcaagcgggaggaccaauggugcgggucgcugaucggauugacagccagggcaaccugggcuacuaauauucagguggccaucaaccagguccgaagacugauugguaaugagaacuaccucgauuauaugacauccaugaaacgguucaagaaugaaucugacccugagggcgcgcuuugguga

SEQ ID NO: 13707 - RNA, 9879 nt, Artificial Sequence
  derived and/or modified CDS sequence (opt3) from DENV-1__FJ410284__SS-prME
agcgugaccaugcugcucaugcuuaugcccacagcacuggcuuuccacuugacuacgagaggaggggaaccucauaugaucguaaccaagcaggaaaggggaaaauccuuacuguuuaagacaucugccgguguuaauaugugcacucuaauugccauggaccucggagaacugugugaagauaccaugacauacaaaugcccacggauaaccgaagcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaagcgccuaccagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugggagcuucaaacuggagaaggaaguggcugagacccagcacgguacgguccuugugcagauaaaguacgagggcacagacgcgccuugcaaaaucccauucucgacccaagaugaaaaggggguuauucagaacggacgcuugaucacugcaaaucccauagugacagacaaagagaagccuguaaacauugaagccgagccacccuuuggcgagucuuauaucgucaucggugugggggaaaaagcucugaagcucuccugguucaagaaaggcucaaguauuggaaagauguuugaggccaccgcaagaggcgccaggcggauggcuauccugggggauacugccugggacuucggaagcauugguggcguuuuuaccuccguggggaaacuuguccaucagauauucggaacagcauacggcgugcuguuuucugguguaagcuggacgaugaagaucgggauuggcguguugcucaccuggcugggauuaaauucacgaaguacuucccugagcaugacauguaucgcgguuggccuagucacccucuaccugggggugauggugcaggcugauucuggaugcgucaucaacuggaaaggccgcgaacuuaagugugguucagggauuuucguuacaaaugaggugcacacuuggaccgaacaauauaaguuucaggccgacaguccgaaaagauugagcgcagccauaggaaaggcuugggaggagggcgugugcgguaucagguccgccacgcggcuggaaaacauuauguggaaacagaucucuaacgagcucaaucauauucuguuagaaaacgacaugaaguucacaguagucgugggcgauguuguggggauccuggcacagggcaaaaagaugauacgcccucaacccauggagcacaaauacucguggaaaagcuggggcaaggcuaagaucauuggggccgacguccagaauaccacuuuuaucauugauggaccaaacaccccugaaugucccgacgaucagagagcguggaauaucugggagguggaggacuauggcuucgguauauuuacaacuaacauuuggcuuaaguugagggauuccuacacccaggccugcgaccaccgucucaugucagcugcaaucaaagauaguaaggccguucaugcugacaugggguauuggauugaaucugagaaaaaugaaacauggaagcuggcccgggcauccuucaucgaggugaagacguguauauggccaaaaucccacacccuauggucaaacggaguacuggaaagcgagauggucauccccaagauuuacggcgguccuaucucucaacauaauuaucgaccaggcuacuucacucagacagcggggccguggcaccucggaaaacuggagcuugauuuugacuugugcgaaggcaccacugugguggucgaugagcacugcgggaacagaggacccucccugaggacaaccacgguuacuggcaagauuauccaugaaugguguugccgcaguuguaccuuaccuccacuccgguucaaaggugaggacgggugcugguacggaauggagauaagacccgugaaggaaaaggaggaaaaucugguaaaaagcauggugucugccggcuccggugaggucgacucauuuagucuuggccuguuguguauuagcaucaugaucgaagaggugaugaggucgcgcuggucccgaaagaugcucaugacagggacccuggcuguuuuccuacugcucauuaugggacagcugacuuggaacgaucuuauccgguugugcauuauggugggcgccaaugcaucugaccguauggggaugggaacaaccuaucuggcuuuaauggccacauuuaaaaugagaccuauguucgcagucggccuccuguuuaggcgccuuacuagccgggaggugcugcuacucaccauaggucugucauugguugccaguguggaacugccaaacuccuuagaggaacucggggauggacuggcuaugggcaucaugauucuuaagcuguugacggacuuccaaucucaccagcucugggcgacacugcuaagccugaccuuuaucaaaacuacccuuucccuccauuacgccuggaagacaauggcaaugguccugucaauugucagcuuguucccccuguguuuaaguacuaccucucagaagacgacauggcucccggugcugcuuggcucccuggggugcaaaccuuugaccauguuucucaucgcugagaauaagauauggggaagaaaaagcuggccacugaacgaagguaucauggccguuggcguggucucgauucuacugucaucucuucucaagaacgaugugccccuggccgggccuuugaucgcuggaggcauguuaauugcauguuauguaaucagugguuccagcgccgaccugucucucgagaaagcggcugaggugagcugggaagaggaagccgagcacuccggggcaucacauaauauacuggucgaaguucaggaugacggaacuaugaagauuaaagaugaggagaaggacgauacacuuaccauccuguugaaggccacucuacuggcugugaguggcguguacccccucagcaucccagcaacacuguucgucugguauuuuuggcagaaaaagaaacagaggucuggcgugcuuugggacaccccuucacccccagaaguugagcgagccguauuagaugacgggauuuaccgcauaaugcagcggggacugcucgguagaagccaggugggcgucgggguguuccaagaaaacguuuuccacacgauguggcacgugacuaggggagcggucuugauguaucagggcaagcgucuggagccgaguugggcuagcgugaaaaaggaccucaucuccuacggugggggauggcgccugcagggcucuuggaauaccggcgaggaaguacaggucauugccguggagccugggaagaaccccaaaaauguucaaacagcaccaggaaccuuuaagacacccgaaggugaggugggcgccaucgcucuugauuucaaaccugggacuucgggaagcccaauugucaaccgggaaggcaagaucgugggucuguacgggaauggaguugugaccacgucaggcacauaugucuccgccauagcacaggcuaaagccagucaggagggccccuugccugagaucgaagacgagguguuuagaaagaggaaccuaacuauuauggaucugcauccggggucuggaaagacccgacgguaccucccagcgaucguacgcgaagccacaaaaagaaaguuaaggacccugauucuugcacccacucgggugguugcuagcgagauggccgaagcucugaaagguaugccuauccgauaucaaaccacagcagucaaguccgagcacacgggcaaagagauaguggaccucaugugccaugccacuuucaccaugagauugcugucaccagugcgcguccccaauuacaacaugauuaucauggaugaagcccacuuuacagacccuucuagcaucgcugcgaggggguauauuaguacccguguaggaaugggcgaggcagccgcuaucuucaugacugccacaccgcccgguuccguggaagcauuuccacagagcaaugccguuauacaggaugaggaacgggacauuccugagagaucuuggaacucaggguacgaguggaucaccgauuuccccggaaagacggugugguuugucccauccauuaagaguggcaaugacaucgcuaacugucucaggaaaaauggcaagcgcgugauacagcugagccgaaaaacuuucgauacagaauaucaaaagaccaaaaacaacgacugggacuacguugugaccacugauauuucggagaugggggcgaauuuuagagccgaccgggucaucgauccuaggcgcugccuuaagcccgugauccuaaaggacggaccagaacguguaauucuggcagguccgaugccugugacaguugcuucugccgcacagagacggggcaggaucgggcgcaaccauaauaaagagggagaucaguacauuuauaugggccagcccuugaacaaugacgaggaucacgcccacuggaccgaagcuaagauguuacuggacaacauaaauacaccagaggguaucauucccgcccucuucgaaccugagcgagaaaaauccgcggcaaucgauggggaguacagacugcggggcgaggccaggaagacuuucgucgaacuuaugcgcagaggagaccugccaguguggcucagcuauaaaguggcuucagagggcuuucaauacagugauaggcgguggugcuucgacggggaacguaacaaucaggucuuggaggaaaacauggauguugagaucuggacgaaggagggagaacgcaaaaagcugcgacccagauggcuagacgccaggaccuauucugacccucuggcucuccgggaguuuaaggaguucgcagccggucgcagauccgugagcggcgaucuuauucuggagauagggaaauuaccgcagcauuugacacagagggcucaaaaugcccuggacaaccucguaaugcugcacaauucagaacagggaggccgggcauaccgacaugcgauggaggagcuuccagauacuaucgaaacccugaugcucuuggcccugauugcuguguuaacagguggggucacccuauuuuuccugaguggcagaggacucggcaagacuagcaucgggcuucugugugugauggccuccucuguuuugcuguggauggcaagcguggagccccacuggauugcugccuccaucauacucgaauuuuuccugaugguccuucucaucccugagcccgaccgccagaggacgccacaggauaaccaacuggcauauguagugauuggauugcuguuuaugaucuuaaccguugccgcuaaugagaugggucuacuggaaacaacuaaaaaggaccucggcauugggcacguggcggucgagaaccaucaccaugccaccaugcuugauguggaccugcacccugcaucagcuuggacauuguacgccgucgccaccacuaucauaacacccaugaugcggcauacgauugaaaacaccacugcaaauaucucucugacagcuauugccaaccaggcggcuauccucaugggacuggauaaaggcuggccaauaaguaagauggacaucggugugccucuuuuagcccuggggugcuacucgcagguuaauccgcucaccuugaccgcagccgugcugaugcuaguagcucacuaugcaauuaucggccccggacugcaagccaaggcgacacgugaggcucagaaaagaacugccgcaggcauuaugaagaacccaacgguggaugggaucgucgccauagaccucgauccuguuguguacgacgcuaaauucgaaaagcagcuuggacagauuaugcuguugauccuguguaccagccaaauccuccugaugaggacaacuugggccuuaugcgaguccauuacccuugcaacaggcccccugaccacucucugggaggguucuccagggaaauuuuggaauacgacaaucgcugucucaauggccaacauauuccgcggaagcuaucuagcgggcgccggucuggcauuuuccuugaugaagagucugggcgggggacggcgaggcaccggggcucagggagaaacucucggcgagaaguggaaaagacagcuuaaucagcugucuaagagcgaguucaacauuuacaaaaggucagguaucauggagguggaccgcuccgaagccaaggagggguugaaacggggagagaccacaagacacgcaguaagucguggcacugcuaagcugaggugguucguggaacggaaucucguuaagccugaggguaaagugauugauuuaggcugugggcgcggaggcuggagcuauuacugcgccgggcugaagaaagucaccgaagugaagggauauacaaaaggcggucccgggcaugaggaaccgaucccaauggccacguacggauggaaccuugucaagcugcacucuggcaaagacguguuuuucaccccucccgagaagugugauacucuacucugcgacauaggcgaguccucaccaaaucccacaaucgaagaggggcgaacccugagaguuuugaagaugguagaaccuuggcugaggggaaaccaauuuuguauuaaaauccucaauccguacaugcccagcguggucgagacucuugagcagaugcagcggaagcaugguggcaugcuggugcgcaacccauuaucgagaaauucuacacacgaaauguauuggguuaguugcgggaccggaaacauuguguccgcggucaauaugacgagcaggaugcuguugaaccgauucaccauggcucaccggaaaccuacauacgagcgugauguggaccucggcgcagguacuagacauguagccguggaacccgagguugcuaaccuggauaucauugggcagcgcaucgaaaauauaaagcacgagcauaaaucaaccuggcacuaugacgaggauaacccuuacaagacaugggccuaucauggauccuacgaagucaagccaucuggcagcgcaaguuccauggugaauggcguggucaaacuacuuacuaagcccugggacguuauuccuauggugacccaaaucgccaugacagauaccacuccauuugggcagcagaggguauucaaagagaagguggacacgcggacacccaaagcuaagagaggaaccgcgcaaaucauggaagucacugcccgcuggcugugggguuuucucagcaggaacaagaaaccgcgaauuuguacccgggaggaguucacaagaaaggugaggucuaaugcagcuauaggcgccguuuuuguggacgagaaccaguggaacucagcaaaagaggccgucgaagaugagcgcuucugggaccuggugcagaaggaacgugaguugcacaaacaggggaagugcgcuacgugcguauauaacaugaugggaaagcgggagaaaaagcugggcgaguuugguaaagccaaggggaguagagcgaucugguacauguggcucggagcaagguuccuugaguuugaagcccugggcuucaugaaugaggaucacugguucucccgcgaaaacagcuuaucuggcguugagggggagggacugcauaaauuggguuacauucuccgagacaucucgaagauuccuggcgggaauauguaugcugaugacaccgccggaugggauacucggaucacagaagacgaucugcaaaacgaggcaaaaauaaccgacaucauggaaccagagcacgcucuacuugccacuucaauuuuuaagcugacauaccagaauaagguggucagagugcagaggcccgcuaaaaacggcaccgugauggaugucaucagccgcagagaccagcgggguuccgggcaaguuggaacauauggccucaauacuuucaccaacauggaagcccagcugauuaggcagauggagagugagggcaucuuuuugccuucugaauuagagacgccaaaccuggcagaacgugugcucgauuggcuugagaagcaugggguagaacgacugaaacgcauggcgauaagcggagacgacuguguggucaagcccauugaugacagauucgccaccgcucuaacagcccugaaugauauggguaaagugcggaaggacaucccgcagugggagccuuccaagggcuggaacgauuggcaacagguucccuuuugcucacaccacuuccaucagcucaucaugaaagacgggagggagauuguggucccaugucgcaaucaggaugaauuggugggcagagcacggguaagucaaggcgcugguuggucucugagggagacugccugccuuggaaagagcuacgcacagauguggcagcugauguauuuucaccgacgugaccucagauuagccgcgaacgcuauauguuccgccguuccuguggauuggguccccaccucacgcacaacuuggagcauccaugcacaccaucaauggaugaccacggaagacaugcugucuguguggaaucggguuuggauugaggaaaacccauggauggaggauaaaacacacguguccaguuggggagacguccccuacuugggcaagagggaggaccaguggugcggcagccugaucgggcucaccgccagagcuacuugggccucgaauauucagguggcaaucaaccagguacgccggcuuauaggaaaugaaaacuaucuggauuacaugacauccaugaaaagguucaagaaugagggugacccugaaggcgcucuaugguga

SEQ ID NO: 13708 - RNA, 9879 nt, Artificial Sequence
  derived and/or modified CDS sequence (opt3) from DENV-1__FJ410285__SS-prME
agcgugaccaugcugcucaugcuuaugcccacagcccuggcuuuccacuugacuacgcggggaggggaaccucauaugaucgucuccaagcaggaaagggggaaaucuuuacuguuuaagaccucagccgguguuaacaugugcacacuaauugccauggaccucggcgaacugugugaagauacuaugaccuacaaaugcccacggauaacagaaaccgaaccggacgauguggacuguuggugcaaugcgacugauacauggguaaccuaugggacguguagucaaacuggagagcaccgccgagacaagcguagcguggcucuugccccacaugucggccuggguuuggagaccagaacagaaacuuggauguccucugagggggcauggaaacagauccagaggguggaaaccugggcccuccggcacccuggauucacaguuauugcucuguuucuggcacaugugaucggcaccucgauuacgcagaagggcaucauauucauccucuuaaugcuggucacuccaucaauggccaugcgcugcguggggauuggaagcagagauuuuguagagggucuuaguggcgcuacauggguugacguggucuuggagcacggguccugugugaccacuauggccaaggauaaacccacacuggacaucgaacuacucaagaccgaggugacgaacccugcgguccugaggaaacuuugcauugaagcaaagaucucuaauaccacaacugauagccgguguccaacccaaggagaggccacacugguugaagaacaggacgcuaacuucgugugccgccgaacuuuuguagauagaggcugggguaauggguguggauuguucggcaaaggcucccucauaaccugcgccaaguuuaagugcgugacaaaacuggaggggaagauuguccagcacgaaaacuuaaaauacucagugaucguuaccgugcauacuggagaccagcaccaagucgguaaugagaguacggaacauggcacaaccgcaacuauuacaccccaagcuccuaccaccgagauccagcugacugacuauggggcccucagccuugauuguucuccaaggacaggacuggacuucaacgaaaugguguugcuaacgaugaaggagaaauccuggcugguacacaagcagugguuucucgaucugccgcuucccuggaccucaggcgcgagcacaagucaagagacauggaaucggcaggaccuguugguuaccuucaaaacagcccacgcaaagaagcaggaaguggucgugcucgguucucaagagggggcuaugcauacugcccugaccggcgcuacggaaauccagaccuccggaacaacuaccauuuuugccggccacuuaaaaugccgucugaagauggauaaacuaacacucaaggggaugagcuacgucauguguacuggaucguucaaacuggagaaggaaguggcagagacccagcaugguacgguucuugugcagauaaaguaugagggcacagacgccccuugcaaaaucccauucucuacccaagaugaaaaggggguaacucagaacggacgcuugauuacagcuaaucccaucgucaccgacaaagagaagccugugaacauagaagcggagccacccuuuggcgaguccuacauuaucaucggugcaggggaaaaagcccugaagcucucaugguucaagaaaggcaguagcauuggaaagauguuugaggcuacugccagaggcgcaaggcggauggccauccugggggauaccgcuugggacuucggauccauugguggcguuuuuacaucuguggggaaacuuguccaccagauauucggaacggccuauggcgugcuguuuagcgguguaucauggaccaugaagaucgggauuggcguguugcucacuuggcugggauuaaauagucgauccacaagccugucuaugaccuguaucgcaguuggccuagucacacucuaccugggggugauggugcaggcggauucaggaugcgucaucaacuggaaaggccgcgaacuuaagugugguagugggauuuucguuacuaaugaggugcauaccuggacggaacaauacaaguuucaggcugacagcccgaaaagauuguccgccgcaauaggaaaggccugggaggagggcgugugcgguaucaggucugcuacacggcuggaaaacauuauguggaaacagaucucgaacgagcucaaucacauucuguuagaaaacgacaugaaguucaccguagucgugggcgauguugccgggauccuggcacagggcaagaagaugauacgcccucaacccauggaguauaaauacagcuggaaguccuggggcaaggcuaaaaucauuggggccgacgugcagaauacuaccuuuaucauugauggaccaaacacaccugaaugucccgacgaucagagagcguggaauaucugggaggucgaggacuauggcuucgguauauuuacuaccaacauuuggcuuaaguugagggauucauacacacaggugugcgaccaccgucucaugagugccgcuaucaaagauucuaaggcaguucaugccgacaugggguauuggauugaaagcgagaaaaaugaaacguggaagcuggcucgggccuccuucaucgaggugaagaccuguauauggccaaaaucacacacucuauggagcaacggaguacuggaaucugagaugaucauucccaagaucuacggcgguccuauuucccaacauaauuaucgaccaggcuacuucacacagaccgcagggccguggcaccucggaaaacuggagcuugauuuugacuugugcgaaggcacuacagucgugguggaugagcacugcgggaacagaggacccagucugaggaccacgacugucaccggcaagaucauacaugaaugguguugccgcagcuguacauuaccuccacuccgguucagaggugaggacgggugcugguacggaauggagauuaggcccguuaaagaaaaggaggaaaaucuggugaagucuaugguauccgcgggcccuggugagguggacucauuuagucuuggccuguuguguaucagcaucaugauugaagaggucaugcgcucgcgauggucccggaaaaugcucaugaccgggacucuggccguguucuuucuacugaucaugggacagcucacauggaacgaucugauucgucuuugcauaaugguuggcgcuaaugccucugacagaauggggaugggaaccacauauuuggcacugauggcuacuuucaagaugaggccaauguuugccgugggcuuacucuuccgccggcugaccagcagagagguccuucugcuaacgaucggucucucacugguggcaaguguugaauugcccaacucccuggaggaauuaggggauggacucgccaugggcauuaugauccugaaacuucuggcugacuuucaaucucaccaguugugggcgacacuccugagccuaaccuucauuaagacuaccuuuucccugcauuacgccuggaaaacaauggcaauggugcuuucaaucgucagccucuucccgcuguguuugaguacuaccucucagaagacgacauggcugccuguauuacucggcucccuggggugcaagccacuuaccauguuucugauagcugagaauaaaaucuggggaaggcgaagcuggcccuugaacgaagguauuauggccgugggcaucguuucgauucuccugucaucucuacugaagaacgaugugccucuugccgggccccucaucgcuggaggcaugcugauagcauguuaugucauuagugguuccagcgccgacuugucuuuagagaaagcggcugaggugagcugggaagaggaagccgagcacuccggggcaucacauaauauccugguagaagugcaggaugacggaacuaugaagaucaaagaugaggagcgcgacgauacacucaccauucugcuuaaggccacucuguuggcugucaguggcguuuacccacuaagcauaccugcaacacuguucgugugguauuucuggcagaaaaagaagcagcggucuggcgugcucugggacacccccuccccaccggaagucgagagagccgugcuggaugacgggaucuacaggauuaugcagcguggacuuuuaggucgcucacagguuggcguagggguguuucaagaaaacgucuuccacacgauguggcacgugacucggggagcgguucugauguaucagggcaaaagacucgagccuaguugggcuagcgugaagaaagacuugaucuccuacggugggggauggaggcugcagggcucuuggaauaccggcgaggaaguccaggugauugccguagagcccgggaagaaccccaaaaauguccaaacagcacccggaaccuuuaagacaccugaaggugaggugggcgccaucgcucucgauuucaagccagggacuucgggaagccccauaguuaaccgagaaggcaaaaucgugggucuguacgggaauggagucgugaccacgucaggcacauauguuuccgccauugcacaggcuaaggccagucaggagggcccucuuccggagaucgaagacgagguguuucggaaacgcaaccugacuauuauggauuugcauccagggucuggaaagaccagaagguaccuacccgcgaucguccgggaagccauaaaacgaagacugcgcacacucauuuuagcaccuaccagggugguagcuagcgagauggccgaagcucugaaggguaugccaauccguuaucaaacuaccgcagugaaguccgagcacacaggcaaagagaucguugaccuuaugugccaugccacguucacuaugcggcugcucucacccgucagagugccuaauuacaacaugauuaucauggaugaagcccacuuuaccgacccgucuagcauagcugcgaggggguauauuaguacacgcgugggaaugggcgaggcagccgcuaucuucaugaccgccacucccccagguuccgucgaagcauuuccucagagcaaugccguaauucaggaugaggaacgagacauccccgagagaucuuggaacucaggguacgaguggauaacagauuucccaggaaagaccgugugguuuguuccuuccauuaaaaguggcaaugacaucgcuaacuguuugcggaagaauggcaaaagggugauccagcugagccgcaagacguucgauacugaauaucaaaagacuaaaaauaacgacugggacuacgucgugaccaccgauauuucggagaugggggcgaauuuccgugccgacagaguuaucgauccccggaggugccucaagccagugauucugaaagacggaccggaacgcgucauacuugcagguccuaugcccgugacuguagcuucugccgcacagcgaagaggccggaucgggaggaaccauaauaaggagggagaucaguacauuuauaugggccagccacuaaacaaugacgaggaucacgcccacuggacagaagcuaaaaugcuguuggacaacaucaauacccccgaggguaucauuccugccuuauuugaaccagagcgcgaaaaguccgcggcaauagauggggaguacagacugaggggcgaggcccggaagacauucguggaacucaugcgucgcggagaccugcccguuuggcuuagcuauaaagucgcuucagagggcuuucaauacagugaucgaagauggugcuucgacggggaaaggaacaaucaggugcuggaggaaaacauggauguggagaucuggacuaaggagggagaacggaaaaagcuccgcccuagaugguuggacgccaggacguauucugacccgcuggcucuacgggaguuuaaagaguucgcagccggucgaagauccgucagcggcgaucugauucucgagaucgggaaacuuccacagcaucugacccagcgcgcucaaaaugccuuagacaacuugguuaugcugcacaauucagaacagggaggcagggcauaccggcaugcgauggaggagcuccccgauacaauugaaacucugaugcuucuggcccucaucgcuguguugaccggugggguaacacuguuuuucuuaaguggccguggacuaggcaaaaccagcauagggcugcucugugugauggccuccucuguccuucuguggauggcaagcguggagccucacuggaucgcugccuccauuaucuuggaauuuuuccugaugguucuccugauucccgagccagacagacagaggacuccucaggauaaccaacuugcauauguggucaucggacuccuguuuaugauauugacgguagccgcuaaugagaugggucuguuagaaaccacaaagaaggaccuaggcauugggcacguggcgguugagaaccaucaccaugccgcaaugcuggauguggaccuccaccccgcuucagccuggacucuuuacgccgucgcaaccacaaucauuaccccaaugaugcgccauacuaucgaaaacacaacggcuaauauaucucugaccgccaucgcgaaccaggcugccauuuugaugggacuggauaaaggcuggccuaucaguaagauggacauuggugugccgcuccuggcacuugggugcuacucgcaggucaaucccuuaacucugacagccgcugugcucauguugguugcacacuaugccaucauaggcccaggacugcaagcgaaagcuacccgggaggcccagaagcgaaccgcagccggcauuaugaaaaacccuacaguggaugggaucguagcuaucgaccuagaucccguggucuacgacgccaaguucgaaaagcagcugggacagauuaugcuccuuauccuguguacuagccaaauauugcugaugagaacgaccugggcacucugcgaguccauuacacuggcuacuggcccauuaaccacacuuugggaggguucuccugggaaauuuuggaauaccacuaucgccguuucaauggcgaacauuuucaggggaagcuaucuggccggcgcaggucucgcuuucucccuaaugaagagucugggcgggggacgccggggcacgggggcccagggagaaacauugggcgagaaauggaagagacagcugaaucagcucucuaaaagcgaauuuaacaccuacaagcguucagguaucauggagguggacagguccgaagcaaaggaggggcuuaaacggggagagacuaccaagcacgcugucagucgcggcacagccaaacugcgaugguucguggaaagaaauuugguaaagcccgaggguaaagugauagaucugggcugugggaggggaggcuggagcuauuacugcgccgggcucaagaagguuacugaagugaaaggauauaccaagggcgguccggggcaugaggaaccaaucccuauggcgacauacggauggaacuuagucaaacugcacucuggcaaggacguguuuuucauucccccagagaaaugugauacgcuucugugcgacaucggcgaguccucacccaauccuaccauugaagaggggcggacucuacgcguccucaagaugguggaaccguggcugagaggaaaccaauuuuguaucaaaauuuugaaucccuacaugccaagcguuguagagacacuggagcagaugcagaggaagcaugguggcaugcucgugcgaaacccucuuucgagaaauucuacccacgaaauguauugggucaguugcgggacuggaaacaucguguccgcuguuaauaugacaagccguaugcuguuaaacagauucaccauggcacaccgcaagcccacguacgagagggauguggaccugggcgccgguacccggcaugucgcuguggaaccugagguagccaacuuggauauaauugggcagagaaucgaaaauaucaaacacgagcauaagucaacauggcacuaugacgaggauaacccauacaaaacuugggcauaucauggauccuacgaagugaagcccucuggcagcgccaguuccaugguuaauggcgucgugaaacuccugaccaagccuugggacgugauuccaauggucacacaaauagcuaugacugauaccacacccuuugggcagcagcgcguuuucaaggagaaaguggacaccaggacuccgaaggcgaaacgaggaacggcccaaaucauggaaguaacagcaaaguggcuaugggguuuucuuagccggaacaaaaagccuagaauuuguaccagggaggaguucacucgcaaggugcguucuaaugcugccaucggcgcagucuuuguggacgagaaccaguggaacucagccaaagaggcuguugaagaugagcgguucugggaccuggugcacagagaaagggagcuccacaagcaggggaaaugcgcaaccugcgucuauaacaugaugggaaagcgcgagaaaaagcugggcgaguuugguaaggcgaaagggagucgagcaauuugguacaugugguugggagcccgguuccuggaguucgaagcucucggcuuuaugaaugaggaucauugguucuccagagaaaacagccuuucuggcguggagggggagggacugcacaaguuagguuacauccugagggacauaucgaaaaucccaggcgggaauauguaugccgaugacacagcaggaugggauacgcgcauuaccgaagacgauuugcagaacgaggcuagaaucacugacauuauggaacccgagcaugcccuccuggcuaagucaaucuuuaaacuaacauaccaaaauaagguaguucgggugcagaggccugccaaaaacggcaccgucauggaugugauaagccgucgagaccagcgcgguuccggacaggugggaacuuauggccuuaauacauucaccaacauggaagcacaacugauuagacagauggagagugagggcaucuuuucuccaagcgaacucgagacacccaaccuggcggaacgggucuuggauugguuagagaaguacgggguugaaaggcugaagcgcauggccaucuccggagacgacugugugguaaaaccgauugaugacagauucgcuacugcccucaccgcacuuaaugauauggguaaggugcggaaagacauaccucagugggagcccucaaagggcuggaacgauuggcagcaagucccauuuugcagucaccacuuccaucagcugaucaugaaagacgggagggagauugugguuccuugucgaaaucaggaugagcuagugggacgugcuagagucucucagggcgccgguuggagccugcgcgagacggcaugccucgggaaguccuaugcccaaauguggcaguugauguacuuucaccggagggaccugagacuugcggcuaacgccaucuguucagcagugcccguagauuggauuccaaccagccgcacaacuuggucuauccaugcccaccaucaguggaugaccacagaagacaugcuguccguuuggaaucggguguggauagaggaaaaccccuggauggaggauaagacucacaucaguagcuggggagacgucccuuaucucggcaaaagggaggaccaauggugcggcucguuaauugggcugaccgcucgagccacgugggcaacaaauauccagguggcuauuaaccagguuagacgguugaucggaaaugaaaacuaccuggauuacaugaccuccaugaagagguucaaaaaugagucugacccagaaggugcccucugguga

SEQ ID NO: 13709 - RNA, 9879 nt, Artificial Sequence
  derived and/or modified CDS sequence (opt3) from DENV-1__FJ410286__SS-prME
agcgugacaaugcugcucaugcuuaugcccacagcacuggcuuuccacuugacuacgagaggaggggaaccucauaugaucgucuccaagcaggaaagaggaaaaucuuuacuguuuaagaccucagccgguguuaacaugugcacacugauugcaauggaccucggagaacugugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuugcaccccaugucggccuggguuuggaaacuagaaccgagacauggauguccucugaaggggccuggaaacagauccagaggguggagacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagacuuuguggagggucuuaguggcgcgacuuggguagauguuguguuggaacacggguccugugucacaaccauggcaaaggacaaacccacucuggauaucgagcugcucaagacagaagugaccaacccugccgugcugaggaaacuuugcauugaggcuaagaucucuaauacgaccacagacagccgguguccaacucaaggagaagccacccuggucgaggagcaggaugcaaacuucguuugccgccgaacauuuguggacagaggcugggguaauggguguggauuguucggcaaaggcucccuccugacuugcgcuaaguuuaagugcguaaccaaauuagaagggaagauagugcaguacgagaaccugaaauauucagucauugugacaguucacaccggagaucagcaucaaguggguaaugaaaguacugagcacggcacgacagccaccaucacuccccaggcgccuaccacagaaauucagcucaccgacuacggggcccuuacucuggacuguagcccaaggacaggauuggauuucaacgagaugguccuacugacgaugaaggagaaaucuuggcucgugcauaagcagugguuucuggaccuuccgcugcccuggaccuccggcgcaucaacuagccaagaaacauggaaucggcaggauuugcucguaaccuucaaaacagcucacgccaagaagcaggagguugugguccuggguagucaagaaggggcuaugcacacugccuuaaccggcgcaacggagauccagaccucuggaacaacuaccaucuuugccggccaucugaaaugccgucuaaagauggacaaacucacacugaaggggauguccuaugugauguguacuggcagcuucaaacuugaaaaggaggucgcugagacccagcacgguacgguguugguucagauuaaguacgaaggcacagaugcgccuugcaaaauaccauucucgacccaagacgggaagggagugacucagaacggccgccugaucacagcaaaucccauuguaaccgauaaagagaagccugucaacaucgaagccgagccacccuuuggugagucuuauauagugauuggggcuggcgaaaaagcccucaagcuguccugguucaagaaaggaucaaguaucggcaagauguuugaggcaacugccagaggggcuaggcggauggccauccuuggagacaccgcaugggauuucgguagcauuggcgggguuuuuacauccgugggaaaacugguccaucagaucuucggcacggcguacgguguguuguuuucugggguaagcuggaccaugaagauuggcauaggagugcuccugacuugguuaggccuaaauucacgaaguacaucccuaagcaugaccuguaucgcuguugggcucgucacacuguaccuuggagugauggugcaggccgacucuggcugcgucauuaacuggaaaggucgcgaauugaagugugggucaggaaucuucguuacuaaugaggugcacaccuggacggaacaauauaaguuucaggcagauaguccgaaaagacugagcgccgcuaucggcaaggccugggaggagggugugugcggcauuagguccgcaacacggcucgaaaacauaauguggaaacagaucucuaacgagcugaaucauauuuuacuggaaaacgacaugaaguucaccguagucgugggggacguugcuggaauccuugugcagggcaaaaagaugauucgcccucaacccauggaguacaaauauucguggaaaagcugggggaaggccaaaaucauaggagcggauguccaaaauuccacuuuuaucauugacggcccaaacaccccugaaugucccgaugaccagagagccuggaauaucugggagguggaggauuacgguuucgggauuuuuacaacuaacaucugguugaagcucagggacucauauacccagguuugcgaucaccgucugaugagugcugcaauaaaagacucuaaggccgugcacgcugauaugggauacuggauugaaagcgagaaaaaugaaacauggaagcuagcccgggcauccuucaucgagguaaagacguguauuuggccaaaaucacauacccuguggagcaacggcguccucgaaucugagaugaucauacccaagauccacgguggcccuauuucccaacauaauuaucgaccaggguacuucacucagacagcgggaccguggcaccugggcaaacuugaguuggacuuugaucugugcgaagggaccacugugguggucgacgagcacugcggaaacagaggccccaguuuaaggacaaccacgguuacugguaagaucauucaugaaugguguugccgcagcuguacccucccuccacugcgguucagaggggaggauggaugcugguacggcauggagaucaggcccgugaaagaaaaggaggaaaaucuuguaaagucuaugguguccgccgguucaggcgaggucgacaguuuuagccugggguugcucuguauaucgauuaugaucgaagaggugaugcgcucccgauggucucggaaaaugcugaugacaggaacccuagcuguuuucuuucugcucaucaugggccagcugacuuggaacgaccuuauucguuugugcaucauggugggggccaaugcaagcgauagaaugggaaugggcacaaccuaucuggcuuuaauggccacauucaagaugaggccuauguuugcagucggucuccuguuccgccggcuuacuucaagagaggugcugcuacucaccauugggcugaguuugguugccuccguggaacugccaaacucuuuagaggaacucggagacggccuggcuaugggcauaaugauccuuaaacuguugacggauuuucaaagcuaccagcucugggcgacacugcuaucccugaccuucauuaagacuaccuuuucacuucacuaugccuggaaaacaauggcaaugguccucagcaucguaagucuguuccccuugugucugucuacuaccucccagaagacgacaugguuaccggugcuccuggggagccuuggaugcaagccucugaccauguuuuugauugcugagaauaaaaucugggguaggaagucguggccacucaacgaaggcauaauggccguugggaucgugucaauucugcuaucuagucugcuuaaaaacgacgucccccucgccggaccucugaucgcuggcgguauguugauugcauguuacgugaucuccgggagcucugccgauuuaagccuggagaaggcggcugagguauccugggaagaggaagccgagcauucaggagcaagucacaauauacucguggaaguccaggacgauggcacuaugaaaauuaaggacgaggagcgagaugacacacugaccauccuucugaaagccacuuugcuagcuguuagcggcguguauccccugucuaucccagcaacacucuucguguggcauuucuggcaaaagaagaaacagcgcuccgggguccugugggauaccccuucacccccagaaguggagcgggccguucuugacgauggaauuuacagaauaaugcagagggguuuacugggccguagucagguaggggugggagucuuucaagaaaacguguuccacacgauguggcacguuacucgcggcgcggugcucauguaucaggguaagcgguuggagccgagcugggcuuccgucaaaaaggaccugaucucuuacgggggaggcuggagauuucagggcucguggaauaccggggaggaagugcagguaauugccgucgagccuggcaagaaucccaagaaugugcaaacagcaccagguaccuucaagacacccgaaggcgagguuggggccaucgcucucgacuuuaaaccuggaacuagcggcucaccaauugugaacagggaagguaagaucgucgggcuguacggaaauggcgugguuaccacguccggcacauaugugagugccauagcacaggcuaaagccucucaggaggggccccuuccugagaucgaagaugaggucuuccgaaagcggaaccugacuauuauggacuugcauccgggaagcgguaaaacccgcagauaccuaccagcgaucgugagggaagccauuaagcggaagcugcgaacacucaucuuagcacccaccagaguaguggcuuccgagauggccgaagcucugaaaggcaugccuauacgcuaucaaacuaccgcaguuaagucagagcacacagggaaagagauugucgaucuuaugugccaugccacguuuacuaugaggcugcucucuccagugcgugugcccaauuacaacaugaucaucauggacgaagcccacuucaccgauccuagcaguauugcugcgcggggauauaucuccacaagagucggcaugggugaggcagccgcuauauuuaugaccgccacuccgcccgggagcauggaagcauucccacagucuaaugccguaauucaggacgaggaaagggauaucccugagcgcucauggaacuccggauacgaguggauuacagacuuucccggcaagaccgugugguucguuccaaguaucaaagcuggcaaugauauagcgaacuguuugcgaaagaaugggaagagagugauucagcugagccggaaaacguucgacacugaauaucaaaagaccaagaacaacgauugggacuacgucgugaccaccgacaucucggagaugggagccaauuuuagggcagaucgcguuaucgacccucguagaugccucaagcccgugauucugaaagaugguccagaacgggucauccuugcuggcccgaugccugugacuguagccucugcagcccagaggcgcgggcgaauuggaagaaaccauaauaaggagggcgaccaguacauauauaugggucagccccuaaacaaugaugaggaccacgcucacuggacagaagccaagaugcuguuggauaacaucaauaccccagaggggauuauccccgcguuauucgaaccugagcgggaaaaauccgcagccaucgacggcgaguacaggcugcgcggagaggcuagaaagacauuuguggaacucaugaggcggggcgaucugccaguuuggcuuagcuauaaagucgccucagagggguuccaauacagugaccgucgcuggugcuuugauggagaacgaaacaaucaggugcuggaggaaaacauggacguggagauuuggacuaaggagggugaaaggaaaaagcucaggccccggugguuggaugcucgcacguauucugacccucuggcacuaagagaguucaaagaauuugccgcuggcaggcgguccgucagcggggaccugauacucgagaucggaaaacuuccgcagcaucugacccagcgagcccaaaaugcauuagauaacuugguuaugcugcacaauucagaacagggcgguagagcguaccgccaugccauggaggagcucccagacacaauugaaacucugaugcuucuggcucucaucgccguguugaccgggggcguaacacuguucuuuuuaaguggaaagggccuagggaaaaccagcauuggacugcucugugugauggcauccucuguccuucuguggauggcuagcguggagccccacuggaucgccgcauccauaaucuuggaguucuuucugaugguucuccugauuccugagcccgauaggcagcggacuccacaggacaaccaacuugccuauguggucaucggucuccuguucaugauuuugacgguagcugcgaaugagaugggccuguuagaaaccacaaagaaagaucuagggaucggacacguggccguugagaaccaucaccaugcagcuaugcuggacguggaucuccacccugccucagccuggacucuuuacgcagucgcuaccacaauaauuacccccaugaugcgucauacuaucgaaaacacaacggccaauauuucucugaccgcgaucgcuaaccaggccgcaauauugaugggccuggacaaggguuggccaaucaguaaaauggauauuggggugccucuccuggcccuuggcugcuacucgcaggucaauccguuaacucugacagcugcagugcucauguugguugcccacuaugcgaucauuggacccggccugcaagcuaaggccaccagagaggcacagaagaggaccgccgcugggaucaugaaaaacccaacaauagacggaauuguggccaucgaucuagacccuguaguguacgaugcaaaguuugaaaaacagcugggccagaucaugcuccuuauucuguguacuagccaaaucuugcugaugcgcacgaccugggcucucugcgaguccauaacacuggccacuggucccuuaaccacacuuugggaggggucuccaggaaaguucuggaauaccacuauugcggucucaauggccaacaucuuccggggcagcuaucuggcaggagcuggccucgccuuuucccuaaugaaaagucuaggggguggccgaagagggacgggagcacagggcgaaacauugggugagaaguggaagaggcagcugaaucagcucucuaaaagcgaguucaacaccuacaagcgcucagggauuauggaaguugaccgguccgaagcuaaagagggacuuaagagaggcgagacuaccaaacacgccgugagucgugguacagccaagcugaggugguuugucgaacggaauuuggugaagccugagggcaaaguaaucgaccugggguguggacgcggcggguggagcuauuacugcgcgggacucaagaaagugacugaaguuaagggcuauaccaaaggugggcccggacaugaggaaccgauaccaauggcuacauacggcuggaacuuagugaagcugcacucuggcaaagaugucuucuuuaucccucccgagaagugugacacgcuucugugcgauauuggggaguccucaccaaaucccaccaucgaagagggacgaacucuaagagugcucaagauggucgaaccuuggcugagggguaaccaauucuguauuaaaaucuugaauccguacaugcccagcgugguugagacacuggagcagaugcagcggaagcauggcgggaugcucguacgcaacccacuuucgagaaauucuacccacgaaauguauugggugaguugcggaacuggcaacauugucuccgcagugaauaugacaagcaggaugcuguuaaaccgauuuaccauggcccaccggaaaccuacguacgagcgugacguugaucugggugcugggaccagacauguggccgucgaacccgagguggcaaacuuggacaucauaggacagcgcauugaaaauaucaagcacgagcauaaaucaacauggcacuaugaugaggacaacccuuacaagacuugggccuaucauggcuccuacgaaguaaagccaucuggcagcgcuaguuccauggugaaugggguugucaaacuccugaccaagcccugggaugugaucccuauggugacacaaauugcgaugacugacaccacaccauucggacagcagagggucuuuaaagagaagguugauacccggacucccaaagccaagagagguacggcacaaauaauggaagugacagcucgcuggcuauggggcuuccuuagcaggaacaagaaaccgcgaaucuguacccgggaggaauuuacuagaaagguaaggucuaaugccgcaauuggggccguguucgucgacgagaaccaguggaacucagcuaaagaggccguggaagacgaucgcuuuugggaccugguucaccgugagcgggaacuccacaagcagggaaaaugcgcgaccugcguguauaacaugaugggcaagagagagaagaaacugggugaguucgggaaggcaaaaggaaguagggccaucugguacaugugguugggcgcucgcuuccuggaguuugaggcccucggcuucaugaaugaagaucauugguuuucccgagagaacagccuuucuggggucgaaggagagggucugcacaaguuaggcuacauucugcgggacaucucgaaaauaccugggggaaauauguaugcagaugacacagcuggcugggauacgagaaucaccgaggacgauuugcagaacgaagccaagauuacugacaucauggagccagaacaugcucuccuggccaaaucaauuuucaagcuaacauaccaaaauaaggugguaaggguucagcgccccgccaaaaacgguaccgugauggaugucaucagcagacgggaccagaggggguccggacaggugggcacuuauggccuuaauacauuuaccaacauggaggcgcaacugauacgucagauggaaagugaggggauuuuccucccuaacgagcuggaaacaccaaauuuggccggacgaguguuagauuggcuggagaaguacggugucgaacgccucaaaagaauggcuaucucuggcgacgacuguguugugaagcccaucgaugaccgguuugccacugcacuuaccgcucugaacgauauggggaaaguaaggaaggacauuccgcagugggagccuagcaagggauggaaugauuggcagcaagugcccuucugcucccaccacuuucaucagcuaauaaugaaagacggccgcgaaaucgucgugccauguagaaaccaggaugagcugguuggucgggccagggugucacagggggcaggauggagucuccgagagacggccugcuugggcaagucuuaugcgcaaauguggcagcugauguacuuccaccguagagaccuucgccuggcugccaaugcaauuuguagcgccgucccuguggauuggguacccaccucccggacaacuuggucaauccaugcucaccaucaguggaugaccacagaagacaugcucagcguuuggaacaggguguggauugaggaaaauccauggauggaggauaaaacuagaaucucuuccugggaagacguccccuauuuaggcaagcgcgaggaccaauggugcgggagucugauaggauugaccgcccgggcaacgugggcuacaaacauccagguggccauuaaucagguuaggcgacugaucgguaacgagaauuacagcgauuacaugaccucgaugaaaagauuuaagaacgaauccgagccugaaggcgcgcucugguga

SEQ ID NO: 13710 - RNA, 9879 nt, Artificial Sequence
  derived and/or modified CDS sequence (opt3) from DENV-1__FJ461339__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggaaaaaagaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucacacacccaggugugcgaccaccgucucaugagugcagccauuaaagauucuaaggcuguucaugccgacaugggguauuggaucgaaagcgagaaaaaugaaacauggaagcuggcacgggcguccuucauugaggugaagacguguaucuggccaaaaucacacacccuauggagcaacggaguacuggaaucugagaugauaauccccaagauuuacggcgguccuaucucccaacauaauuaucgaccaggcuacuucacucagacagccgggccguggcaccucggaaaacuggagcuugauuuugacuugugcgaaggcaccacugucgugguggaugagcacugcgggaacagaggacccagucugaggacaaccacggucacuggcaagauuauccaugaaugguguugccgcagcuguaccuuaccuccacuccgguucaaaggugaggacgggugcugguacggaauggagauaagacccguuaaggaaaaggaggaaaaucuggugaaaucuaugguauccgcuggcucaggugagguggacaguuuuagccuuggccuguuguguauuucgaucaugaucgaagaggucaugaggucccgcuggucucgaaagaugcucaugacagggacccuggccguguucuuucuacugauuaugggacagcucacuuggaacgaucugauccggcuuugcauuaugguuggcgcaaaugcuagcgaccguauggggaugggaacaaccuauuuggcccugauggcaacauucaaaaugagaccuauguuugccgugggcuuacucuucaggcgccugacuucacgggagguccuucugcuaaccauaggucucagucugguggcuuccguugaauugccaaacucucuggaggaauuaggggauggacucgcgaugggcaucaugauucugaagcuucugacggacuuucaaccccaccaguugugggccacacuccugagccuaaccuucaucagaacuaccuuuucccugcauuacgcauggaaaacaauggcuauggugcuuucaauugucagccucuucccgcuguguuugaguacuaccucucagaagacgacauggcugccuguauuacucggcucccuggggugcaagccacuuaccauguuucugaucgccgagaauaaaauauggggaaggaagagcuggcccuugaacgaagguaucauggccgugggcauuguuucgauccuccugucaucucuacugaaaaacgaugugccucuugcugggccccucauugcaggaggcaugcugaucgccuguuaugucauaagugguuccagcgcggacuugucuuuagagaaggcugccgaggugagcugggaagaggaagcagagcacuccggggccucacauaauauucugguagaagugcaggaugacggaacuaugaaaaucaaggaugaggagcgagacgauacacucaccauccugcuuaaagcuacucuguuggcagucaguggcguuuacccacuaagcauuccugccacacuguucgugugguauuucuggcaaaagaagaaacagcgcucuggcgugcucugggacacccccuccccaccggaagucgagcgggcggugcuggaugacgggauauacagaaucaugcagaggggacuuuuaggucguucacagguuggcguagggguguuucaagaaaacgucuuccacacgauguggcacgugacucgcggagcuguucugauguaucagggcaagcggcucgagccuaguugggccagcgugaaaaaggacuugauuuccuacggugggggauggagacugcagggcucuuggaauaccggcgaggaaguccaggugaucgcaguagagcccgggaaaaacccaaagaauguccaaacagcccccggaaccuuuaagacaucggaaggugaggugggcgcuauugcccucgauuucaaaccugggacuagcggaucaccaaucguuaacagggaaggcaagauagugggucuguacgggaauggagucgugaccacguccggcacauauguuagugcaaucgcucaggccaaagcgucucaggagggcccccuuccugagauugaagacgagguguuucgaaagcggaaccugacuaucauggauuugcauccggggagcggaaaaacccgcagauaccuaccagccauugucagggaagcaaucaagcggcgacugagaacacucauauuagcucccacccgcgugguagccuccgagauggcugaagcacugaaggguaugccuauuagguaucaaacuaccgccgugaaaucagagcacacaggcaaggagaucguugaccuuaugugccaugccacguucacuaugcgucugcucucuccaguccgggugcccaauuacaacaugaucauuauggaugaagcucacuuuaccgacccuagcaguaucgcggcaagaggguauauauccacaagggugggaaugggcgaggccgcugccauuuucaugaccgcaacuccgcccgguagcgucgaagccuuuccacagucuaaugcuguaauccaggaugaggaacgcgacauuccugagcgaucauggaacuccggguacgaguggaucacagauuuccccggaaaaaccgugugguuuguuccaaguauaaagagcggcaaugacauugcgaacuguuugagaaaaaauggcaagcgggugauccagcugucgaggaagacguucgauacugaauaucaaaaaacaaagaacaacgacugggacuacgucgugaccaccgauaucucugagaugggggccaauuuccgcgcagaccguguuauugauccuagacggugccucaaacccgugauccugaaggacggaccagaaagggucauucuugcugguccgaugccugugacuguagccuccgcagcccagcgccgaggcagaauagggcggaaccauaauaaagagggagaucaguacaucuauaugggccagccccuaaacaaugacgaggaucacgcucacuggacagaagccaagaugcuguuggacaacauuaauaccccagaggguaucauccccgcguuauuugaaccugagagggaaaagagcgcagccauugauggggaguaccgccugagaggcgaggcuaggaaaacauucguggaacucaugcggcguggagaccugccaguuuggcuuucauauaaggucgccagugagggcuuucaauacucugaucgccgauggugcuucgacggggaaagaaacaaucaggugcuggaggaaaacauggauguggagauauggacuaaagagggagaaaggaagaaacuccggccccgcugguuggacgcuagaacguauuccgacccucuggcacuaagggaguuuaaggaauucgccgcuggucggcgaagcgucucaggcgaucugauccucgagauugggaaacuuccgcagcaucugacccagagagcccaaaaugcauuagacaacuugguuaugcugcacaauagugaacagggaggccgcgcguacaggcaugccauggaggagcucccagauacaaucgaaacucugaugcuucuggcucucauugccguguugaccggugggguaacacuguuuuucuuaagcggccggggacuaggcaagaccuccaucgggcugcucugugugauagcaucuagcguccuucuguggauggcuuccguggagccccacuggaucgccgcaucaauuaucuuggaauuuuuccugaugguucuccugauuccugagcccgaccgucagagaacuccacaggauaaccaacuugccuauguggucaucggacuccuguuuaugauauugacgguagcugcgaaugagaugggucuguuagaaaccacaaagaaagaccuaggcauugggcacguggccguugagaaccaucaccaugcagcuaugcuggauguggaccuccacccugccucugccuggacucuuuacgcagucgcuaccacaaucauuacccccaugaugaggcauacuaucgaaaacacaacggccaauauaagucugaccgcgaucgcuaaccaggccgcaauuuugaugggacuggauaagggcuggccaaucucgaaaauggacauuggugugccucuccuggcccuugggugcuacagccaggucaauccguuaacucugacagcugcagugcucauguugguugcccacuaugcgaucauaggccccggacugcaagcuaaggccacccgcgaggcacagaaacggaccgccgcuggcauuaugaagaacccaacaguggaugggaucguagccaucgaccuagauccuguggucuacgacgcaaaguucgaaaaacagcugggacagauuaugcuccuuauccuguguacuucccaaauauugcugaugcgaacgaccugggcucucugcgagucuauuacacuggccacuggccccuuaaccacacuuugggaggguucaccagggaaguuuuggaauaccacuaucgcgguuagcauggccaacauuuucagaggauccuaucuggcaggcgugggucucgcuuucagucuaaugaaaucucugggcgggggaaggcgcggcacgggggcccagggagaaacauugggcgagaaguggaaacggcagcugaaucagcucagcaagucagaauuuaacaccuacaagagauccgguaucauggaggucgaccguagugaagcaaaagaggggcuuaagaggggagagacuaccaaacacgcugugagccggggcacagccaagcugcgcugguucguagaacgaaauuuggugaaaccugaggguaagguuauagaucugggcugugggagaggaggcuggucuuauuacugcgccgggcucaagaaagugacugaagucaagggauauaccaaaggcggucccgggcaugaggaaccgaucccaauggcgacauacggauggaacuuagugaagcugcacuccggcaaagacgucuuuuucauuccucccgagaagugugauacgcuucugugcgacaucggcgagucaagcccaaaucccaccauugaagaggggaggacucuacgggugcucaaaaugguugaaccuuggcugcgcggaaaccaauuuuguaucaagauuuugaauccguacaugcccucgguaguggagacacuggagcagaugcagagaaagcaugguggcaugcucgucaggaacccacuuucucgaaauaguacccacgaaauguauuggguguccugcgggacuggaaacaucguuagcgcugugaauaugacaucacggaugcuguuaaaccguuucaccauggcacacagaaaaccuacguacgagcgcgaugucgaccugggcgccgguaccaggcauguggcuguagaacccgagguggccaacuuggauauaauugggcagcggaucgaaaauaucaagcacgagcauaaauccacauggcacuaugacgaggauaacccuuacaagacuugggcauaucauggaucuuacgaaguuaaaccaagcggcagugccuccagcauggucaauggcguggugaagcuccugaccaagcccugggacgucauuccuaugguuacacaaauagcuaugacugauaccacaccauuugggcagcagagaguguucaaagagaagguagacacccgcacucccaaagcgaagaggggaacggcccaaaucauggaagugacagcaaaauggcuaugggguuuucuuucucgaaacaagaagccgcggauuuguaccagagaggaauucacuaggaaaguccgcucaaaugcugccaucggcgcaguguuuguugacgagaaccaguggaauagugccaaggaggcuguggaagaugagcguuucugggaccugguccaccgggaaagagagcuccacaaacaggggaagugcgccaccugcguguauaacaugaugggaaaaagggaaaagaagcugggcgaguuugguaaagcgaaggggucccgcgcaauuugguacaugugguugggagcccgauuccuggaguucgaagcucucggcuuuaugaaugaggaucauugguucagccgggaaaacucucuuucgggcguagagggggagggacugcacaaauuagguuacauccugagagacauaucaaagaucccuggcgggaauauguaugccgaugacacagcaggaugggauacgaggauuaccgaagacgauuugcagaacgaggcuaaaaucacugacauuauggaaccagagcaugcccuccuggcuaagagcaucuuuaaacuaacauaccaaaauaagguugugcgcguccagagacccgccaagaacggcaccgugauggaugugauaucccggagggaccagcgugguagugggcaggucggaacuuauggccuuaauacauucaccaacauggaagcacaacugauucgacagauggagucugagggcaucuuuagcccuuccgaacucgagacaucaaaccuggcggggcgcguuuuggauugguuagaaaaacacggaguggagagacugaagcggauggccaucaguggugacgacuguguagugaaaccaauugaugacagguucgcuacugcccucaccgcacuuaaugauaugggcaagguccgcaaagacauaccccagugggaaccgucuaagggguggaacgauuggcagcaagugccuuuuugcagccaccauuuccaccagcugaucaugaaggacggaagagagauuguugugcccugucggaaucaggaugagcuagucggcagggcucgagugucccagggugccggguggucacugcgugaaacggcaugccucggaaaaagcuacgcccaaauguggcaguugauguauuuucauagacgcgaccugcggcuugcggcuaacgccaucuguucugcaguaccaguugauugggugccuaccuccaggacaacuuggaguauucacgcccaucaccaguggaugaccacagaggacaugcugagcgucuggaauagaguguggaucgaagagaaccccuggauggaagauaagacucacguuucguccuggggcgacgugccauaccucggcaaacgcgaggaccaauggugcgggucuuuaauaggacugaccgcucgggccacgugggcaacaaauauccaggucgcuauuaaccaggugaggcgauugcuggguaaugagaacuaucucgauuacaugaccucaaugaagagauucaaaaaugaaagcgaccccgagggcgcccuuugguga

SEQ ID NO: 13711 - RNA, 9879 nt, Artificial Sequence
  derived and/or modified CDS sequence (opt3) from DENV-1__FJ882515__SS-prME
agcgugaccaugcugcucaugcuuaugcccaccgcccuggcuuuccacuugacuacgagaggaggggaaccucauaugaucgucaccaagcaggaaaggggaaaauccuuacuguuuaagacaucugccgguguuaauaugugcacuuuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugggagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccauugggaaacuuguucaucagauauucggaacggcguacggcgugcuguuuucuggugucagcuggaccaugaagaucgggauuggcguguugcucacuuggcugggauuaaauucacgaaguacaucccugagcaugaccuguaucgcuguaggccuagugacacucuaccuggggguuaugguccaggccgauucuggaugcgugaucaacuggaaaggccgcgaacuuaagugugguucagggauuuucgugacuaaugagguccacaccuggacggaacaauauaaguuucaggcagacaguccgaaaagauugagcgccgcuauaggaaaggccugggaggagggcguuugcgguaucagguccgcaacacggcuggaaaacauuauguggaaacagaucucuaacgagcucaaucauauucuguuagaaaacgacaugaaguucaccguggugguaggcgaugucguggggauccuggcucagggcaagaagaugauacgcccucaacccauggagcacaaauacucguggaaaagcuggggcaaggccaaaaucauuggggcggacguucagaauacuaccuuuaucauugauggaccaaacacaccugaaugucccgacgaucagagagccuggaauaucugggagguggaggacuauggcuucgguauauuuacuaccaacauuuggcuuaagaugagggauuccuacacacaggucugcgaccaccguuugaugucagcugcaaucaaagauaguaaggccgugcaugcugacaugggguauuggauugaaucugagaaaaaugaaacguggaagcucgcccgggcauccuucaucgagguuaagaccuguauauggccaaaaucccacacucuguggucaaacggagugcuagaaagcgagaugaucauucccaagaucuacggcgguccuauuucucaacauaauuaucgaccaggcuacuucacacagaccgcggggccguggcaccugggaaaacucgagcuggauuuugaccuuugcgaaggcacuacaguagucguggaugagcacugcgggaacagaggacccuccuugaggaccacgacugugaccggcaagaucauacaugaaugguguugccgcaguuguacacugccuccauuacgguucaaaggugaggacgggugcugguacggaauggagauuagacccgucaaggaaaaggaggaaaaucucguuaaaagcauggugucugccggcuccggugagguagacucauuuagucugggccuucuguguaucagcaucaugauugaagaggugaugaggucgcgcuggucccgaaagauguugaugaccgggacucucgcugucuuccugcuacugaucaugggacagcucacauggaacgaucugauucggcuuugcauaauggugggcgccaaugcaucugaccguauggggaugggaaccacauauuuggcucugauggccacuuuuaaaaugagaccuauguucgcaguuggcuuacucuuuaggcgccugaccagccgggaggugcuucugcuaacgaucggucucucacuggucgccaguguggaauugccaaacucccuggaggaauuaggggauggacucgcuaugggcauuaugauccugaaacuucugacagacuuccaaucucaccaguugugggcgacccuccugagccuaacuuuuauuaaaaccacacugucccuucauuacgccuggaagacuauggcaaugguucucucaaucgugagccugauacccuugugucugaguaccacgucucagaagacaaccugguuaccgguccuccugggcucccuugggugcaaaccucugacuauguucuugaucgcugagaauaagauuuggggaagaaaaagcuggccacucaacgaagguaucauggccguaggcgugguuucgauucugcuaucaucucugcuuaagaacgaugugccccucgccgggccucugaucgcuggaggcauguugauagcauguuaugucauuagugguuccagcgccgacuuaucucuggagaaagcggcugaggugagcugggaagaggaagccgagcacuccggggcaucacauaauauccucguagaagugcaggaugacggaacaaugaagaucaaagaugaggagagggacgauacccugacuauucuucugaaggccacauugcuagcugucaguggcguuuacccccugagcauaccagcaacccucuuugugugguauuucuggcaaaagaaaaagcagcgaucuggcgugcugugggacacgccuucacccccagaagucgagcgcgccgugcuugaugacgggaucuaccggauuaugcagagaggauuacuggguaggagccagguuggcguagggguguuucaagaaaacgucuuccacacuauguggcacgugacccguggagcgguucucauguaucagggcaaacgcuuggagccgaguugggcuagcgugaagaaagaccugaucuccuacggugggggauggcggcuccagggcucuuggaauacaggcgaggaaguccaggugauugccguagagccugggaagaaccccaagaauguccaaaccgcaccaggaacauucaaaacucccgaaggugaggugggcgccaucgcucuggauuuuaagccugggaccucgggaagcccaauaguuaacagagaaggcaaaaucgugggucuuuacgggaauggagucgugacgacaucaggcacuuauguuuccgccauugcacaggcuaaggccagucaggagggcccccugccugagaucgaagacgagguguucaggaaacgaaacuugaccauuauggaucuacauccggggucuggaaagacacggcgcuaccugccagcgaucgucagagaagccauaaagaggaaacuccggaccuuaauucuggcacccacucgagugguagcuagcgagauggccgaagcucuuaaggguaugccuaucagauaucaaaccacagcagugaaauccgagcacacgggcaaggagaucguugaccugaugugccaugccacuuuuaccaugcgccucuugucaccagucagggugcccaauuacaacaugauuaucauggaugaagcccacuucacagacccuucuagcauagcugcgcguggguauauuaguacccgggugggaaugggcgaggcagccgcuaucuuuaugacugccacaccgcccgguuccgucgaagcauucccacagagcaaugccguaauucaggaugaggaaagagacaucccugagaggucuuggaacucaggguacgaguggauaaccgauuuucccggaaaaacggugugguucguuccauccauuaagaguggcaaugacaucgcuaacugucugcgcaagaauggcaaacgagugauccagcucagcagaaagacuuuugauacagaauaucagaagaccaagaacaacgacugggacuacgucgugaccacugauauuucggagaugggggcgaauuuccgggccgacaggguuaucgauccucgccguugccugaaacccgugauucuuaaggacggaccagaaagagucauacuagcagguccgaugccugugacaguagcuucugccgcacagcggaggggccgcaucgggcgaaaccauaauaaggagggagaucaguacauuuauaugggccagccccugaacaaugacgaggaucacgcccacuggaccgaagcuaaaauguuguuagacaacaucaauacaccagaggguaucauucccgcccuguuugaaccugagagagaaaaguccgcggcaauagauggggaguaccggcucaggggcgaggcccgcaaaacuuucguggaacugaugagaaggggagaccuuccaguuuggcugagcuauaaggucgcuucagagggcuuccaauacagugaucggcguuggugcuuugacggggaacgcaacaaucaggugcucgaggaaaacauggauguggagaucuggacgaaagagggagaacgaaagaaauugagacccagguggcuggacgcccggaccuauucugacccucuagcucugcgcgaguucaaggaauuugcagccgguagaagguccgucagcggcgaucucauucuugagaucgggaagcugccgcagcauuuaacacagcgggcucaaaaugccuuggacaaccugguuaugcuccacaauucagaacagggaggccgagcauacagacaugcgauggaggagcugccagauacuauugaaacccuuaugcugcucgccuugaucgcugugcugacaggugggguaaccuuauucuuucuaaguggccgcggacugggcaaaacuagcauagggcuccuuugugugauggccuccucuguccuguuguggauggcaagcguggagccccacuggaucgcugccuccauuauccuggaguucuuucucaugguucugcuuauuccugagcccgacaggcagcggacgccacaggauaaccaacucgcauauguggucaucggacuguuguucaugauacugaccguagccgcuaaugagauggguuuacuagaaacaacuaagaaagaccugggcauugggcacguggcgguugagaaccaucaccaugccaccaugcucgauguggaccuucacccugcaucagcuuggacacuguacgccgucgccaccacuaucauuacacccaugaugcgucauacgaucgaaaacaccacugcaaauauaucuuugacagcuaucgccaaccaggcggcuauucugaugggacucgauaagggcuggccaaucaguaaaauggacauuggugugccucugcuugccuuagggugcuacucgcaggucaauccgcugacccucaccgcagccguguugaugcugguugcucacuaugcaaucauaggccccggacuacaagccaaggcgacaagagaggcucagaagaggacugccgcaggcauuaugaaaaacccaacgguggaugggaucguagccaucgaccuggauccuguggucuacgacgcuaaguuugaaaaacagcucggacagauuaugcuucugaucuuguguaccagccaaauacugcucaugcgcacaacuugggcccugugcgaguccauuaccuuagcaacaggcccccuuaccacucugugggaggguucuccagggaaguucuggaauacgacaaucgcuguuucaauggccaacauuuuucggggaagcuaucucgcgggcgccggucuagcauucucccugaugaaaaguuugggcgggggacgaagaggcaccggggcucagggagaaacucugggcgagaaguggaagaggcagcucaaucagcuuucuaaaagcgaauuuaacaucuacaagcgcucagguauaauggagguggaccgguccgaagccaaagaggggcugaagagaggagagaccacacgucacgcagucaguaggggcacugcuaaauugcggugguucguggaacgcaaucugguaaagccugaggguaaggugaucgaucucggcugugggcgaggaggcuggagcuauuacugcgccgggcuaaagaagguuaccgaagugaaaggauauacaaagggcggucccgggcaugaggaaccgauuccaauggccacguacggauggaaccuggucaaacuucacucuggcaaggacguguucuuuaccccucccgagaaaugugauacucugcuaugcgacaucggcgaguccucaccaaaucccacaauugaagaggggagaacccucaggguccugaagaugguggaaccuugguugcggggaaaccaauucuguaucaagauucugaauccguacaugcccagcguuguagagacucucgagcagaugcagcgcaaacaugguggcaugcuugugagaaacccacugucgagaaauucuacacacgaaauguauugggucaguugcgggaccggaaacaucguguccgcgguuaauaugacgagccgaauguuacugaaccgguuuaccauggcucaccguaagccuacauacgagaaagauguggacuugggcgcagguacuagacaugucgccguggaacccgagguagcuaaccucgauauaauugggcagcgcaucgaaaauaucaagcacgagcauaaaucaaccuggcacuaugacgaggauaacccuuacaagacaugggccuaucauggauccuacgaagugaagccaucuggcagcgcaaguuccaugguuaauggcgucgugaaacugcuaacuaagcccugggacgugauuccuauggucacccaaauagccaugacagauaccacuccauucgggcagcagaggguuuuuaaagagaagguggacacgcggacacccaaagcuaagagaggaaccguacaaaucauggaagugacugcgcgcuggcuuugggguuuccugagcaggaacaagaaaccgcgaauuuguacccgggaggaauuuacaagaaaggucaggucuaaugccgcaaucggcgcuguguucguugacgagaaccaguggaacucagccaaagaggcaguggaagaugagcgcuuuugggaccucguccagaaggaacgugagcugcacaaacaggggaagugcgccacgugcguguauaacaugaugggaaagcgggagaaaaaguugggcgaguucgguaaagcuaaggggaguagagccauuugguacauguggcugggagcgagguuucucgaguucgaagcacuuggcuuuaugaaugaggaucacugguucucccgcgaaaacagccugucuggcguagagggggagggauuacauaaacuggguuacaucuugcgagacauaucgaagaucccuggcgggaauauguaugccgaugacaccgcuggaugggauacucggauuacagaagacgaucuccaaaacgaggccaaaaucaccgacauuauggaaccagagcacgcacugcuagcuacuucaaucuucaaacuuacauaccagaauaagguugugagaguccagaggcccgccaaaaacggcaccgugauggaugugauaagccgcagagaccagcgggguuccgggcaagucggaacauauggccugaauacuuuuaccaacauggaagcucagcucauuaggcagauggagagugagggcaucuuccugccuucugaauuggagacgccaaacuuagccgaacguguucuggauuggcucgagaaguacgggguggaacgacuuaaacgcauggcaaucagcggagacgacuguguagugaagcccauugaugacagauuugcgaccgcccugacagcucuaaaugauauggguaaaguccggaaggacauaccgcagugggagccuuccaagggcuggaacgauuggccccaagugccacauugcucacaccacuuccaucagcugaucaugaaagacgggagggagauuguugugccuugucgcaaucaggaugaacucgucggaagggcacgggugagucagggcgcagguuggucuuugagggagacugcuugccugggaaagagcuaugcccaaauguggcagcuuauguacuuucaccgacgugaccugagacucgcagccaacgcgaucuguuccgcuguacccguugauugggugccaaccucacgcacaacuuggagcauucaugcccaccaucaguggaugaccacggaagacauguuaucugucuggaaucggguguggaucgaggaaaaccccuggauggaggauaaaacacacguuuccaguuggggagacgugccuuaucugggcaagagggaggaccaauggugcggcagcuugauagggcugaccgcaagagccacuugggcuucgaauauccaggucgccauuaaccaggugcgccggcucaucggaaaugaaaacuaccuugauuacaugacauccaugaaaagguucaagaaugaggacgauccagaaggugcacugugguga

SEQ ID NO: 13712 - RNA, 9879 nt, Artificial Sequence
  derived and/or modified CDS sequence (opt3) from DENV-1__FJ882517__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucaccccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacuagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaagaggccuugaagcugucaugguuuaagaaaggcaguagcaucggaaagauguucgaagcaacugccagaggcgcuaggcggauggccauccucggggauaccgcaugggacuuuggauccauugguggcguuuucacaucuguggggaaacugguccaucagaucuuuggaacggcguacggcgugcuuuucagcgguguaucauggaccaugaagauugggauaggcgugcuguugacuuggcucggacugaauagucgauccacaagcuuaucuaugaccuguaucgcuguuggccuggucacacuauaccucggggugauggugcaggccgauucaggaugcgucauuaacuggaaaggccgcgagcugaagugugguagugggaucuuuguuacuaaugaagugcacaccuggacggagcaguauaaguuccaagcagacagcccgaaaagacuuuccgccgcuaucggaaaggccugggaggaaggcgugugcgguauuaggucugcaacacgguuggagaacauaauguggaaacagaucucgaacgaacugaaucauauucuccuggagaacgacaugaaguuuaccguagucgugggcgauguugcugggaucuuagcccagggaaaaaagaugauucgcccucagcccauggaauacaaauauagcuggaaguccuggggcaaggcgaaaaucauaggggccgacgugcaaaauacuaccuucaucauugauggaccaaacacaccugagugucccgacgaucagagagcuuggaauaucugggaggucgaagacuacggcuuugguauuuucacuaccaacaucuggcugaagcuuagggauucauauacacaggugugcgaccaccguuugaugagugcagccauaaaagauucuaaggcuguucacgccgacaugggguacuggauugagagcgaaaaaaaugagacguggaagcucgcacgggcguccuucaucgaagugaagaccuguauuuggccaaaaucacauacucuguggagcaacggaguacuagagucugagaugaucauacccaagaucuauggcgguccuauuucccagcacaauuaccgaccaggcuacuuuacacaaaccgccgggccguggcaucugggaaaacucgaacuggauuucgaccuuugcgagggcacuacagucgugguggaugaacacugcgggaacagaggacccaguuugaggaccacgacugucaccggcaagaucauucacgagugguguugccgcagcuguacacugccuccauuacgguuuaaaggugaggacgggugcugguauggaauggaaaucagacccguuaaggagaaggaagagaaucucgugaaaucuaugguauccgcuggcucaggugaaguggacaguuucagccugggccuucuguguauaucgauuaugaucgaggaggucaugaggucccgcuggucucgaaagauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggugacuuuuaaaaugagaccuauguucgcagucggccuguuauuuaggcgccucaccucacgggaagugcugcuucugacgauuggucuaagucucguugccuccguggagcugccaaacucuuuggaagagcugggggauggauuagcuaugggcauaaugauccucaagcugcuuacagacuuccagagccaucaacugugggcgaccuugcucucccugacuuuuauuaaaaccacauucucacuacacuaugccuggaagacuauggcaaugguccugagcaucguaagucuuuuuccccucugucugucuaccacgucccagaagacaaccugguugccggugcuguuaggcagccucgggugcaaaccucugacuauguuccuuauugcugaaaauaagaucuggggaagaaaaucguggccacugaacgaggguauaauggccguuggcaucgugucaauuuugcucucuagucugcuaaagaacgaugucccccuggccgggccucuuaucgcuggaggcaugcucauugcauguuacgugaucuccgguagcucugccgaccugagcuuggagaaagcggcugaaguauccugggaggaagaggccgaacauucaggggcaagucacaauauauuaguggagguccaggaugacggaacaaugaagauuaaagaugaggaaagggacgauacccugacuauccuccugaaggccacacuucuggcuguuagcggcguguaucccuugucuaucccagcaacccuauucgugugguacuuuuggcagaagaaaaagcaacgauccggcguccugugggacacgccuucacccccagagguggaacgcgccguucucgaugacgggauuuaucggauaaugcagagaggacugcuugguaggagucagguaggcgugggggucuuccaggagaacguguuucauacuauguggcacguuacccguggagcgguguuaauguaccaaggcaaacgccuggagccgagcugggcuuccgucaagaaagaccucaucucuuacggugggggauggcgguugcagggcucguggaauacaggcgaagaggugcagguaauugccgucgaaccugggaagaaccccaagaaugugcagaccgcaccaggaacauucaaaacuagcgagggugaaguuggcgccaucgcucuggauuuuaagcccgggaccucaggauccccuauugugaacagagagggcaaaaucgucggucucuaugggaauggagugguuacgacaaguggcacuuacgugucugccauagcacaagcuaaggccagccaggagggcccacugcccgaaaucgaggacgaagucuucaggaaacgaaaccuuaccauuauggaucugcacccuggguccggaaagacacggcgcuauuugccggcgaucgugagagaggccauuaagaggaaacuacggacccugauccucgcaccaacucgaguaguggcuucagaaauggccgaggcuuuaaaggguaugcccauaagauaccagaccacagcaguuaaaucugagcauacgggcaaggaaauugucgaccugaugugccacgccacuuuuaccaugcgccuucugagcccugugagggugccaaauuauaacaugaucaucauggaugaggcccauuucacagaccccaguuccauugcugcgcguggguacaucagcacccgggucggaaugggcgaagcagccgcuauauuuaugacugccacaccuccggguucuguagaggcauucccccaaucaaaugccgugauucaggaugaagagagagacaucccagagagguccuggaacaguggguaugaauggauuaccgauuuuccuggaaaaacgguuugguucgugcccagcaucaagucgggcaaugacauagcuaacugucuccgcaagaauggcaaacgagucauucaguugucuagaaagacuuucgauacagaguaccagaaaaccaagaacaacgacugggacuacgugguuaccacugauaucuccgaaaugggggcgaauuuucgggccgacagggugaucgauccacgccguugccugaaaccugucauucucaaggacggacccgagagagugauccuggcagguccaaugccgguaacaguggcuagcgccgcacaacggaggggccgcauugggcgaaaccacaauaaggagggagaucaguauauauacaugggccagccucuuaacaaugacgaagaucaugcccacuggaccgaggcuaaaaugcuacuggacaacaucaauacacccgaagguauuaucccagccuuguucgagcccgaaagagagaagucagcggcaaucgauggggaguaucgguuaaggggcgaagcccgcaaaacuuuuguugagcugaugagaaggggagaccucccugucuggcugaguuacaagguggcuucugaaggcuuccaguauuccgaucggcguuggugcuuugacggggagcgcaacaaucaagugcuugaagagaacauggaugucgagauuuggacgaaagaaggagagcgaaagaaacugagaccaagguggcucgacgcccggaccuacagcgaccccuuggcucugcgcgaauucaaggaguuugcagccgguagaaggucaguuaguggcgaucuaauacuggaaaucgggaagcucccucagcaccuuacacagcgggcucagaaugcccuggacaacuuagugauguugcauaauagcgagcaaggaggccgagcauauagacacgcgauggaggaacugccggauacuauugagacccucaugcugcuugcccugaucgcuguacucacagguggggugaccuuguucuuucuguccggccgcggauuaggcaaaacuucuauugggcuacugugugucauggccagcuccgugcuccuuuggauggcaucaguugaaccacauuggaucgcugccucuauaauccuggaguucuuuuugauggugcugcucauucccgagccugacaggcagcggacgccccaggauaaccagcuggcauacgucguaaucggacuucucuucaugauucugaccguggccgcuaaugaaauggguuugcuggagacaacuaagaaagacuuaggcaucgggcacguugcgguggaaaaccaccaucacgccgcaaugcuagaugucgaccugcauccagcuagugccuggacccucuacgccguggcaacaaccauaauuacuccuaugaugcgucacacaaucgagaacacgaccgcuaauauuucgcuuacugccaucgcgaaccaagcugccauacugaugggauuggauaagggcuggcccaucagcaaaauggacauuggugucccacugcucgcacuggggugcuauucccaggugaauccucuuacauuaaccgccgcuguucugaugcucguggcacauuacgccaucauuggcccgggauugcaggcgaaggcuaccagagaagcccaaaagaggacagcagccggcaucaugaaaaaccccacuguagaugggauaguggcuauugaccuggauccagucguuuaugacacgaaguuugagaaacagcuaggacagaucaugcugcucauccuuuguaccucucagauucuguugaugcgcacaacuugggcccugugcgagucaaucacccucgcaacaggcccucugaccacuuuaugggaagguagccccgggaaguucuggaauacgacaauagcuguguccauggccaacauuuuccggggaaguuaccuugcgggcgccggucuggcauuuucucucaugaaaagccuaggcgggggacgaagaggcaccggggcucaaggagagacucugggcgaaaaguggaagaggcaguugaaucagcugucaaaauccgaguucaacaccuauaagcgcagugguaucauggaagucgaccggagcgaggccaaagaggggcucaagagaggagaaacaacuaaacacgcagugucucguggcaccgcuaagcuuaggugguuuguagagcggaaucuggugaagccagaagguaaaguuauugauuugggcugugggcgcggaggcugguccuacuauugcgccgggcugaagaaagugacagaggucaagggauacacgaaaggcgguccugggcacgaagagcccaucccgauggccaccuacggauggaaccucgugaaguuacauucaggcaaagacgucuucuuuauaccaccugagaagugugauacucugcuuugcgacaucggcgaaagcucgcccaauccaacaauugaggaagggcgaacccugagagugcuaaagaugguugagcccuggcucaggggaaaccaguucuguaucaaaauucugaauccuuauaugccgucuguaguggagacuuuggaacaaaugcagcggaagcacgguggcaugcugguccgcaacccccucaguagaaauuccacacaugagauguacugggugagcugcgggaccggaaacaucguuucagcggugaauaugacguccaggaugcuucugaaccgauuuaccauggcucaccggaaaccaacauaugaacgugaugucgacuuaggcgcagguacuagacacguggccguagagccugaaguggcuaaccuggauauuaucgggcagcgcauagagaauauuaagcaugagcacaaaucuaccuggcauuacgacgaagauaaccccuauaagacaugggccuaccacggaagcuaugagguuaagccuaguggcuccgcaagcucuauggucaauggcguggugaaauugcucacuaagccaugggacgucauccccaugguuacccagaucgccaugacagauaccacuccuuucgggcaacagaggguguuuaaagaaaagguagacacgcggacaccaaaagcuaagagaggaaccgcgcagauuauggaggugacugccaaguggcugugggguuuccuaucacgcaacaaaaagcccaggauauguacccgagaagaguuuacacggaaagucagaaguaaugcagcuaucggcgccguguucguugacgagaaccaauggaauuccgcaaaggaagccguggaggaugaaagguuuugggaccuuguccaucgcgagcgugaacugcacaaacaggggaagugcgcuacgugcguguacaacaugaugggaaagcgggagaaaaagcucggcgaguucgguaaagccaaggggagcagagcgauuugguacauguggcugggagcaagguucuuggaauuugaggcccugggcuucaugaaugaagaucacugguuuucucgcgagaacucgcucucaggcguagagggggaaggacuucauaaacuggguuauaucuuacgagacauuagcaagaucccgggcgggaauauguacgcugaugacaccgccggaugggauacucggauaacagaggacgaucugcagaacgaagcaaaaaucaccgacauuauggagccugaacacgcuuugcucgccaaguccaucuucaagcugacuuaucagaauaaaguugugagaguccaaaggccagcuaagaacggcacagugauggaugugauuagucgcagagaccagcgggguucugggcaggucggaaccuacggccuaaauacauuuacuaacauggaggcccagcuuaucaggcaaauggagagcgaaggcauauucucccccucagagcuggaaaccccuaaccucgcagggcguguucuggauugguuggagaaacauggaguggaacgauuaaagcgcauggcgauuaguggugacgacuguguagugaaaccaaucgaugacagauuugccacggcucugaccgcccucaaugauaugggcaagguccggaaggacaucccccagugggagccgucuaaaggguggaacgauuggcagcaggugccuuucugcagccaccacuuucaucaacuuauuaugaaggacggaagggagauaguugugcccugucgcaaucaggaugaacuggucggcagagcacgggugucccagggugcuggguggucacuaagggagacagccugccugggaaaaagcuaugcacagauguggcaacucauguacuuccaccgacgugacuugagacuggccgcgaacgcuaucuguucugccguaccaguugauugggugccuacuucccgcaccacauggaguauucaugcacaccaucaguggaugacuaccgaagacaugcuuagcgucuggaaucggguguggaucgaggaaaaccccuggauggaggauaagacgcacauuucguccuggggcgacguuccauaucugggcaaaagggaggaccaguggugcgggucucucaucggauuaacagccagagcuaccugggccacuaauauacaaguggcaaucaaccagguccgccggcugauugguaaugaaaacuacuuggauuacaugacaucaaugaagagguuuaagaaugagagcgaccccgaaggcgcucugugguga

SEQ ID NO: 13713 - RNA, 9879 nt, Artificial Sequence
  derived and/or modified CDS sequence (opt3) from DENV-1__JQ287661__SS-prME
agcgugaccaugcugcucaugcuuaugcccaccgcccuggcuuuccacuugacuacgagaggaggggagccucauaugaucgucaccaagcaggaaaggggaaaauccuuacuguuuaagacaucugccgguguuaauaugugcacuuuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccauugggaaacuuguucaucagauauucggaacggcguacggcgugcuguuuucuggugucagcuggaccaugaagaucgggauuggcguguugcucacuuggcugggauuaaauucacgaaguacaucccugagcaugaccuguaucgcuguaggccuagugacacucuaccuggggguuaugguccaggccgauucuggaugcgugaucaacuggaaaggccgcgaacuuaagugugguucagggauuuucgugacuaaugagguccacaccuggacggaacaauauaaguuucaggcagacaguccgaaaagauugagcgccgcuauaggaaaggccugggaggagggcguuugcgguaucagguccgcaacacggcuggaaaacgugauguggaaacagauuucuaacgagcucaaucauauccuguuagaaaacgacaugaaguucaccgugguagucggcgaugugguugggauucuggcucagggcaagaagaugauccgcccucaacccauggagcacaaauacucguggaaaagcuggggcaaggccaaaauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaagaugagggauuccuacacacaggugugcgaccaccguuugaugucagcugcaauuaaagauaguaaggccguucaugcugacaugggguauuggaucgaaucugagaaaaaugaaacguggaagcucgcccgggcauccuucauugaggugaagaccuguaucuggccaaaaucccacacucuguggucaaacggaguacuagaaagcgagaugauaauccccaagauuuacggcgguccuaucucucaacauaauuaucgaccaggcuacuucacacagaccgcggggccguggcaccugggaaaacucgagcuggauuuugaccuuugcgaaggcacuacagucgugguggaugagcacugcgggaacagaggacccuccuugaggaccacgacugucaccggcaagauuauccaugaaugguguugccgcaguuguacacugccuccauuacgguucaaaggugaggacgggugcugguacggaauggagauaagacccguuaaggaaaaggaggaaaaucucgugaaaagcaugguaucugccggcuccggugagguggacucauuuagucugggccuucuguguauuagcaucaugaucgaagaggucaugaggucgcgcuggucccgaaagauguugaugaccgggacucucgcuguguuccugcuacugauuaugggacagcucacauggaacgaucugauccggcuuugcauuaugguuggcgccaaugcaucugaccguauggggaugggaaccacauauuuggcucugauggccacuuuuaaaaugagaccuauguucgcagugggcuuacucuuuaggcgccugaccagccgggagguccuucugcuaacgauaggucucucacugguggccaguguugaauugccaaacucccuggaggaauuaggggauggacucgcuaugggcaucaugauucugaaacuucugacagacuuccaaucucaccaguugugggcgacccuccugagccuaacuuuuaucaaaaccacacugucccuucauuacgccuggaagacuauggcaauggugcucucaauugucagccugauccccuugugucugaguaccacgucucagaagacaaccugguuaccgguacuccugggcucccuugggugcaaaccucugacuauguucuugauagcugagaauaagaucuggggaagaaaaagcuggccacucaacgaagguauuauggccgugggcguugugucgauccugcuaucaucucugcuuaagaacgaugucccccucgccgggccucugauugcuggaggcauguugaucgcauguuaugugauaagugguuccagcgccgacuuaucucuggagaaagcggcugagguaagcugggaagaggaagccgagcacuccggggcaucacauaauauucucguggaaguccaggaugacggaacaaugaagaucaaagaugaggagagggacgauacccugacuauccuucugaaggccacauugcuagcuguuaguggcguguacccccugagcauuccagcaacccucuuugugugguauuucuggcaaaagaaaaagcagcgaucuggcguccugugggacacgccuucacccccagaaguggagcgcgccguucuugaugacgggauauaccggaucaugcagagaggauuacuggguaggagccagguaggcgugggggucuuucaagaaaacguguuccacacuauguggcacguuacccguggagcggugcucauguaucagggcaaacgcuuggagccgaguugggcuagcgucaagaaagaccugauuuccuacggugggggauggcggcuccagggcucuuggaauacaggcgaggaagugcagguaaucgccgucgagccugggaagaaccccaagaaugugcaaaccgcaccaggaacauucaaaacucccgaaggugagguuggcgccauugcucuggauuuuaagccugggaccucgggaagcccaaucgugaacagagaaggcaaaauagucggucuuuacgggaauggagugguuacgacaucaggcacuuauguguccgccaucgcacaggcuaaggccagucaggagggcccccugccugagauugaagacgaggucuucaggaaacgaaacuugaccaucauggaucuacauccggggucuggaaagacacggcgcuaccugccagcgauugugagagaagccaucaagaggaaacuccggaccuuaauacuggcacccacucgaguaguggcuagcgagauggccgaagcucuuaaggguaugccuauuagauaucaaaccacagcaguuaaauccgagcacacgggcaaggagaucgucgaccugaugugccaugccacuuuuaccaugcgccucuugucaccagugagggugcccaauuacaacaugaucauuauggaugaagcccacuucacagacccuucuagcaucgcugcgcguggguauauaaguacccgggucggaaugggcgaggcagccgcuauuuuuaugacugccacaccgcccgguuccguagaagcauucccacagagcaaugccgugauccaggaugaggaaagagacauuccugagaggucuuggaacucaggguacgaguggaucaccgauuuucccggaaaaacgguuugguucgugccauccauaaagaguggcaaugacauugcuaacugucugcgcaagaauggcaaacgagucauccagcucagcagaaagacuuuugauacagaauaucagaagaccaagaacaacgacugggacuacgugguuaccacugauaucucggagaugggggcgaauuuccgggccgacagggugauugauccucgccguugccugaaacccgucauccuuaaggacggaccagaaagagugauucuagcagguccgaugccuguaacaguggcuucugccgcacagcggaggggccgcauagggcgaaaccauaauaaggagggagaucaguacaucuauaugggccagccccugaacaaugacgaggaucacgcccacuggaccgaagcuaaaauguuguuagacaacauuaauacaccagaggguaucauccccgcccuguuugaaccugagagagaaaaguccgcggcaauugauggggaguaccggcucaggggcgaggcccgcaaaacuuucguugaacugaugagaaggggagaccuuccagucuggcugagcuauaagguggcuucagagggcuuccaauacagugaucggcguuggugcuuugacggggaacgcaacaaucaggugcucgaggaaaacauggaugucgagauauggacgaaagagggagaacgaaagaaauugagacccagguggcuggacgcccggaccuauucugacccucuagcucugcgcgaguucaaggaauuugcagccgguagaagguccguuagcggcgaucucauccuugagauugggaagcugccgcagcauuuaacacagcgggcucaaaaugccuuggacaaccuggugaugcuccacaauucagaacagggaggccgagcauacagacaugcgauggaggagcugccagauacuaucgaaacccuuaugcugcucgccuugauugcuguacugacagguggggugaccuuauucuuucuaaguggccgcggacugggcaaaacuagcaucgggcuccuuugugucauggccuccucugugcuguuguggauggcaagcguugagccccacuggauagcugccuccaucauucuggaguucuuucucauggugcugcuuaucccugagcccgacaggcagcggacgccacaggauaaccaacucgcauaugucguaauuggacuguuguucaugauccugaccguggccgcuaaugagauggguuuacuagaaacaacuaagaaagaccugggcauagggcacguugcgguggagaaccaucaccaugccaccaugcucgaugucgaccuucacccugcaucagcuuggacacuguacgccguggccaccacuauuaucacacccaugaugcgucauacgauugaaaacaccacugcaaauaucucuuugacagcuauagccaaccaggcggcuauccugaugggacucgauaagggcuggccaauuaguaaaauggacaucggugucccucugcuugccuuagggugcuacagccaggugaauccgcugacccucaccgcagccguuuugaugcugguggcucacuaugcaauuaucggccccggacuacaagccaaggcgacaagagaggcucagaagaggacugccgcaggcauaaugaaaaacccaacgguagaugggauuguggccaucgaccuggauccugucguuuacgacgcuaaguuugaaaaacagcucggacagaucaugcuucugauuuuguguaccagccaaauccugcucaugcgcacaacuugggcccugugcgaguccauaaccuuagcaacaggcccccuuaccacucugugggaggguucuccagggaaguucuggaauacgacaauugcugugucaauggccaacaucuuucggggaagcuaucucgcgggcgccggucuagcauucucccugaugaaaaguuugggcgggggacgaagaggcaccggggcucagggagaaacucugggcgagaaguggaagaggcagcucaaucagcuuucuaaaagcgaauuuaacauuuacaagcgcucagguaucauggaggucgaccgguccgaagccaaagaggggcugaagagaggagagaccacacgucacgcagugaguaggggcacugcuaaauugcggugguucguagaacgcaaucuggugaagccugaggguaagguuauagaucucggcugugggcgaggaggcuggagcuauuacugcgccgggcuaaagaaggugaccgaagucaaaggauauacaaagggcggucccgggcaugaggaaccgaucccaauggccacguacggauggaaccuggugaaacuucacucuggcaaggacgucuucuuuaccccucccgagaaaugugauacucugcuaugcgacauuggcgaguccucaccaaaucccacaaucgaagaggggagaacccucagggugcugaagaugguugaaccuugguugcggggaaaccaauucuguauuaagauccugaauccguacaugcccagcguaguggagacucucgagcagaugcagcgcaaacaugguggcaugcuugucagaaacccacugucgagaaauucuacacacgaaauguauugggugaguugcgggaccggaaacauuguuuccgcggugaauaugacgagccgaauguuacugaaccgguuuaccauggcucaccguaagccuacauacgagaaagaugucgacuugggcgcagguacuagacauguggccguagaacccgagguggcuaaccucgauaucauagggcagcgcauugaaaauaucaagcacgagcauaaaucaaccuggcacuaugacgaggauaacccuuacaagacaugggccuaucauggauccuacgaaguuaagccaucuggcagcgcaaguuccauggucaauggcguggugaaacugcuaacuaagcccugggacgucaucccuaugguuacccaaauugccaugacagauaccacuccauucgggcagcagaggguguuuaaagagaagguagacacgcggacacccaaagcuaagagaggaaccgugcaaauaauggaagucacugcgcgcuggcuuugggguuuccugagcaggaacaagaaaccgcgaaucuguacccgggaggaauuuacaagaaaggugaggucuaaugccgcaauuggcgcuguuuucguggacgagaaccaguggaacucagccaaagaggcagucgaagaugagcgcuuuugggaccucgugaagaaagaacgugagcugcacaagcaggggaagugcgccacgugcguauauaacaugaugggaaaacgggaaaagaaauugggcgaguucgguaaggcuaaagggaguagagccaucugguacauguggcugggagcgagguuucucgaguucgaagcacuuggcuuuaugaaugaggaucacugguucucccgcgaaaacagccugucuggcguugagggggagggauuacauaagcuggguuacauuuugcgagacaucucgaaaauaccuggcgggaauauguaugccgaugacaccgcuggaugggauacucggaucacagaagacgaucuccagaacgaggccaagauuaccgacaucauggaaccagagcacgcacugcuagcuacuucaauuuucaaacuuacauaccaaaauaaaguggucagagugcagaggcccgccaagaacggcaccgugauggaugucaucagccgcagagaccagcgggguuccgggcagguuggaacauauggccugaauacuuuuaccaacauggaagcucaacucauaaggcagauggagagugagggcauuuuccugccuucugaauuggagacgccaaacuuagccgaacgugugcuggauuggcucgagaaauacgggguagaacgacuuaagcgcauggcaaucagcggagacgacuguguggucaaacccaucgaugacagauuugcgaccgcccugacagcucuaaaugauauggguaaggugcggaaggacauuccgcagugggagccuuccaaaggcuggaacgauuggcagcaaguucccuucugcucacaucacuuucaccagcugauaaugaaggacgggagggagaucguggucccaugucgcaaucaggaugaacucgugggaagggcacggguaagucagggcgcagguuggucuuugagggagacugcuugccuggggaaaagcuaugcccaaauguggcagcuuauguacuuccaucgacgugaccugagacucgcagccaacgcgauuuguuccgcuguuccuguggauuggguccccaccucacgcacaacuuggagcauccacgcccaucaccaguggaugaccacggaagacauguuaucuguguggaaucggguuuggauugaggaaaacccauggauggaggauaagacacauguguccaguuggggagacguccccuaucugggcaaaagggaggaccaauggugcggcagcuugaucgggcugaccgcaagagccacuugggcuucgaauauacagguggccaucaaccagguacgccggcucauuggaaaugaaaacuaccuugauuacaugacauccaugaagagguuuaagaaugagggugacccugaaggcgcacugugguga

SEQ ID NO: 13714 - RNA, 9879 nt, Artificial Sequence
  derived and/or modified CDS sequence (opt3) from DENV-1__FJ882518__SS-prME
agcgugaccaugcugcucaugcuuaugcccaccgcacuggcuuuccacuugacuacgagaggaggggagccucauaugaucgucaccaagcaggaaaggggaaaauccuuacuguuuaagacaucugccgguguuaacaugugcacucuaauugccauggaccucggagagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaggaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggcagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccauccacaccugaaugucccgacgaucagagagccuggaacaucugggagguggaggacuauggcuucgguauuuuuacuaccaauaucuggcuuaaguugagggauucauacacacagguuugcgaccaccgucucaugagugcugcaauaaaagauucuaaggccgugcaugcugacaugggguauuggauugaaagcgagaaaaacgaaacguggaagcuggcccgggcauccuucaucgagguaaagaccuguauuuggccaaaaucacacacucuauggagcaauggaguccuggaaucugagaugaucauacccaagaucuacggcgguccuauuucccaacauaacuaucgaccaggcuacuucacacagaccgcggggccguggcaccucggaaaacuggagcuugauuuugacuugugcgaaggcacuacagugguggucgaugagcacugcgggaauagaggacccagucugaggaccacgacuguuaccggcaagaucauucaugaaugguguugccgcagcuguacauuaccuccacuccgguucaaaggugaggacgggugcugguacggaauggagaucagacccgugaaggaaaaggaggaaaaccugguaaaaucuaugguguccgccggcucaggugaggucgacaguuuuagccuuggccuguuguguauaucgauuaugaucgaagaggugaugaggucccgcuggucucgaaagaugcucaugaccgggacucuggcuguuuuccuacugcucaucaugggacagcugacauggaaugaucuuauucgguugugcaucauggugggcgccaacgcaagcgaccguauggggaugggaaccacauaucuggcuuuaauggccacuuuuaaaaugagaccuauguucgcagucggccuccuguuuaggcgccuuaccucacgggaggugcugcuacucacgauuggucugaguuugguugccuccguggaacugccaaauucuuuagaggaacucggggauggacuggcuaugggcauaaugauccuuaagcuguugacagacuuccaaagccaccagcucugggcgacccugcuaucccugacuuuuauuaaaaccacacuuucacuccauuacgccuggaagacuauggcaaugguccugagcaucgcuaguuuguucccccuguguuuaucuaccacgucccagaagacaaccuggcucccgguacugcuuggcagccuggggugcaaaccuuugacuauguuucucauuacagagaccaagaucuggggaagaaaaucguggccacugaacgaagguauaauggccgugggcguugugucaauccuacugucuagucuucucaagaaugaugucccccuggccgggccuuugauugcuggaggcauguuaaucgcauguuaugugauuuccgguagcucugccgaccugagccucgagaaagcggcugagguauccugggaagaggaagccgagcacucaggggcaagucauaacauccugguggucguucaggaugacggaacuaugaagauaaaagaugaagagagggacgauacacuuaccauucuguugaaggccacgcuacuggcugugagcggcguguacccccucucuaucccagcaacucuguucgucugguauuuuuggcaaaagaaaaagcagcgauccggcgugcuuugggacaccccuucacccccagagguugaacgcgccguauuagaugacgggaucuaccggauuaugcagagaggacugcucgguaggagucaggugggcgucgggguguuccaagagaacguuuuccacacaauguggcacgugacccguggagcggucuugauguaucagggcaaacgccuggaaccgagcugggcuuccgugaagaaagaccucauaucuuacggugggggauggcggcugcagggcucguggaauacaggcgaggagguacaggucaucgccguggaaccugggaagaaccccaagaauguucaaacugcaccaggaaccuuuaaaacgcccgagggugaagugggcgccauugcucuugauuucaagccugggacaagcggaucaccaaucgucaacagagagggcaaaauugugggucuguacgggaauggaguugugacuaccuccggcacauaugucagugccaucgcacaggcuaaggccucucaggaaggccccuugccugagauagaggacgaaguguuuaggaaacgaaaccuaaccaucauggaucugcauccggggagcggaaagacucggcgcuaccucccagcgauuguaagagaggccaucaagaggaaauuacggacccugauucuugcacccacacgagugguugcuuccgaaauggccgaggcucugaaggguaugccuaucagauaucaaacgacugcagucaaaucagaacacaccggcaaggagauaguggaccucaugugccaugccacauucaccaugcgcuugcugucuccagugaggguccccaauuacaacaugauuaucauggaugaggcccacuuuacugacccuagcaguaucgcugcgcguggguauauuuccacacggguaggaaugggcgaagcagccgcuaucuucaugaccgccacgccgcccgguagcguggaggcauuuccacagucuaaugccguuauacaggaugaagagagagacauuccugaaaggucauggaacuccggguacgaguggaucacugauuuccccggaaaaacagugugguuugucccaaguauuaagagcggcaaugacaucgcuaacugucuccgcaagaauggcaaacgagugauacagcugucgagaaagaccuucgauaccgaguaucagaaaacuaagaacaaugacugggacuacguugugacaaccgauauuucugaaaugggggcgaacuuucgggccgacagggucaucgauccucgccguugccuuaaacccgugauccuaaaggacggaccagagagaguaauucuggcagguccgaugccugugacaguugcuuccgccgcacagcggaggggccgcaucgggcgaaaccauaauaaggaaggagaucaguacauuuauaugggccagcccuugaacaaugacgaggaucacgcccacuggacugaggcuaaaauguuacuggacaacauaaauacgccagaagguaucauucccgcccucuucgagccugaaagagaaaagagcgcggcaaucgauggggaauaccggcugaggggcgaggcccgcaaaaccuucgucgagcuuaugagaaggggagaccugccaguguggcucucauauaagguggcuagugaaggcuuucaauacucugaucggcguuggugcuucgacggggagcgcaacaaucaggucuuggaagagaacauggauguugaaaucuggacaaaagagggagagcgaaagaaacugagacccagguggcuagacgcccggacuuauuccgacccucuggcucuccgcgaauuuaaggaguucgcagccgguagaaggagcgugucaggcgaucuuauucuggaaauagggaaguuaccgcagcauuugacccagcgggcucaaaaugcccuggacaaccucguaaugcugcacaauagugagcagggaggccgagcauacagacaugcgauggaggaacuuccagauacaaucgagacccugaugcucuuggcccugauugcuguguuaacugguggggucacgcuauuuuuccugagcggccgcggacucggcaaaaccuccaucgggcuucugugugugauggccucuagcguuuugcuguggauggcauccguggaaccccacuggauugcugccucaaucauacucgaguuuuuccugaugguccuucucaucccugaacccgacaggcagcggacaccacaggauaaccaacuggcauauguagugauuggauugcuguuuaugaucuuaacuguugccgcuaaugagaugggucuacuggagaccacaaagaaagaccucggcauugggcacguggcggucgaaaaccaucaccaugccaccaugcuugauguggaccugcacccugcaucugcuuggacuuuguacgccgucgccacaacgaucauaacccccaugaugcgucauacuauugagaauacaaccgcaaacaucagucugaccgcuauugccaaccaggcggcuauccucaugggacuggauaagggcuggccaauaucgaaaauggacaucggugugccucuuuuagcccuggggugcuacagccagguuaauccgcucacauugacugcagccgugcugaugcuaguagcucacuaugcaauuaucggccccggacugcaagccaaggcgacgagagaagcucagaagaggaccgccgcaggcauuaugaaaaacccaacaguggaugggaucgucgccauagaccucgauccuguuguguacgacgcuaaguucgagaaacagcuuggacagauuaugcuguugauccuguguacuucccaaauccuccugaugcgcaccacaugggccuuaugcgaaucuauuacccuugcaacuggcccccugacgacacucugggaggguucaccagggaaguuuuggaauaccacuaucgcugucagcauggccaacauauuccggggauccuaucuagcgggcgccggucuggcauuuaguuugaugaaaucucugggcgggggacgaagaggcaccggggcucagggagagacacucggcgaaaaguggaagaggcagcuuaaucagcugagcaaaucagaguucaacauuuacaagcgcuccgguaucauggaaguggaccggagugaggccaaagaaggguugaagagaggagagacuacccgucacgcaguaagcaggggcacagcuaaacugcggugguucguggagcgcaaucucguuaagccugaagguaaggugauugauuuaggcugugggcgaggaggcuggucuuauuacugcgccgggcugaaaaaggucacggaggugaaaggauauaccaagggcggucccgggcaugaggagccgaucccaauggccacuuacggauggaaccuugucaaacugcacuccggcaaggacguguuuuucacaccucccgaaaaaugugauacccuacucugcgacauaggcgagucaagcccaaaucccacuaucgaggaagggagaacacugaggguuuugaagaugguagagccuuggcugcggggaaaccaauuuuguauuaagauccucaauccguacaugcccucgguggucgaaacccuugagcagaugcagcgcaaacaugguggcaugcuggugagaaacccauuaucuaggaauaguacgcacgagauguauuggguuuccugcgggaccggaaacauugugagcgcggucaauaugacaucacgaaugcuguugaaccgguucacuauggcucaccguaagccuaccuacgaaagagauguggaccucggcgcagguacacgccauguagccguggagcccgaaguugcuaaucuggauaucauugggcagaggaucgagaacauaaaacacgaacauaaguccacuuggcacuaugacgaggauaacccuuacaaaaccugggccuaucauggaucuuacgaggucaagccaagcggcagugcauccagcauggugaauggcguggucaagcuacuuacaaaacccugggacguuauuccuauggugacccaaaucgccaugacugauacgacaccauuugggcagcagcggguauucaaggaaaaaguggacaccagaacucccaaggcuaaacgcggaaccgcgcaaaucauggaggucacagccagguggcugugggguuuucucucucgaaacaagaagccgcggauuuguacgagagaagaguucaccaggaaagugcgcucaaaugcagcuauaggcgccguuuuuguggacgaaaaccaguggaauagugcaaaggaggccgucgaggaugaacguuucugggaccuggugcagaaagagcgggaauugcacaagcaggggaaaugcgcuacuugcguauauaacaugaugggaaagagagagaagaaacugggcgaauuugguaaggccaaaggguccagggcgaucugguacauguggcucggagcacgcuuccuugaguuugaggcccugggcuucaugaaugaagaucacugguucagccgagagaacucuuuaucgggcguugaaggggagggacugcauaaguuggguuacauucuccgggacaucucaaaaauuccuggcgggaauauguaugcugaugacacagccggaugggauaccagaaucacugaggacgaucugcaaaacgaagcaaagauaacagacaucauggagccagaacacgcucuacuugccaccagcauuuuuaaacugacauaccagaauaagguggucagggugcagcgccccgcuaagaacggcacugugauggaugucaucuccagacgggaccagagggguagugggcaaguuggaaccuauggccucaauacguucaccaacauggaggcccagcugauucgucagauggaaucugagggcaucuuuuugccuagcgaguuagaaacaccaaaucuggcagagcgagugcucgauuggcuugaaaaauacgggguagagcgccugaagagaauggcgauauccggagacgacuguguggucaaacccauugaugaccgguucgccacugcucuaaccgcccugaacgauauggguaaggugaggaaagacaucccgcagugggaaccuucaaagggcuggaacgauuggcaacagguucccuuuugcagucaucacuuccaccagcucaucaugaaggacgggcgcgagauuguggucccauguagaaaucaggaugaguuggugggacgggcaaggguaucucaaggcgcugguuggagccugcgagaaacagccugccuugggaaauccuaugcacagauguggcagcugauguacuuucaucguagagaccuccgcuuagccgcgaacgcuauauguucagccguuccuguggauuggguccccacuagccggaccacguggucuauccacgcacaucaccaauggaugacaaccgaggacaugcuguccguguggaauaggguuuggauugaagagaacccauggauggaagauaagacucaugugaguagcuggggagacguccccuauuugggcaaaagagaggaccaguggugcggcucgcugaucgggcucacagcccgcgcuaccugggccuccaauauucagguggcaaucaaccagguacggaggcuuauaggaaaugagaacuaccuggauuacaugacuucuaugaagcgauucaaaaaugaaggugacccugagggcgcucuaugguga

SEQ ID NO: 13715 - RNA, 9879 nt, Artificial Sequence
  derived and/or modified CDS sequence (opt3) from DENV-1__FJ882519__SS-prME
agcgugacaaugcugcuaaugcuuaugcccacagcacuggcuuuccacuugacuacgcgaggcggggaaccucauaugaucgucuccaagcaggaaagggggaaaucuuuacuguuuaagacaucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagggauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucugcaacgcgguuggaaaacaucauguggaagcagauuucgaacgagcugaaucauauccuccuggaaaacgacaugaaauuuacaguagucgugggcgauguugcugggauuuuagcccagggaaagaaaaugauccgcccucagcccauggaguacaaguauagcuggaaguccuggggcaaagcgaagauaaucggggccgacgugcaaaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaggauucuaaagcuguucacgccgacaugggguacuggaucgaaagcgagaagaaugaaacauggaagcucgcacgggcguccuucauugaggugaaaacguguaucuggccaaagucacauacccuguggagcaacggaguacuagaaucugagaugauaauccccaaaauuuauggcgguccuaucucccagcacaauuaccgaccaggcuacuuuacucaaacagccgggccguggcaucugggaaagcucgagcuggauuucgaccuuugcgaaggcaccacugucgugguggaugagcacugcgggaacagaggacccaguuugaggacaaccacggucacuggcaaaauuauccacgaaugguguugccgcagcuguacccugccuccauuacgguuuaagggugaggacgggugcugguauggaauggagauaagacccguuaaggaaaaagaggaaaaucucgugaagucuaugguauccgcuggcucaggugagguggacaguuucagccugggccuucuguguauuucgaucaugaucgaagaggucaugaggucccgcuggucucgaaaaauguugaugacagggacccucgccguguuuuuccugcuaauuaugggacagcugacuuggaacgaucucauccggcugugcauuaugguuggcgcaaaugcuagcgaccguauggggaugggaacaaccuaccuugccuugauggcaacauuuaagaugagaccuauguucgccgugggccuguuauuuaggcgccucacuucacgggagguccugcuucugaccauaggucuaagucucguggcuuccguugaacugccaaacucuuuggaggaacugggggauggauuagcgaugggcaucaugauucucaaacugcuuacggacuuccagagccaucaacugugggccacauugcucucccugaccuuuaucaagacuaccuucucacuacacuaugcauggaagacaauggcuauggugcugagcauugucagucuuuuuccccucugucugucuacuaccucccagaaaacgacaugguugccgguacuguuaggcagccucgggugcaagccucugaccauguuccuuaucgccgagaauaaaauauggggaagaaagucguggccacugaacgaagguaucauggccgugggcauuguuucaaucuugcucucuagucugcucaagaaugaugugccccuggcugggccucuuauugcaggaggcaugcucaucgccuguuacgucauauccgguagcucugcggaccugagcuuggagaaggcugccgagguguccugggaagaggaagcagagcauucaggggccagucacaauauuuuaguagaagugcaggaugacggaacuaugaaaaucaaggaugaggagagggacgauacacugaccauccuccugaaggcuacucuucuggcagucagcggcguuuaucccuugucuauuccagccacacuauucgugugguacuuuuggcagaaaaagaaacaacgauccggcgugcugugggacaccccuucacccccagaagucgagcgcgcggugcucgaugacgggauauaucggaucaugcagagaggacugcuugguaggagucagguuggcguagggguguuccaggaaaacgucuuucauacgauguggcacgugacucguggagcuguuuuaauguaccaaggcaagcgccuggagccgagcugggccuccgugaaaaaggaccucauuucuuacggugggggauggcgguugcagggcucguggaauaccggcgaggaaguccaggugaucgcaguagagccugggaagaaccccaaaaauguccagacagccccaggaaccuucaagacaagcgaaggugaggugggcgcuauugcccuggauuuuaaacccgggacuucaggauccccuaucguuaacagagaaggcaagauagugggucucuaugggaauggagucgugaccacgaguggcacauacguuucugcaaucgcucaagccaaagcgagccaggagggcccacugcccgagauugaagacgagguguucaggaagcgaaaccuuacuaucauggaucugcacccuggguccggaaagacccggcgcuauuugccggccauugucagagaagcaaucaaaaggaagcuacggacacugauacucgcuccaacccgagugguagccucagagauggcugaagcauuaaaagguaugcccauuagauaccagacuaccgccgugaagucugagcauacaggcaaagagaucguugaccugaugugccacgccacguuuacuaugcgccuucugagcccugucagggugccaaauuauaacaugaucauuauggaugaagcucauuucaccgaccccaguuccaucgcggcacguggguacauaagcacacgggugggaaugggcgaggccgcugccauuuuuaugaccgcaacuccuccggguucugucgaagccuucccccaaucaaaugcuguaauccaggaugaggaaagagacauuccagagagguccuggaacaguggguaugaguggaucacagauuuuccuggaaagaccgugugguucguucccagcauaaagucgggcaaugacauugcgaacugucuccgcaaaaauggcaagcgagugauccaguugucuagaaaaacguucgauacugaauaccagaagaccaagaacaacgacugggacuacgucgugaccaccgauaucuccgagaugggggccaauuuucgggcagacaggguuauugauccacgccguugccugaagccugugauccucaaggacggacccgaaagagucauucuggcugguccaaugccggugacuguagccagcgcagcccaacggaggggccgcauagggcgaaaccacaauaaagagggagaucaguauaucuacaugggccagccucuuaacaaugacgaggaucaugcucacuggacagaagccaagaugcuacuggacaacauuaauacccccgaggguaucaucccagcguuguucgaacccgagagagaaaaaucagcagccauugauggggaguaucgguuaaggggcgaggcucgcaagacauuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauauggacuaaggagggagaaaggaaaaagcugagaccaagauggcucgacgcucggacguacagcgaccccuuggcacugcgcgaguucaaggaauuugccgcugguagaaggucagucaguggcgaucuaauccuggagauugggaaacucccucagcaccuuacccagcgggcccagaaugcacuggacaacuuaguuauguugcauaauagcgaacaaggaggccgagcguauagacacgccauggaggagcugccggauacaaucgaaacucucaugcugcuugcucugauugccgugcucaccggugggguaacauuguucuuucuguccggccgcggauuaggcaagaccucuaucgggcuacugugugugauggcaagcuccguccuccuuuggauggcuucaguggagccacauuggauagccgcaucuaucauucuggaguucuuuuugaugguucugcucauccccgagccugacaggcagcggacuccccaggauaaccagcuggccuacguggucauuggacuucucuucaugauccugacgguagcugcgaaugagauggguuugcuggaaaccaccaaaaaggacuuaggcauagggcacguggccguugagaaccaccaucacgcagcuaugcuagauguggaccugcauccagccagugccuggacucucuacgcagucgcuaccacaauuaucaccccuaugaugcgucacacuauugaaaacacaacggccaauaucucgcuuaccgcgauagcuaaccaagccgcaauccugaugggauuggauaaaggcuggcccauuagcaagauggacaucggugugccacugcucgcccuggggugcuauucccaggucaauccucuuacuuuaacagcugcagugcugaugcucguugcccauuacgcgauuaucggcccgggauugcaggcuaaggccaccagagaggcacagaaaaggaccgccgcuggcauaaugaagaaccccacaguggaugggauuguagccaucgaccuggauccaguggucuaugacgcaaaauuugaaaagcagcuaggacagaucaugcugcucauucuuuguacuucucagauccuguugaugcgcacgaccugggcucugugcgagucaauaacacucgccacuggcccucugaccacauuaugggaggguagccccgggaaauucuggaauaccacuauugcgguuuccauggccaacaucuuccggggaaguuaccuugcaggcgcuggucuggccuuuucucucaugaaaagccuaggcgggggacgaagaggcacgggggcacaaggagaaacacugggcgagaaguggaaaaggcaguugaaucagcugucaaaguccgaguucaacaccuauaaacgcagugguauuauggagguggaccggagcgaagcuaaggaggggcucaaaagaggagagacuaccaagcacgccgucucucguggcacagccaaacuuaggugguuuguggaacggaaucugguaaaaccagaggguaaggugaucgauuugggcugugggcgcggaggcugguccuacuauugcgcggggcugaaaaagguuacugaagugaaaggauacaccaagggcgguccugggcacgaggaacccauaccgauggcuacauacggauggaaccucgucaaauuacauucaggcaaggacguguucuuuaucccaccugagaagugugauacgcugcuuugcgacauuggcgagagcucgcccaauccaaccaucgaagaggggcgaacucugagaguccuaaaaaugguggaacccuggcucaggggaaaccaguucuguauuaagauccugaauccuuauaugccgucuguuguagagacauuggagcaaaugcagcggcgccacgguggcaugcuggugagaaacccccucaguagaaauuccacccaugaaauguacugggucagcugcgggacuggaaacauugugucagcaguuaauaugacaucccgaaugcuucugaaccgguuuaccauggcccaccguaaaccaacguaugagagagauguggacuuaggcgcugguacccgccacgucgccguggaaccugagguagcaaaccuggauaucauagggcagaggauugaaaauaucaagcaugagcacaaaucuacauggcauuacgacgaggauaaccccuauaagacuugggccuaccacggaagcuaugaagugaagccuaguggcuccgcuagcucuaugguuaauggcgucgugaaauugcucaccaagccaugggacgugauccccauggucacacagauugcgaugacugauaccacaccuuucgggcaacagcggguuuuuaaagagaagguggacaccagaacuccaaaagccaagcgcggaacggcacagauaauggaaguaacagcuaaguggcugugggguuuccuaucaaggaacaaaaagccccgaaucuguacccgggaggaauuuacuagaaaagugaggaguaaugccgcaauuggcgccgucuucguggacgagaaccaauggaacuccgcuaaggaggccguugaagaugagcgcuuuugggaccuugugcaucgugaacgggagcugcacaaacaggggaagugcgcgaccugcgucuacaacaugaugggaaagagagagaaaaagcucggcgaguucgguaaagcaaaggggagcagggccaucugguacauguggcugggagcucgcuucuuggaguuugaagcccugggcuucaugaaugaggaucacugguuuucucgagaaaacucgcucucaggcguggagggggagggacuucauaaacuggguuauauuuuacgggacaucagcaagauaccgggcgggaauauguacgcagaugacacagcuggaugggauacgagaaucaccgaagacgaucugcagaacgaggccaaaauuacugacaucauggaaccugagcacgcuuugcucgccaaguccauuuucaagcugacauaucagaauaaaguaguuagggugcaacgcccagcaaagaacggcaccgucauggaugugaucaguagacgggaccagagggguucuggacaggugggaacuuacggccuaaauacauuuaccaacauggaagcgcagcuuauacgucaaauggagagcgagggcauuuucucccccucagaacuggagacaccuaaccucgccgggcgaguccuggauugguuggaaaaacauggaguugagcgcuuaaagagaauggcuaucaguggugacgacugugugguaaaaccaaucgaugaccgguuugccacugcacugaccgcucucaaugauaugggcaaggugaggaaggacauuccccagugggaaccgucuaaaggguggaacgauuggcagcaggucccuuucugcagccaccacuuucaucaacuuauaaugaaggacggacgcgagaucgugguucccuguagaaaucaggaugagcuggugggccgggccagggucucccagggugcaggguggucacuacgagaaacggccugccugggaaaaagcuaugcgcagauguggcaacucauguacuuccaccguagagacuugcgccuggcugccaacgcaauuuguucugccgugccaguagauuggguuccuaccucccggacaacuuggaguauccaugcucaccaucaguggaugaccacagaggacaugcuuagcguguggaauagggucuggauugaagagaaccccuggauggaagauaagacucacaucucguccuggggcgacgugccauaucugggcaaaagagaggaccaguggugcgggucucucauaggauuaaccgcccgcgcaacgugggcuacaaauauccaaguugccauuaaccaggugcggaggcugaucgguaaugagaacuacuuggauuacaugaccucaaugaagcgauuuaagaaugaaagcgaccccgagggcgcgcugugguga

SEQ ID NO: 13716 - RNA, 9879 nt, Artificial Sequence
  derived and/or modified CDS sequence (opt3) from DENV-1__FJ882520__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaagcuuugcauugaagccaaaaucucuaauacgaccacagauagcagguguccaacucaaggagaggcuacccugguugaagagcaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauccagacguccggaaccacaacuauuuuugcaggccauuuaaagugccggcugaaaauggauaagcuaacccucaaagggaugagcuaugucauguguacaggaucguucaagcuggagaaggaaguggccgagacucagcacgguaccguucuugugcagauaaaauacgagggcacggacgcuccuugcaagaucccauucucuacacaagaugaaaaagggguaacccagaacggacguuugauuacugcgaaucccaucgucacagacaaggagaaaccugugaacauagaagcagagccacccuuuggcgaguccuauauuguuaucggugccggggaaaaggcucugaagcucucaugguucaaaaagggcaguagcaucggaaaaauguuugaggccaccgcacgcggcgccagaaggauggcuauucugggggauacugccugggacuucggauccaucgguggcguguuuaccucugucgggaagcuugugcaucagauuuucggaacagcauacggcguacuguuuagcggugugucauggacgaugaaaauagggaucggcguuuugcucaccuggcugggauuaaauagucgguccacuagccugucuaugacauguauugcggucggccuagugacccucuaccugggggugaugguccaggcugauucaggaugcguuaucaacuggaagggccgagaacuuaagugugguagugggaucuucgugacaaaugaggugcacacuuggaccgaacaauauaaauuucaggccgacagcccgaagcgcuuguccgcagccauuggaaaagcuugggaggagggcguaugcgguauaagaucugccacgaggcuggaaaacaucauguggcggcagauuucgaacgagcucaaucauauccuguuagaaaacgacaugaaguucacagucgugguuggcgauguggucgggauucuggcacagggaaaaaagaugauccgcccucaacccauggagcacaaauacagcuggaaguccuggggcaaggcuaaaauaaucggggccgacgugcagaauaccacuuuuauuaucgauggaccaaacaccccugaaugucccgacgaucagagagcguggaauauuugggagguugaggacuauggcuucgguaucuuuacaacuaacauauggcuuaaguugagggauucauacacccaggugugcgaccaccgucucaugagugccgcuauuaaagauucuaaggcaguacaugccgacaugggguauuggaucgaaagcgagaaaaaugaaacauggaagcuggcucgggccuccuucauugaggucaagacguguaucuggccaaaaucacacacccuauggagcaacggagugcuggaaucugagaugauaauccccaagauuuacggcgguccuaucucccaacauaauuaucgaccaggcuacuucacucagacagcagggccguggcaccucggaaaacuggagcuugauuuugacuugugcgaaggcaccacuguggucguugaugagcacugcgggaacagaggacccagucugaggacaaccacggugacuggcaagauuauccaugaaugguguugccgcagcuguaccuuaccuccacuccgguucaaaggugaggacgggugcugguacggaauggagauaagacccguaaaggaaaaggaggaaaaucuggugaaaucuauggucuccgcgggcucaggugagguggacaguuuuagccuuggccuguuguguauuucgaucaugaucgaagagguuaugaggucccgcuggucucgaaagaugcucaugacagggacccuggccguguucuuucuacugauuaugggacagcucacuuggaacgaucugauccggagcugcauuauggucggcgcuaaugccucagaccguauggggaugggaacaaccuaucuugcauugauggcuacauucaaaaugagaccuauguuugccgugggccuguuauucaggcgccucacuagucgggagguucugcuucugaccauaggucuaucccucguggcaucugucgaacugccaaacagcuuggaggaacugggggauggauuagccaugggcaucaugauucucaagcugcuuacggacuuucaauccuaccagcugugggcuacauugcucucacugaccuucaucaaaacuaccuuuagccuacacuaugcguggaagacaauggccaugguacugaguauugugucucuucucccccuguguuuguccacuaccagccagaagacgacauggcugccgguuuuacucggcucgcuggggugcaaaccucuuaccauguuccugaucgcagagaauaagauauggggaagaaaaucauggccauugaacgaagguaucauggcugugggcauugucucuauccuccugaguucccuacugaagaacgaugugccccuugccgggccucucauugccggaggcaugcugaucgcuuguuacguaauaagcgguucuagcgcagacuuguccuuagagaaagccgcggaggugucaugggaagaggaagcugagcauaguggggccagccacaauauucuggucgaaguucaggaugacggaacuaugaagaucaaagaugaggagagggacgauacacucaccauccugcuuaaggcaacucuguuggccgugucuggcguguauccccuauccauuccagcuacacuguuugucugguacuucuggcaaaagaaaaagcagcgaucaggcgugcucugggacaccccuagucccccagaaguugagcgcgcaguacuggaugacgggauauaucggaucaugcagagaggacuuuuagguaggagccaggugggcgucgggguguuccaagaaaacguuuuucauacgauguggcacgugacucguggagccguccugauguaccagggcaaacgccucgagccguccugggcgucugugaagaaagacuugauuucguacggugggggauggcggcugcagggcagcuggaauaccggcgaggaaguacaggucaucgcuguggagccugggaagaaccccaagaauguucaaacagccccaggaaccuucaaaacacccgaaggugaggugggcgcaauugcccucgauuuuaagccugggacuucaggauccccaaucgucaacagagaaggcaaaauagugggucuguaugggaauggaguugugaccacgaguggcacauacgucucugcuaucgcccaggcaaaggcuagccaggagggcccccuuccugagauugaagacgagguguucaggaaacgaaaccugacuaucauggauuugcacccgggguccggaaagacccggcgcuaucuaccagccauuguaagagaagcgaucaagaggaaacugcggacacucauauuagcccccacccgagugguugcaucagagauggcugaagcccugaaggguaugccuauuagauaccaaacuaccgcugucaaaucugagcauacaggccgcgagaucguggaccuuaugugccacgcaacguuuacuaugaggcugcucagcccagugcguguccccaauuauaacaugaucauuauggaugaagcccauuucaccgacccuaguuccaucgccgcucggggguacauaagcacaagaguaggaaugggcgaggcggcagccauuuuuaugaccgcuacuccgcccgguucuguggaagccuucccacagucaaaugcaguuauccaggaugaggaaagggacauuccugagcgcuccuggaacaguggguaugaguggaucacagauuuucccggaaagaccgugugguucgucccaagcauaaaaucgggcaaugacauugccaacuguuugcgaaagaauggcaagagagugauccagcugucucggaaaacguuugauacugaauaccaaaagacaaaaaacaacgacugggacuacguugugaccaccgauaucuccgagaugggggcuaauuucagggcggaccgcgucauugauccucguagaugccucaagcccgugauccugaaagacggaccagaacggguaauucuugccgguccgaugccugugacuguugcaagcgcugcccagaggcgcggccgaauagggagaaaccacaauaaggagggagaucaguauaucuacaugggccagccccuaaacaaugacgaggaucaugcacacuggacagaagccaagaugcuguuggacaacauuaauaccccagaggguaucauccccgcuuuauucgaaccugagcgggaaaaaucagccgcgauugauggggaguauaggcugcgcggcgaggcaagaaagacauuugucgaacucaugaggcggggagaccugccaguguggcuuaguuacaaaguggccucugagggcuuccaauauuccgaucgucgcuggugcuuugacggggaacgaaacaaucagguccuggaggaaaacauggauguugagauauggacuaaggagggagaaagaaaaaagcucaggccccggugguuggacgcucgcacguacagcgacccucuggcccuaagagaguucaaagaauuugcugcagguaggcggucagugaguggcgaucugauccucgagauugggaagcuuccgcagcaccugacccagcgagcccaaaaugcuuuagacaacuugguaaugcugcauaauagcgaacagggaggcagagccuaucgccacgcaauggaggagcucccagauacaaucgaaacucugaugcuucuggcgcucauugccguguugaccgguggggucacacuguucuuuuuauccggcaggggacuaggcaagaccucuaucgggcugcucugugugauggcuagcuccgcccuucuguggauggcaucaguugagccccauuggauagcugccucuaucauuuuggaauucuuucugauggugcuccugaucccugagcccgaccggcagcguacuccacaggauaaccaacuugcauacgucguaauuggacuccuguucaugaucuugacgguggccgcuaaugagaugggucuguuagaaaccacaaaaaaggaccuaggcauagggcacguugcgguggagaaccaccaucacgccacuaugcuggaugucgaccuccauccugcaagugcuuggacccuuuacgccguggccacaaccauuaucacucccaugaugagacacacaauugaaaacacgaccgcaaauaucucgcugacugcuauagccaaccaggcggcuaucuugaugggacuggauaaaggcuggccaauuagcaagauggacaucggugucccucuccuggcccuugggugcuauucccaggugaauccguuaacacugaccgcagccguucucauguugguggcucauuacgcaauuaucggccccggacugcaagccaaagcgaccagggaggcucagaagcgcacagccgcaggcauaaugaagaacccaacuguagaugggauuguggccaucgaccuagauccugucguuuaugacgcuaaauuugaaaagcagcugggacagaucaugcuccuuauucuguguacgucucaaaucuugcugaugcggaccacaugggcccucugcgagucaauaacucuggcaaccggccccuuaacaacccuuugggaggguagcccagggaaauucuggaauacuacgauugcuguguccauggccaacaucuuucgaggaaguuaccuggcgggcgccggucucgcauucucucuaaugaagagccugggcgggggaagaaggggcacaggggcucagggagaaaccuugggcgagaaauggaagcgccagcugaaucagcucucaaaguccgaauucaacacuuauaaacggagugguauuauggaggucgacagaagcgaagccaaggaggggcuucguaggggagagaccacaaaacacgcagugucucggggcacugcuaagcugcgcugguuuguagaacgaaauuuggugaaaccugaggguaagguuaucgaucugggcugugggagaggaggcugguccuacuauugcgccgggcucaagaaagugaccgaagucaagggauacacaaaaggcggucccgggcacgaggaaccgauaccaauggccacguacggauggaacuuagugaagcugcauucaggcaaagacgucuucuuuaucccucccgagaagugugauacccuucugugcgacauuggcgagagcucgccaaaucccacuaucgaagaggggaggacacuacgggugcucaaaaugguugaaccuuggcugcgcggaaaccaauucuguauuaagaucuugaauccguauaugcccucuguaguggagacccuggagcagaugcagagaaagcacgguggcaugcucgucaggaacccacuuagucgaaauuccacucaugaaauguacugggugagcugcgggacaggaaacauuguuucagcggugaauaugaccucccggaugcuguuaaaccguuuuacgauggcucacagaaaaccuaccuaugagcgcgaugucgaccugggcgcagguacaaggcacguggccguagaacccgagguggcuaacuuggauaucauagggcagcggauugaaaauaucaagcaugagcacaaaucuacuuggcauuacgacgaggauaacccuuauaagaccugggccuaccacggaagcuaugaaguuaaaccaaguggcuccgcaagcucuauggucaauggcguggugaagcuccugacaaagcccugggacgucaucccuaugguuacucaaauugccaugaccgauacaaccccauucgggcagcagagaguguuuaaagagaagguagacacucgcacgcccaaagcuaagaggggaacagcgcaaauaauggaagugaccgcccgauggcuaugggguuuccuuucacggaacaaaaagccgagaaucuguacuagggaggaauuuacccgcaagguccguaguaaugcagcuauuggcgccguguucguugacgagaaccaguggaauuccgcaaaagaggccguggaagaugagcgguuuugggaccugguccauagagaaagggagcuccacaagcaggggaaaugcgcuacaugcguguacaacaugaugggaaagcgcgaaaaaaagcugggcgaguucgguaaggccaaagggagccgagcgaucugguacaugugguugggagcacgguuucuggaguucgaagcccucggcuucaugaaugaggaucacugguuuucuagagaaaacucgcuuucaggcguagagggggagggacugcauaaguuagguuauauucugagggacaucagcaaaauaccuggcgggaauauguacgcugaugacacggccggaugggauacccgcaucacugaagacgauuugcagaacgaggcaaagauuacagacaucauggaaccagagcacgcucuccuggccaccuccauuuucaaacuaacuuaucaaaauaagguugugagaguccagcggcccgcuaggaacggcacagugauggaugugaucagucgucgagaccagcgcgguucugggcaggucggaaccuacggccuuaauacauuuacuaacauggaagcccaacugauaagacagauggagagcgagggcauuuucuccccuucagaacucgagaccccaaaccuggcagaacggguuuuggauugguuagagaaacaugggguggaaaggcugaagcgcauggcgaucaguggagacgacuguguagugaagcccaucgaugacagauuugccacggcucucucugcccuuaaugauauggguaaaguccggaaggacauuccgcagugggagccuagcaaaggcuggaacgauuggcagcaagugcccuucugcucccaccacuuucaucagcugauaaugaaggacgggagggagaucguugugccaugucgaaaucaggaugaacuagucggacgugcaagagugucacagggcgcugguuggagccugcgcgagaccgccugccucgggaaaucuuaugcacaaauguggcaguugauguacuuccaccggagggaccugagacuugccgcgaacgcuauuuguuccgccguaccuguugauugggugcccacaagucgcacuaccuggagcauccaugcacaccaucaguggaugacaacugaagacaugcugucggucuggaaucggguguggauugaggaaaacccauggauggaggauaagacccacaucuccucuuggggagacguucccuaucucggcaagagggaggaccaauggugcggcucauuaauagggcugacggcccgagcuacaugggccaccaauauccagguggcaauuaaccaggucagacgguugaucggaaaugaaaacuaccuggauuacaugacuagcaugaaaagguuuaagaaugagagugacccugaaggugcucucugguga

SEQ ID NO: 13717 - RNA, 9879 nt, Artificial Sequence
  derived and/or modified CDS sequence (opt3) from DENV-1__FJ882523__SS-prME
agcgugaccaugcugcucaugcuuaugcccaccgcacuggcuuuccacuugacuacgcgaggcggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacaugggugaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagggauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaggaacaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacgaggaaaaaccuguaaacauagaggccgagccacccuuuggcgaaucuuauauugucaucggugcuggggagaaggcccugaaacucuccugguucaagaagggcucaaguaucggaaaaauguuugaagcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaaaauagggaucggcguauugcucacuuggcugggauuaaauucacgaaguacaucccugagcaugaccuguauugcugugggccuaguuacacucuaccugggggucauggugcaggccgauucuggaugcgugaucaacuggaagggccgcgagcuuaaaugugguucagggaucuucgucacuaaugaaguucacaccuggacggagcaauauaaguuucaggcagacaguccgaagagauugagcgccgcuauuggaaaagccugggaggaaggcgugugcgguauaagguccgcaacacggcuggagaacaucauguggaagcagauuucuaacgaacucaaucauauccuguuagagaacgacaugaaauucaccgugguagucggcgaugugguugggauucuggcucagggaaagaaaaugauccgcccucaacccauggaacacaaguacucguggaaaagcuggggcaaggccaagauaaucggggcggacgugcagaauacuaccuuuauuaucgauggaccaaacacaccugagugucccgacgaucagagagccuggaauauuugggaggucgaagacuauggcuucgguaucuuuacuaccaacauauggcuuaaauugagggauuccuacacacaggugugcgaccaccgucucaugucagcugcaauuaaggauaguaaagccguucaugcugacaugggguauuggaucgagucugaaaagaaugagacguggaaacuggcccgggcauccuucauugaagugaagaccuguaucuggccaaagucccacacucuauggucaaacggaguacuggagagcgagaugauaauccccaaaauuuacggcgguccuaucucucaacauaauuaucgaccaggcuacuucacacagaccgcggggccguggcaccucggaaagcuggaacuugauuuugacuugugcgagggcacuacagucgugguggaugaacacugcgggaacagaggacccucccugaggaccacgacugucaccggcaaaauuauccaugagugguguugccgcaguuguacauuaccuccacuccgguucaagggugaggacgggugcugguacggaauggaaauaagacccguuaaagagaaggaagagaaucugguaaagagcaugguaucugccggcuccggugaaguggacucauuuagucuuggccuguuguguauuagcaucaugaucgaggaggucaugaggucgcgcuggucccgaaaaaugcucaugaccgggacucuggcuguguuccuacugcucauuaugggacagcugacauggaacgaucuuauccgguugugcauuaugguuggcgccaaugcaucugaccguauggggaugggaaccacauaucuggcuuuaauggccacuuuuaagaugagaccuauguucgcagugggccuccuguuuaggcgccuuaccagccgggaaguccugcuacucacgauaggucugucauugguggccaguguugagcugccaaacuccuuagaggaacucggggauggacuggcuaugggcaucaugauucuuaaacuguugacagacuuccaaucucaccagcucugggcgacccugcuaagccugacuuuuaucaagaccacacuuucccuccauuacgccuggaaaacuauggcaauggugcugucaauugucagcuuguucccccuguguuuaaguaccacgucucagaagacaaccuggcucccgguacugcuuggcucccuggggugcaagccuuugacuauguuucucaucgcugaaaauaaaauauggggaagaaagagcuggccacugaacgaggguaucauggccgugggcguugugucgauucuacugucaucucuucucaaaaacgaugucccccuggccgggccuuugaucgcuggaggcauguuaauugcauguuaugugaucagugguuccagcgccgaccugucucucgagaaggcggcugaaguaagcugggaggaagaggccgaacacuccggggcaucacauaauauacugguggagguccaggaugacggaacaaugaaaauuaaggaugaggaaagggacgauacccuuacuauccuguugaaagccacacuacuggcuguuaguggcguguacccccucagcaucccagcaacccuguucgugugguauuuuuggcaaaagaagaaacagcgaucuggcguccuuugggacacgccuucacccccagagguggaacgcgccguuuuagaugacgggauuuaccggauaaugcagagaggacugcucgguaggagccagguaggcgugggggucuuccaagagaacguguuccacacuauguggcacguuacccguggagcgguguugauguaucagggcaagcgccuggagccgaguugggcuagcgucaaaaaggaccucaucuccuacggugggggauggcggcugcagggcucuuggaauacaggcgaagaggugcagguaauugccgucgaaccugggaaaaaccccaagaaugugcaaaccgcaccaggaacauuuaagacucccgagggugaaguuggcgccaucgcucuugauuucaaaccugggaccucgggaagcccaauugugaacagagagggcaagaucgucggucuguacgggaauggagugguuacgacaucaggcacuuauguguccgccauagcacaggcuaaagccagucaggagggccccuugccugaaaucgaggacgaagucuuuaggaagcgaaaccuaaccauuauggaucugcauccggggucuggaaaaacacggcgcuaccucccagcgaucgugagagaggccauuaagaggaaguuacggacccugauccuugcacccacucgaguaguggcuagcgaaauggccgaggcucugaaagguaugccuauaagauaucaaaccacagcaguuaaguccgagcacacgggcaaagaaauugucgaccucaugugccaugccacuuucaccaugcgcuugcugucaccagugagggugcccaauuacaacaugaucaucauggaugaggcccacuuuacagacccuucuagcauugcugcgcguggguauaucaguacccgggucggaaugggcgaagcagccgcuauauucaugacugccacaccgcccgguuccguagaggcauuuccacagagcaaugccgugauucaggaugaagagagagacaucccugagaggucuuggaacucaggguacgaauggauuaccgauuuccccggaaagacgguuugguuugugccauccaucaaaaguggcaaugacauagcuaacugucuccgcaagaauggcaagcgagucauucagcugagcagaaaaacuuucgauacagaguaucaaaagaccaaaaacaacgacugggacuacgugguuaccacugauaucucggaaaugggggcgaauuuucgggccgacagggugaucgauccucgccguugccuuaagcccgucauucuaaaagacggaccagagagagugauccuggcagguccgaugccuguaacaguggcuucugccgcacagcggaggggccgcauugggcgaaaccauaauaaggagggagaucaguacauauauaugggccagcccuugaacaaugacgaagaucacgcccacuggaccgaggcuaagauguuacuggacaacaucaauacaccagaagguauuauccccgcccucuucgagccugaaagagagaaauccgcggcaaucgauggggaguaccggcugaggggcgaagcccgcaagacuuucguugagcuuaugagaaggggagaccugccagucuggcucagcuauaaaguggcuucagaaggcuuucaauacagugaucggcguuggugcuucgacggggagcgcaacaaucagguguuggaagagaacauggaugucgagauuuggacgaaggaaggagagagaaagaagcugagacccagguggcuagacgcccggaccuauucugacccucuggcucuccgcgaauuuaaagaguucgcagccgguagaagguccguuagcggcgaucuuauacuggaaaucgggaaguuaccgcagcauuugacacagcgggcucaaaaugcccuggacaaccucgugaugcugcacaauucagagcagggaggccgagcauacagacaugcgauggaggaacuuccagauacuauugagacccugaugcucuuggcccugaucgcuguauuaacagguggggugacccuauuuuuccugaguggccgcggacucggcaagacuagcauugggcuucugugugucauggccuccucuguguugcuguggauggcaagcguugaaccccacuggaucgcugccuccauaauccucgaguuuuuccugauggugcuucucauuccugagcccgacaggcagcggacgccacaggauaaccaacuggcauaugucguaaucggauugcuguuuaugauuuuaaccguggccgcuaaugaaaugggucuacuggagacaacuaaaaaggaccucggcaucgggcacguugcgguggaaaaccaucaccaugccaccaugcuugaugucgaccugcacccugcaucagcuuggacauuguacgccguggccaccacuauaauuacacccaugaugcgucauacgaucgagaacaccacugcaaauauuucucugacagcuaucgccaaccaggcggcuauacucaugggacuggauaaaggcuggccaaucaguaagauggacauuggugucccucuuuuagcccuggggugcuacagccaggugaauccgcucaccuugaccgcagccguucugaugcuaguggcucacuaugcaaucauuggccccggacugcaagccaaagcgacaagagaagcucagaagaggacugccgcaggcaucaugaagaacccaacgguagaugggauaguggccauugaccucgauccugucguuuacgacgcuaaauucgagaagcagcuuggacagaucaugcuguugauccuguguaccagccaaauucuccugaugcgcacaacuugggccuuaugcgaguccaucacccuugcaacaggcccccugaccacucucugggaagguucuccagggaaauuuuggaauacgacaauagcugugucaauggccaacauuuuccggggaagcuaucuagcgggcgccggucuggcauuuuccuugaugaagagucugggcgggggacgaagaggcaccggggcucagggagagacucucggcgaaaaauggaagaggcagcuuaaucagcugucuaagagcgaguucaacaucuacaaacgcucagguauuauggaagucgaccgguccgaggccaaggagggguugaaaagaggagaaaccacacgucacgcagugaguaggggcacugcuaagcugcggugguucguagagcgcaaucucgugaaaccugaagguaagguuaucgauuuaggcugugggcgaggaggcuggagcuauuacugcgccgggcugaagaaagugaccgaggucaagggauauacaaaaggcggucccgggcaugaggaaccgauaccaauggccacguacggauggaaccuugugaagcugcacucuggcaaagacgucuuuuucaccccucccgagaagugugauacucuacucugcgacaucggcgaauccucaccaaaucccacaauugaggaagggagaacccugaggguguugaaaaugguugagccuuggcugcggggaaaccaauuuuguaucaagauucucaauccguacaugcccagcguaguggagacucuugaacagaugcagcgcaagcaugguggcaugcuggucagaaacccauuaucgagaaauucuacacacgagauguauugggugaguugcgggaccggaaacaucguuuccgcggugaauaugacgagccgaaugcuguugaaccgguucaccauggcucaccguaaaccuacauacgaaagagaugucgaccucggcgcagguacucgccauguggccguagagcccgaaguggcuaaccuggauauuaucgggcagaggauagagaauauuaagcacgagcauaaaucaaccuggcacuaugacgaagauaacccuuacaagacaugggccuaucauggauccuacgagguuaaaccaucuggcagcgcaaguuccauggucaauggcguggugaagcuacuuacuaagcccugggacgucaucccuaugguuacccaaaucgccaugacagauaccacuccauuugggcagcagcggguguucaaagaaaagguagacacgagaacacccaaagcuaagcgcggaaccgcgcaaauuauggaggugacugccagguggcugugggguuuucucagccgaaacaaaaagccgcggauauguaccagagaagaguucacaaggaagguccgcucuaaugcagcuaucggcgccguguuuguugacgagaaccaguggaacucagcaaaagaagccguggaggaugaacguuucugggaccugguccagaaggagcgggaauugcacaaacaggggaagugcgcuacgugcguguauaacaugaugggaaaaagagagaagaagcugggcgaguuugguaaagccaaggggaguagggcgauuugguacauguggcucggagcacgcuuccuugaauuugaggcccugggcuucaugaaugaagaucacugguucucccgagagaacagcuuaucuggcguagagggggaaggacugcauaaauuggguuacauccuccgggacauuucgaagaucccuggcgggaauauguaugcugaugacaccgccggaugggauacuagaauaacagaggacgaucugcaaaacgaagcaaaaaucaccgacauuauggagccagaacacgcucuacuugccacuucaaucuuuaagcugacauaccagaauaaaguugugaggguccagcgccccgcuaagaacggcaccgugauggaugugauuagcagacgggaccagagggguuccgggcaagucggaacauauggccucaauacuuucaccaacauggaggcccagcugauccgucagauggagagugaaggcauauuuucuccuagcgaguuggaaauuccaaacuuagcagagcgaguucuggauuggcucgaaaaguacgggguggagcgccuuaaaagaauggcgaucuccggagacgacuguguagugaagcccaucgaugaccgguucgccacggcucugaccgcccuaaaugauauggguaaagucaggaaggacgugccgcagugggagccuucaaaaggcuggaacgauuggcaacagguucccuuuugcagucaucacuuccaccagcugauuaugaaggacgggcgcgaaauaguggucccauguagaaaucaggaugagcucgugggacgggcaaggguaucucaaggcgcugguuggagcuugcgagaaacagccugccuggggaaguccuaugcacagauguggcagcuuauguacuuucaucguagagaccugcgccucgccgcgaacgcuaucuguucagccguuccuguggauuggguccccacuagccggaccacauggucuauucacgcacaucaccaauggaugacuaccgaggacauguuauccguguggaauaggguuuggaucgaagagaacccauggauggaggauaaaacgcaugugaguagcuggggagacguccccuaucugggcaagagagaagaccaguggugcggcucguugauugggcugacagcccgcgcuaccugggccuccaauauccagguggcaauaaaccagguacggaggcucaucggaaaugagaacuaccuugauuacaugacuucuaugaaacgauucaagaaugaaggugacccugagggcgcucugugguga

SEQ ID NO: 13718 - RNA, 9879 nt, Artificial Sequence
  derived and/or modified CDS sequence (opt3) from DENV-1__FJ882524__SS-prME
agcgugaccaugcugcucaugcuuaugcccaccgcacuggcuuuccacuugacuacgaggggaggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuacgucugccgccgaacuuucguugauagaggcugggguaauggguguggauuguuuggcaaaggcagccucauaaccugcgcuaaguucaagugcgugacaaaacuggaggggaagauuguacaguaugaaaacuuaaaauacuccgugaucgucaccgugcacacuggagaccagcaucaaguugguaaugagucaacggaacacggcacaaccgccacuauuacaccccaggcgccuacaagugagauccagcugaccgacuauggggcccucacucuugauuguagcccaaggacaggacuggacuuuaacgaaaugguguugcuaacgaugaaggagaaaucuuggcugguccauaagcagugguuccucgaucugccgcuucccuggaccuccggcgcaucaacuagccaagagacauggaaucggcaggaccuguuggugaccuuuaaaacagcucacgccaagaagcaggaaguaguugugcucgguagucaagagggggcuaugcacacugcccugaccggcgcaacggaaauccagaccucuggaacaacuaccauuuucgccggccauuuaaaaugccgucugaagauggauaaacuaacacucaaggggauguccuacgucauguguacuggaucguuuaaacuggagaaggaaguggcugagacccagcacgguacgguccuugugcagauaaaguaugagggcacagacgcgccuugcaaaaucccauucucgacccaagaugaaaaggggguuacucagaacggacgcuugauuacagcaaaucccaucgugaccgacaaagagaagccuguaaacauagaagccgagccacccuucggcgagucuuacauugucaucggugcuggggaaaaagcccugaagcucuccugguuuaagaaaggcucaaguaucggaaagauguucgaggcaacugccagaggcgcuaggcggauggccauucugggggauaccgcaugggacuuuggaagcaucgguggcguguucacauccguugggaaacuugugcaucagauuuuuggaacggcguacggcguccuguucucuggugugagcuggaccaugaagauagggaucggcguauugcucacuuggcugggauuaaauucacgaaguacaucccugagcaugaccuguauugcugugggccuaguuacacucuaucugggggucauggugcaggccgauucuggaugcgugaucaacuggaaaggccgcgaacuuaagugugguucagggaucuuugucacuaaugagguucacaccuggacggaacaauacaaguuccaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguuuaccgugguagucggcgaugugguugggauucuggcucagggcaaaaagaugauccgcccucaacccauggagcacaaauauucguggaaaagcuggggcaaggccaagauaaucggggcggacgugcagaauacuaccuucauuaucgauggaccaaacacaccugaaugucccgacgaucagagagccuggaauauuugggaggucgaggacuacggcuuugguaucuucacuaccaacauauggcuuaaguugagggauuccuauacacaggugugcgaccaccgucucaugucagcugcaauuaaagauaguaaggccguucaugcugacaugggguacuggaucgaaucugagaaaaaugaaacguggaagcuggcccgggcauccuuuauugaggugaagaccuguaucuggccaaaaucccacacucuauggucaaacggaguacuggaaagcgagaugauaauccccaagauuuauggcgguccuaucucucaacauaauuaccgaccaggcuacuucacacagaccgcggggccguggcaccucggaaaacuggagcuugauuucgacuugugcgaaggcacuacagucgugguggaugagcacugcgggaacagaggacccucccugaggaccacgacugucaccggcaagauuauccaugaaugguguugccgcaguuguacauuaccuccacuccgguuuaaaggugaggacgggugcugguauggaauggagauaagacccguuaaggaaaaggaggaaaaucuggugaaaagcaugguaucugccggcuccggugagguggacucauucagucuuggccuguuguguauuagcaucaugaucgaagaggucaugaggucgcgcuggucccgaaagaugcucaugaccgggacucuggcuguguuucuacugcucauuaugggacagcugacauggaacgaucuuauccgguugugcauuaugguuggcgccaaugcaucugaccguauggggaugggaaccacauaccuggcuuuaauggccacuuucaaaaugagaccuauguuugcagugggccuccuguucaggcgccuuaccagccgggagguccugcuacucacgauaggucugucauugguggccaguguugaacugccaaacuccuuagaggaacucggggauggacuggcuaugggcaucaugauucuuaagcuguugacagacuuucaaucucaccagcucugggcgacccugcuaagccugacuuucaucaaaaccacacuuucccuccauuaugccuggaagacuauggcaauggugcugucaauugucagcuuguuuccccuguguuuaaguaccacgucucagaagacaaccuggcucccgguacugcuuggcucccuggggugcaaaccuuugacuauguuccucaucgcugagaauaagauauggggaagaaaaagcuggccacugaacgaagguaucauggccgugggcguugugucgauucuacugucaucucuucucaagaacgaugucccccuggccgggccuuugaucgcuggaggcauguuaauugcauguuacgugaucagugguuccagcgccgaccugucucucgagaaagcggcugagguaagcugggaagaggaagccgagcacuccggggcaucacauaauauacugguggaaguccaggaugacggaacaaugaagauuaaagaugaggagagggacgauacccuuacuauccuguugaaggccacacuacuggcuguuaguggcguguauccccucagcaucccagcaacccuguuugugugguacuucuggcaaaagaaaaagcagcgaucuggcguccuuugggacacgccuucacccccagaaguggagcgcgccguuuuagaugacgggauuuaucggauaaugcagagaggacugcucgguaggagccagguaggcgugggggucuuucaagaaaacguguuccacacuauguggcacguuacccguggagcgguguugauguaccagggcaaacgccuggagccgaguugggcuagcgucaagaaagaccucaucuccuacggugggggauggcggcugcagggcucuuggaauacaggcgaggaagugcagguaauugccgucgagccugggaagaaccccaagaaugugcaaaccgcaccaggaacauucaaaacucccgaaggugagguuggcgccaucgcucuugauuuuaagccugggaccucgggaagcccaauugugaacagagaaggcaaaaucgucggucuguaugggaauggagugguuacgacaucaggcacuuacguguccgccauagcacaggcuaaggccagucaggagggccccuugccugagaucgaagacgaggucuucaggaaacgaaaccuaaccauuauggaucugcauccggggucuggaaagacacggcgcuaucucccagcgaucgugagagaagccauuaagaggaaauuacggacccugauccuugcacccacucgaguaguggcuagcgagauggccgaagcucugaaggguaugccuauaagauaccaaaccacagcaguuaaauccgagcacacgggcaaggagauugucgaccucaugugccaugccacuuuuaccaugcgcuugcugucaccagugagggugcccaauuauaacaugaucaucauggaugaagcccacuucacagacccuucuagcauugcugcgcguggguacaucaguacccgggucggaaugggcgaggcagccgcuauauuuaugacugccacaccgcccgguuccguagaagcauucccacagagcaaugccgugauucaggaugaggaaagagacaucccugagaggucuuggaacucaggguaugaguggauuaccgauuuucccggaaaaacgguuugguucgugccauccaucaagaguggcaaugacauagcuaacugucuccgcaagaauggcaaacgagucauucagcugagcagaaagacuuuugauacagaauaccagaaaaccaagaacaacgacugggacuacgugguuaccacugauaucucggagaugggggcgaauuuccgggccgacagggugaucgauccucgccguugccuuaaacccgucauucuaaaggacggaccagaaagagugauccuggcagguccgaugccuguaacaguggcuucugccgcacagcggaggggccgcauugggcgaaaccauaauaaggagggagaucaguauauauacaugggccagcccuugaacaaugacgaggaucacgcccacuggaccgaagcuaaaauguuacuggacaacaucaauacaccagaggguauuauccccgcccucuuugaaccugagagagaaaaguccgcggcaaucgauggggaguaucggcugaggggcgaggcccgcaaaacuuucguugaacuuaugagaaggggagaccugccagucuggcucagcuacaagguggcuucagagggcuuccaauauagugaucggcguuggugcuuugacggggaacgcaacaaucagguguuggaggaaaacauggaugucgagauuuggacgaaagagggagaacgaaagaaacugagacccagguggcuagacgcccggaccuacucugacccucuggcucuccgcgaguucaaggaauuugcagccgguagaagguccguuagcggcgaucuuauacuggagaucgggaaguuaccgcagcauuugacacagcgggcucaaaaugcccuggacaaccucgugaugcugcacaauucagaacagggaggccgagcauauagacaugcgauggaggagcuuccagauacuauugaaacccugaugcucuuggcccugaucgcuguauuaacagguggggugacccuauucuuucugaguggccgcggacucggcaaaacuagcauugggcuucugugugucacggccuccucuguguugcuguggauggcaagcguugagccccacuggaucgcugccuccauaauccucgaguucuuucugauggugcuucucauuccugagcccgacaggcagcggaccccacaggauaaccaacuggcauacgucguaaucggauugcuguucaugauuuuaacaguggccgcuaaugagaugggucuacuggaaacuaccaagaaagaccucggcaucgggcacguugcgguggagaaccaucaccaugccacaaugcuugaugucgaccugcacccugcaucagcuuggaccuuguacgccguggccacuacaauaauuacgcccaugaugcgucauaccaucgaaaacacuacagcaaauauuucucugaccgcuaucgccaaccaggcggcuauacucaugggacuggauaagggcuggccaaucaguaaaauggacauuggugucccucuuuuagcccuggggugcuauagccaggugaauccgcucaccuugacagcagccguucugaugcuaguggcucacuacgcaaucauuggccccggacugcaagccaaggcgacuagagaggcucagaagaggacggccgcaggcaucaugaaaaacccaaccguagaugggauaguggccauugaccucgauccugucguuuaugacgcuaaguuugaaaaacagcuuggacagaucaugcuguugauccuguguacaagccaaauucuccugaugcgcacuaccugggccuuaugcgaguccaucacacuugcaaccggcccccugacuacgcucugggaggguucuccagggaaguucuggaauacaaccauagcugugucaauggccaacauuuuucggggaagcuaccuagcgggcgccggucuggcauucuccuugaugaaaagucugggcgggggacgaagaggcacuggggcucagggagaaacccucggcgagaaguggaagaggcagcuuaaucagcugucuaaaagcgaauuuaacaucuauaagcgcucagguauuauggaggucgaccgguccgaagccaaagagggguugaagagaggagagacaacucgucacgcagugaguaggggcaccgcuaaacugcggugguucguagaacgcaaucucgugaagccugaggguaagguuaucgauuuaggcugugggcgaggaggcuggagcuacuauugcgccgggcugaaaaaggugacagaagucaaaggauacacgaagggcggucccgggcaugaggaaccgauaccaauggccaccuacggauggaaccuugugaaacugcacucuggcaaggacgucuucuuuacuccucccgagaaaugugauacacuacucugcgacaucggcgaguccucaccaaaucccaccauugaagaggggagaacucugaggguguugaagaugguugaaccuuggcugcggggaaaccaauucuguaucaagauucucaauccguauaugcccagcguaguggagacacuugagcagaugcagcgcaaacaugguggcaugcuggucagaaacccauuaucgagaaauucuacccacgaaauguacugggugaguugcgggacgggaaacaucguuuccgcggugaauaugaccagccgaaugcuguugaaccgguuuacaauggcucaccguaagccuacuuaugagagagaugucgaccucggcgcagguacccgccauguggccguagaacccgagguggcuaaccuggauauuaucgggcagaggauagaaaauauuaaacacgagcauaagucaacauggcacuacgacgaggauaacccuuauaaaacuugggccuaccauggauccuaugaaguuaagccaucuggcagcgcaaguuccauggucaauggcguggugaagcuacuuaccaaacccugggacgucaucccuaugguuacacaaaucgccaugaccgauacuacgccauucgggcagcagcggguguuuaaggagaaaguagacacaagaacccccaaggcuaaacgcggaacugcgcaaauuauggaagugaccgccagguggcugugggguuuccucagccgaaacaagaagccgcggauauguacaagagaggaauuuacgaggaaaguccgcucuaaugcagcuaucggcgccguguucguugacgagaaccaguggaacucagcaaaggaggccguggaagaugagcguuuuugggaccugguccagaaagaacgggaguugcacaagcaggggaaaugcgcuaccugcguguacaacaugaugggaaagagagaaaagaaacugggcgaguucgguaaggccaaagggaguagggcgauuugguacauguggcucggagcacgcuuucuugaguucgaagcccugggcuuuaugaaugaggaucacugguucucccgagaaaacagcuuaucuggcguagagggggagggacugcauaaguuggguuauauccuccgggacauuucgaaaaucccuggcgggaauauguacgcugaugacacugccggaugggauacaagaauaaccgaagacgaucugcaaaacgaggcaaagaucacugacauuauggaaccagagcacgcucuacuugccacaucaaucuucaaacugaccuaucagaauaagguugugaggguccagcgccccgcuaagaacggcacagugauggaugugauuagcagacgggaccagagggguuccgggcaagucggaacuuacggccucaauaccuuuacgaacauggaagcccagcugauccgucagauggagagugagggcauauucucuccuagcgaauuggagauuccaaacuuagcagaacgaguucuggauuggcucgagaaauaugggguggaacgccuuaagagaauggcgaucuccggagacgacuguguagugaaacccaucgaugaccgguuugccaccgcucugacagcccuaaaugauauggguaaggucaggaaagacgugccgcagugggagccuucaaagggcuggaacgauuggcaacagguucccuucugcagucaucacuuucaccagcugauuaugaaggacgggcgcgagauaguggucccauguagaaaucaggaugaacucgugggacgggcaaggguaucucaaggcgcugguuggagcuugcgagagacugccugccuggggaaauccuacgcacagauguggcagcuuauguauuuccaucguagagaccugcgccucgccgcgaacgcuaucuguucagccguuccuguggauuggguccccaccagccggacaacuuggucuauucacgcacaucaccaauggaugaccacggaagacauguuauccguguggaauaggguuuggaucgaggaaaacccauggauggaggauaagacacaugugaguagcuggggagacguccccuaccugggcaaaagagaggaccaguggugcggcucguugauugggcugaccgcccgcgcuacuugggccuccaauauccagguggcaauaaaccagguacggaggcucaucggaaaugaaaacuaccuugauuauaugacaucuaugaagcgauuuaaaaaugagggugacccugaaggcgcucugugguga

SEQ ID NO: 13719 - RNA, 9879 nt, Artificial Sequence
  derived and/or modified CDS sequence (opt3) from DENV-1__FJ882525__SS-prME
agcgugaccaugcugcuaaugcuuaugcccacagcacuggcuuuccacuugacuacgcggggaggggaaccucauaugaucgucuccaagcaggaaaggggaaaaucuuuacuguuuaagaccucagccgguguuaacaugugcacccuaguggcaauggaccucggcgaguucugugaagauacuaugaccuacaaaugcccacggauuacagaagcggaaccggacgauguagacuguuggugcaaugcuaccgauacuugggugacauaugggaccuguagucagacgggagagcaccgccgagacaagcguagcgucgcccuggcaccccaugugggccuuggucuggagacuagaaccgaaacauggauguccucugagggggccuggaaacagauacagaggguugaaacuugggcuuugcggcacccuggauuuaccgugaucgcacucuuccuggcccaugcuauuggcacaucgaucacccagaagggcauuaucuuuauacugcucauguuagucacgccaucaauggccaugcgcugcguggggaucggaagcagagauuucguugagggucugaguggcgcgacuuggguugacgugguccuugagcacggguccugugugacaaccauggcaaaggauaaacccacuuuggacauugaacugcuaaagacagaggugaccaacccugccguccucaggaaacugugcaucgaagcuaagauuucuaauacgaccacagauagccgguguccaacucaaggagaggccacccuuguugaagaacaggacgcaaacuuugugugccgccgaacauucguagauagaggcugggguaauggguguggacuguuuggcaaaggcuccuugaucacuugcgcuaaguucaagugcgugaccaaacucgaggggaagacaguccaguacgaaaaccugaaauauucagugauaguuaccgugcacacuggagaccagcaucaagucgguaaugagaguacggaacacggcacaaccgccacuauuacaccccaggcgccuagcacagagauccaguuaaccgacuacggggcccugacucucgauuguucuccaaggacaggacuugacuuuaacgaaauggugcuguugacgaugaaggagaaauccuggcuaguacauaagcagugguuccuggaucucccgcugcccuggaccucaggcgcaagcacaagucaagagacauggaaucggaaagaccuucugguuaccuuuaagacagcucacgccaagaaacaggaaguggucguguuggguucucaggagggggcuaugcacacugcccucaccggcgcaacggaaauucaaaccuccggaacaacuaccaucuucgccggccaucugaagugccguuuaaaaauggauaagcugacacuaaaagggaugagcuaugucauguguacuggaucguucaagcucgagaaggaaguggcugagacccagcacgguacgguucuggugcagauccgcuacgagggcacagacgcgccuugcaaaauuccauuuucuacccaggaugaaaaggggguaacucaaaacggaagacuuauaacagcaaaucccaucgucaccgacaaagagaagccugugaacauugaagccgagccacccuucggcgaguccuauaucguuauaggugcuggggaaaaagccuugaagcugucaugguuuaagaaaggcaguagcauuggaaagauguucgaggcaacugccaggggcgcucggcgaauggccauccucggggauaccgcaugggacuuuggauccaucgguggcguguucacaucugucgggaaacuggugcaucagauuuuuggaacggcguacggcguacuuuucagcggugugucauggaccaugaagaucgggauuggcguucuguugacuuggcucggacugaauagucgcuccacuagcuuaucuaugaccuguauagcugucggccuggugacacuauaccucggggugaugguccaggccgauucaggaugcguuaucaacuggaaaggcagagaacugaagugugguagugggauuuuugugacuaaugaggugcacaccuggacggaacaguauaaguuccaagcagacagcccgaaaaggcuuuccgccgcuaucggaaaggccugggaggagggcguaugcgguauccggucugcaacacgcuuggaaaacauuauguggaaacagauaucgaacgagcugaaucauauccuccuggaaaacgacaugaaguuuaccgucgugguuggcgauguggcugggauuuuagcccagggcaagaagaugaucagaccucagcccauggaguacaaauauagcuggaaguccuggggcaaggcgaaaauuaucggggccgacguccaaaauacuaccuucauaaucgauggaccaaacacaccugaaugucccgacgaucagagggcuuggaauauuugggagguggaggacuacggcuuugguaucuucacuaccaacauuuggcugaaacuucgugauucauauacacagguuugcgaccaccgguugaugagugcagccaucaaagauucuaaggcugugcacgccgacaugggguacuggauagaaagcgagaaaaaugaaacguggaagcucgcacgagcguccuucauugagguaaagaccuguaucuggccaaaaucacauacucuguggagcaacggaguccuagaaucugagaugauuauccccaagauauauggcgguccuaucucccagcacaauuacagaccaggcuacuuuacacaaaccgccgggccguggcaucugggaaaacucgagcuggauuucgaccuuugcgaaggcacuacagugguggucgaugagcacugcgggaacaggggacccaguuugcgcaccacgacuguuaccggcaagauuauccacgaaugguguugccggagcuguacacugccuccauuaagauuuaaaggugaggacgggugcugguauggaauggagauuaggcccgugaaggaaaaggaggaaaaucucguaaaaucuaugguguccgcuggcucaggugaggucgacaguuucagccugggccuucuguguaucucgauaaugauugaagaggugaugcgcucccgauggucucggaagauguugaugaccgggacucucgccguauuuuuccugcuaaucaucggacagcugacauggaacgaucucauucgucugugcaucauggugggcgcaaaugcuagcgacagaauggggaugggaaccacauaccuugccuugauggcaacuuuuaaaaugaggccuauguucgccgucggccuguuauuucgccggcucaccucaagagaggugcugcuucugacgauuggucuaagucucguugcuuccguggaacugccaaacucuuuggaggaacugggggauggauuagcgaugggcauaaugauccucaagcugcuuacagacuuccagagccaucaacugugggccaccuugcucucccugacuuuuauuaaaaccacauucucacuacacuaugcauggaagacuauggcuaugguccugagcaucguaagucuuuuuccccucugucugucuaccacgucccagaagacaaccugguugccggugcuguuaggcagccucgggugcaaaccucugacuauguuccuuauugccgagaauaagaucuggggaaggcgaucguggccacugaacgaagguauaauggccguuggcaucgugucaauuuugcucucuagucugcucaagaaugaugucccccuggcugggccucuuaucgcaggaggcaugcucauugccuguuacgugaucuccgguagcucugcggaccugagcuuggagaaggcugccgagguauccugggaagaggaagcagagcauucaggggccagucacaauauauuaguggaaguccaggaugacggaacaaugaaaauuaaggaugaggagcgcgacgauacccugacuauccuccugaaagcuacacuucuggcaguuagcggcguguaucccuugucuaucccagccacccuauucgugugguacuuuuggcagaagaagaaacaacgguccggcguccugugggacacgccuucacccccagaaguggagagagcgguucucgaugacgggauuuauaggauaaugcagcguggacugcuuggucgcagucagguaggcgugggggucuuccaggaaaacguguuucauacuauguggcacguuacccggggagcuguguuaauguaccaaggcaagagacuggagccgagcugggccuccgucaaaaaggaccucaucucuuacggugggggauggagguugcagggcucguggaauacaggcgaggaagugcagguaauugcagucgagccugggaaaaaccccaagaaugugcagaccgccccaggaacauucaagacuagcgaaggugagguuggcgcuaucgcccuggauuuuaaacccgggaccucaggauccccuauugugaaccgagaaggcaagaucgucggucucuaugggaauggagugguuacgacaaguggcacuuacgugucugcaauagcucaagccaaagcgagccaggagggcccacugcccgagaucgaagacgaggucuuccggaagcgcaaccuuaccauuauggaucugcacccuggguccggaaaaacaagaagguauuugccggccaucgugcgggaagcaauuaagcgaaagcuaagaacccugauccucgcuccaacucgcguaguggccucagagauggcugaagcauuaaaagguaugcccauaagguaccagaccacagccguuaagucugagcauacgggcaaagagauugucgaccugaugugccacgccacuuuuaccaugcgucuucugagcccugugcgggugccaaauuauaacaugaucaucauggaugaagcucauuucacagaccccaguuccauugcggcaagaggguacaucagcaccagggucggaaugggcgaggccgcugccauauuuaugacugcaacaccuccggguucuguagaagccuucccccaaucaaaugcugugauucaggaugaggaacgcgacaucccagagcgauccuggaacaguggguaugaguggauuaccgauuuuccuggaaagacgguuugguucgugcccagcaucaaaucgggcaaugacauagcgaacugucucagaaagaauggcaagcgggucauucaguugucuaggaaaacuuucgauacagaauaccagaagaccaaaaacaacgacugggacuacgugguuaccacugauaucuccgagaugggggccaauuuucgcgcagaccgugugaucgauccaagacggugccugaagccugucauucucaaagacggacccgaaagggugauccuggcugguccaaugccgguaacaguggccagcgcagcccaacgccgaggcagaauugggcggaaccacaauaaggagggagaucaguauauauacaugggccagccucuuaacaaugacgaggaucaugcucacuggaccgaagccaagaugcuacuggacaacaucaauacacccgaggguauuaucccagcguuguucgaacccgagagggaaaaaucagcagccaucgauggggaguaucgcuuaagaggcgaggcuaggaagacuuuuguugaacugaugcggcguggagaccucccugucuggcugaguuacaaaguggccucugagggcuuccaguauuccgaucgccgauggugcuuugacggggaaagaaacaaucaagugcuugaggaaaacauggaugucgagauuuggacgaaggagggagaaaggaaaaagcugcggccacgcuggcucgacgcuagaaccuacagcgaccccuuggcacugagggaguucaaagaauuugccgcuggucggcgaucaguuaguggcgaucuaauacuggagaucgggaagcucccucagcaccuuacacagagagcccagaaugcacuggacaacuuagugauguugcauaauagcgaacaaggaggccgcgcguauaggcacgccauggaggagcugccggauacuauugaaacccucaugcugcuugcucugaucgccguacucacagguggggugaccuuguucuuucuguccggccggggauuaggcaagacuucuauugggcuacugugugucauggcaagcuccgugcuccuuuggauggcuucaguugagccacauuggaucgccgcaucuauaauccuggaguucuuuuugauggugcugcucauucccgagccugaccgucagagaacgccccaggauaaccagcuggccuacgucguaaucggacuucucuucaugauucugaccguggcugcgaaugagauggguuugcuggaaacaacuaaaaaggacuuaggcaucgggcacguugccguggagaaccaccaucacgcagcuaugcuagaugucgaccugcauccagccagugccuggacccucuacgcaguggcuacaaccauaauuacuccuaugaugaggcacacaaucgaaaacacgaccgccaauauuucgcuuacugcgaucgcuaaccaagccgcaauacugaugggauuggauaaaggcuggcccaucagcaagauggacauuggugucccacugcucgcccuggggugcuauucccaggugaauccucuuacauuaaccgcugcaguucugaugcucguggcccauuacgcgaucauuggcccgggauugcaggcuaaagccacccgcgaggcacaaaagcggacagccgcuggcaucaugaagaaccccacuguagaugggauaguggccauugaccuggauccagucguuuaugacgcaaaauuugaaaagcagcuaggacagaucaugcugcucauccuuuguacgucucagauucuguugaugcgaaccacaugggcucugugcgagucaaucacucucgccaccggcccucugacaaccuuaugggaggguagccccgggaaauucuggaauacuacgauagcgguguccauggccaacauuuucagaggaaguuaccuugcaggcgcuggucuggccuuuucucucaugaaaagccuaggcgggggaaggcgcggcacaggggcacaaggagaaacccugggcgagaaauggaagcggcaguugaaucagcugucaaaguccgaguucaacacuuauaaaagaagugguaucauggaggucgaccguagcgaagcuaaggaggggcucaaaaggggagagaccacaaagcacgccgugucucggggcacugccaaacuucgcugguuuguagaacgaaauuucgugaagccagaggguaagguuauugaucugggcugugggagaggaggcugguccuacuauugcgcgggguugaaaaaggugaccgaagucaaaggauacacaaagggcgguccugggcacgaggaacccaucccgauggcuacguacggauggaaccuggugaaacuccauucaggcaaggacgucuuuuucauaccaccugagaaaugugauaccuuacugugcgacaucggcgagagcucgcccaauccaacuauugaagaggggaggacacuucgggugcugaagaugguugaacccuggcuacgcggaaaccaguuuuguaucaagauucucaauccuuauaugccgucuguaguggagacccuggagagaaugcaaaggaaacacgguggcauguugguccgaaacccccugaguagaaauuccacucaugaaauguacugggugagcugcgggacaggaaacaucguuucagcagugaauaugaccucccguaugcuccuuaacagauucacgauggcccaccgcaagccaaccuaugagagggaugucgaccugggcgcugguacacggcacguggccguagaaccugagguggcaaacuuagauauuaucgggcagagaauagaaaauauuaaacaugagcacaagucuacuuggcauuacgacgaggauaaccccuauaaaaccugggccuaccacggaagcuaugaaguuaagccuaguggcuccgcuagcucuauggucaauggcguggugaagcuguugacaaaaccaugggacgucauccccaugguuacucagaucgcgaugaccgauacaaccccuuuugggcagcaacgcguguucaaggagaaaguagacacuaggacgccaaaggccaaacgaggaacagcacagauuauggaagugaccgcuaaguggcucugggguuuucugucacggaacaagaaacccagaauauguacuagggaggaguucacccgcaagguccguaguaaugccgcaaucggcgccguguuuguugacgagaaccaguggaacuccgcuaaagaggccguggaagaugagcgguucugggaccuaguccauagagaaagggagcuucacaagcaagggaaaugcgcgacaugcguguacaacaugaugggaaagcgcgaaaagaaacugggcgaguucgguaaggcaaaagggagccgagccauuugguacauguggcucggagcucgguuucuggaguucgaagccuugggcuuuaugaaugaggaucacugguucucuagagaaaacucgcugucaggcguagagggggagggacuccauaaacuugguuauauccugagggacauuagcaaaaucccgggcgggaauauguacgcagaugacacggcuggaugggauacccgcauaacugaagacgauuuacagaacgaggccaagaucacagacauuauggaaccugagcacgcucuguuggccaaauccaucuuuaagcucaccuaucagaauaagguugugagaguccagcggccagccaagaacggcacugugauggaugugauuaguaggcgugaccaacgagguucugggcaggucggaacauacggccugaauaccuucacaaacauggaagcgcagcuaauccgccagauggagagcgagggcauauuuucccccucagaacuugagacuccuaaccuggccgggagaguucucgauuggcuggaaaagcauggaguggagcgguugaaaaggauggcuauuaguggugacgacuguguagugaagccaaucgaugaccgcuucgccaccgcauuaacggcucugaaugauaugggcaaagucagaaaggacaucccccaaugggaaccgucuaagggguggaacgauuggcaacaggugccuuuuugcagccaccacuuccaucagcucauuaugaaagacggacgggagauaguugugcccuguaggaaucaagaugagcuugucggccgagcccgugugucccagggugcaggguggucacugagagaaaccgccugccuaggaaagagcuaugcgcagauguggcagcugauguacuuucaccgccgggaccucagguuggcugccaacgcaaucuguucugccguaccaguugauugggugccuacauccagaacuaccuggaguauucaugcucaccaucaauggaugacaacugaggacaugcugagcgucuggaaucgcguguggaucgaagagaaccccuggauggaagauaaaacccacauuucguccuggggcgacguuccauaucuuggcaagcgggaggaccaguggugcgggucucugaucggacucacggccagggcaacaugggcuaccaauauacagguggccaucaaccaaguccgaagauuaauugguaaugagaacuaccuggauuacaugacuucaaugaaacgguucaagaaugaaagcgaccccgagggcgcguugugguga

SEQ ID NO: 13720 - RNA, 9879 nt, Artificial Sequence
  derived and/or modified CDS sequence (opt3) from DENV-1__FJ882526__SS-prME
agcgugaccaugcugcucaugcuuaugcccacagcacuggcuuuccacuugacuacgagaggaggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagaacaccgccgagacaagcguuccguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaagagccuugaagcugucaugguuuaagaaaggcaguagcaucggaaagauguucgaggcaaccgccaggggcgcucggcgaauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgcuccacuagcuuaucuaugacauguauugcuguuggccuggucacccuauaccucggggugauggugcaggccgauucaggaugcgucaucaacuggaaaggcagagaacugaagugugguagugggaucuuuguuacaaaugaggugcacacuuggaccgaacaguauaaguuccaagcagacagcccgaaaaggcuuuccgccgcuauuggaaaggccugggaggagggcgugugcgguauacggucugcaacgcgcuuggaaaacaucauguggaaacagauuucgaacgagcugaaucauauccuccuggaaaacgacaugaaguuuacaguagucgugggcgauguugcugggauuuuagcccagggcaagaagaugaucagaccucagcccauggaguacaaauauagcuggaaguccuggggcaaggcgaaaauaaucggggccgacgugcaaaauaccacuuucauuaucgauggaccaaacaccccugaaugucccgacgaucagagggcuuggaauauuugggaggucgaggacuacggcuuugguaucuucacaacuaacauauggcugaaacuucgugauucauauacccaggugugcgaccaccgguugaugagugcagccauuaaagauucuaaggcuguucacgccgacaugggguacuggaucgaaagcgagaaaaaugaaacauggaagcucgcacgagcguccuucauugaggugaagacguguaucuggccaaaaucacauacccuguggagcaacggaguacuagaaucugagaugauaauccccaagauuuauggcgguccuaucucccagcacaauuacagaccaggcuacuuuacucaaacagccgggccguggcaucugggaaaacucgagcuggauuucgaccuuugcgaaggcaccacugucgugguggaugagcacugcgggaacaggggacccaguuugcgcacaaccacggucacuggcaagauuauccacgaaugguguugccggagcuguacccugccuccauuaagauuuaaaggugaggacgggugcugguauggaauggagauaaggcccguuaaggaaaaggaggaaaaucucgugaaaucuaugguauccgcuggcucaggugagguggacaguuucagccugggccuucuguguauuucgaucaugaucgaagaggucaugcgcucccgauggucucggaagauguugaugacagggacccucgccguguuuuuccugcuaauuaugggacagcugacuuggaacgaucucauccgucugugcauuaugguuggcgcaaaugcuagcgacagaauggggaugggaacaaccuaccuugccuugauggcaacauuuaaaaugaggccuauguucgccgugggccuguuauuucgccggcucacuucaagagagguccugcuucugaccauaggucuaagucucguggcuuccguugaacugccaaacucuuuggaggaacugggggauggauuagcgaugggcaucaugauucucaagcugcuuacggacuuccagagccaucaacugugggccacauugcucucccugaccuuuaucaaaacuaccuucucacuacacuaugcauggaagacaauggcuauggugcugagcauugucagucuuuuuccccucugucugucuacuaccucccagaagacgacaugguugccgguacuguuaggcagccucgggugcaaaccucugaccauguuccuuaucgccgagaauaagauauggggaaggaaaucguggccacugaacgaagguaucauggccgugggcauuguuucaaucuugcucucugcucugcuaaagaacgaugugccccuggcagggccucuuauugccggaggcaugcucaucgcguguuacgucauaagugguuccagcgcugaccugucuuuggagaaagccgcagaggugagcugggaagaggaagccgagcauuccggggcuucacacaauauuuuaguagaagugcaggaugacggaacuaugaagaucaaagaugaggagcgagacgauacacugaccauccuccugaaggcaacucuucuggccgucaguggcguuuaucccuugagcauuccagcgacacuauucgugugguacuuuuggcagaagaaaaagcaacgcucuggcgugcugugggacaccccuucacccccagaagucgagcgggcugugcucgaugacgggauauauagaaucaugcagaggggacugcuuggucguagccagguuggcguagggguguuccaggaaaacgucuuucauacgauguggcacgugacucgcggagccguuuuaauguaccaaggcaaacggcuggagccgaguugggcaagcgugaagaaagaccucauuuccuacggugggggauggagauugcagggcucuuggaauaccggcgaggaaguccaggugaucgccguagagccugggaagaaccccaagaauguccagacagcuccaggaaccuucaaaacaucggaaggugaggugggcgccauugcacuggauuuuaagcccgggacuagcggaucaccuaucguuaacagggaaggcaaaauagugggucucuaugggaauggagucgugaccacguccggcacauacguuagugcuaucgcccaagcgaaggccucucaggagggcccacugcccgagauugaagacgagguguuccgaaaacggaaccuuacuaucauggaucugcacccugggagcggaaagacccgcagauauuugccggcaauugucagggaagcuaucaagcggaaacuacgaacacugauacucgccccaaccagagugguagcuuccgagauggcagaagccuuaaaggguaugcccauucgcuaccagacuaccgccgugaaaucagagcauacaggcaaggagaucguugaccugaugugccacgcuacguuuacuaugaggcuucugucuccuguccgugugccaaauuauaacaugaucauuauggaugaagcgcauuucaccgaccccagcaguaucgcagcccggggguacauauccacaagagugggaaugggcgaggcugccgcaauuuuuaugaccgccacuccuccggguagcgucgaggcuuucccccaaucuaaugcgguaauccaggaugaggaaagggacauuccagagcgcucauggaacuccggguaugaguggaucacagauuuuccuggaaaaaccgugugguucguucccaguauaaagagcggcaaugacauugccaacugucuccgaaagaauggcaaaagagugauccaguugucgcggaagacguucgauacugaauaccagaaaacaaagaacaacgacugggacuacgucgugaccaccgauaucucugagaugggggcaaauuuuagggcugaccgcguuauugauccacguagaugccugaaaccugugauccucaaggacggacccgaacgggucauucuggccgguccaaugccggugacuguagcauccgccgcucaaaggcgcggccgaauagggagaaaccacaauaaggagggagaucaguauaucuacaugggccagccucuuaacaaugacgaggaucaugcccacuggacagaagcgaaaaugcuacuggacaacauuaauacccccgaggguaucaucccagcauuguucgaacccgagcgggaaaagagcgccgcuauugauggggaguauagguuacgcggcgaggccagaaaaacauuuguggaacugaugaggcggggagaccucccuguuuggcugucauacaaggucgcuagugagggcuuccaguauucugaucgucgcuggugcuuugacggggaacgaaacaaucaagugcuugaggaaaacauggauguggagauauggacuaaagagggagaaagaaagaaacugaggccacgguggcucgacgcacgcacguacuccgaccccuuggcccugagagaguucaaggaauuugcugccgguaggcggagcgucucaggcgaucuaauccuggagauugggaagcucccucagcaccuuacccagcgagcacagaaugcgcuggacaacuuaguuauguugcauaauagugaacaaggaggcagagccuaucgccacgcuauggaggagcugccggauacaaucgaaacucucaugcugcuugcccugauugcagugcucaccggugggguaacauuguucuuucugagcggcaggggauuaggcaaaaccuccaucgggcuacugugugugauggcuucuagcguccuccuuuggauggccuccguggagccacauuggauagcagccucaaucauucuggaguucuuuuugaugguucugcucauccccgagccugaccggcagcguacuccccaggauaaccagcuggcuuacguggucauuggacuucucuucaugauccugacgguagcggccaaugagauggguuugcuggaaaccacaaagaaagacuuaggcauagggcacguggcaguugagaaccaccaucacgcugccaugcuagauguggaccugcauccagccucugcauggacucucuacgcugucgccaccacaauuaucaccccuaugaugagacacacuauugaaaacacaacggcgaauaucagucuuaccgcuauagccaaccaagcagccauccugaugggauuggauaagggcuggcccauuucgaaaauggacaucggugugccacugcucgcucuggggugcuauagccaggucaauccucuuacuuuaacagcagccgugcugaugcucguugcgcauuacgcuauuaucggcccgggauugcaggccaaggcaaccagggaggcccaaaagcgcaccgcugccggcauaaugaaaaaccccacaguggaugggauuguagcaaucgaccuggauccaguggucuaugacgcuaaguuugaaaaacagcuaggacagaucaugcugcucauucuuuguacuucccagauccuguugaugcggacgaccugggcccugugcgagucuauaacacucgcgacuggcccucugaccacauuaugggaggguucacccgggaaguucuggaauaccacuauugccguuagcauggcaaacaucuuccgaggauccuaccuugcuggcgccggucuggcauuuagucucaugaaaucucuaggcgggggaagaaggggcacgggggcucaaggagaaacacugggcgagaaguggaagcgccaguugaaucagcugagcaaaucagaguucaacaccuauaagcgguccgguauuauggagguggacagaagugaagccaaagaggggcucaagcguggagagacuaccaaacacgccgucagcaggggcacagcgaaacuucggugguuuguggaacgcaaucugguaaagccagaggguaaagugaucgauuugggcugugggcgaggaggcuggucuuacuauugcgcugggcugaagaaaguuacugaagugaagggauacaccaaaggcgguccugggcacgaggaacccauaccgauggcaacauacggauggaaccucgucaaguuacauuccggcaaagacguguucuuuaucccaccugagaagugugauacgcugcuuugcgacauuggcgagucaagccccaauccaaccaucgaagaggggagaacucugaggguccuaaagaugguggaacccuggcuccggggaaaccaguucuguauuaaaauccugaauccuuauaugccgucgguuguagagacauuggagcaaaugcagcgcaagcacgguggcaugcuggugagaaacccccucucuaggaauaguacccaugaaauguacugggucuccugcgggacuggaaacauugugagcgccguuaauaugacaucacgaaugcuucugaaccgguuuaccauggcucaccguaaaccaacguaugagagagauguggacuuaggcgccgguacccgccacgucgcaguggaaccugagguagccaaccuggauaucauagggcagaggauugaaaauaucaagcaugagcacaaauccacauggcauuacgacgaggauaaccccuauaagacuugggcuuaccacggaucuuaugaagugaagccuagcggcagugcguccagcaugguuaauggcgucgugaaauugcucaccaagccaugggacgugauccccauggucacacagauugccaugacugauaccacaccuuucgggcaacagcggguuuuuaaagagaagguggacaccagaacuccaaaagcaaagcgcggaacggcucagauaauggaaguaacagccaaguggcugugggguuuccuaucuaggaacaaaaagccccgaaucuguacccgggaggaauuuacuagaaaagugaggucaaaugcagccauuggcgcugucuucguggacgagaaccaauggaauagugccaaggaggcgguugaagaugagcgcuuuugggaccuugugcaucgugaacgggagcugcacaaacaggggaagugcgcaaccugcgucuacaacaugaugggaaagagagagaagaagcucggcgaguucgguaaagccaagggguccagggcuaucugguacauguggcugggagcccgcuucuuggaguuugaagcacugggcuucaugaaugaggaucacugguuuagccgagaaaacucucucucgggcguggagggggagggacuucauaaacuggguuauauuuuacgggacaucucaaagauaccgggcgggaauauguacgcugaugacacagccggaugggauacgagaaucaccgaagacgaucugcagaacgaggcuaaaauuacugacaucauggaaccugagcacgccuugcucgcaaagagcauuuucaagcugacauaucagaauaaaguaguuagggugcaacgcccagcgaagaacggcaccgucauggaugugaucuccagacgggaccagagggguaguggacaggugggaacuuacggccuaaauacauuuaccaacauggaagcccagcuuauacgucaaauggagucugagggcauuuucagccccuccgaacuggagacaccuaaccucgcugggcgaguccuggauugguuggaaaaacauggaguugagcgcuuaaagagaauggccaucucaggugacgacugugugguaaaaccaaucgaugaccgguuugcaacugcucugaccgcccucaaugauaugggcaaggugaggaaggacauuccccagugggaaccgaguaaaggguggaacgauuggcagcaggucccuuucugcucucaccacuuucaucaacuuauaaugaaggacggacgcgagaucgugguucccuguagaaaucaggaugagcuggugggccgggcaagggucagccagggugccggguggucccuacgagaaacggcgugccugggaaaaucauaugcucagauguggcaacucauguacuuccaccguagagacuugcgccuggccgcaaacgccauuuguagcgcugugccaguagauuggguuccuaccucucggacaacuugguccauccaugcccaccaucaguggaugaccacagaggacaugcuuaguguguggaauagggucuggauugaagagaaccccuggauggaagauaagacucacaucagcucguggggcgacgugccauaucugggcaaaagagaggaccaguggugcgggucccucauaggauuaaccgcacgcgcuacgugggccacaaauauccaaguugcgauuaaccaggugcggaggcugaucgguaaugagaacuacuuggauuacaugaccucuaugaagcgauuuaagaaugaaucagaccccgagggcgcucugugguga

SEQ ID NO: 13721 - RNA, 9879 nt, Artificial Sequence
  derived and/or modified CDS sequence (opt3) from DENV-1__FJ882527__SS-prME
agcgugacaaugcugcucaugcuuaugcccacagcacuggcuuuccacuugacuacgagaggcggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuaugcuggccgugggcuuacucuucaggcgccugaccucacgggagguccuucugcuaacgauuggucucagucugguggcuuccguugaauugccaaacucucuggaggaauuaggggauggacucgcgaugggcauaaugauccugaaacuucugacagacuuucagagccaucaauugugggccacccuccugucccuaacuuucauuaagaccacauuuucacugcacuaugcauggaagacuauggcuauggugcuuagcaucgucagucucuucccccuguguuugucuaccacgucccagaaaacaaccuggcugccgguauuacucggcagccuggggugcaagccucuugccauguuucugauugccgagaauaaaaucuggggaagaaagucguggccauugaacgaagguauaauggcugugggcaucguuucaauucuccugucuagucuacugaaaaacgaugugccccuugcagggccucucaucgccggaggcaugcugauugcguguuacgucaucuccgguagcucugcugacuugagcuuagagaaggccgcagagguguccugggaagaggaagccgagcauucaggggcuagucacaauauacugguagaagugcaggaugacggaacuaugaaaauuaaggaugaggagagggacgauacacucaccauccugcuuaaggcaacucuguuggccgucagcggcguuuauccccuaucuaucccagcgacacuguucgugugguacuucuggcagaaaaagaaacaacgauccggcgugcucugggacaccccuucacccccagaagucgagcgcgcugugcuggaugacgggauuuaucggauaaugcagagaggacuuuuagguaggagucagguuggcguagggguguuucaggaaaacgucuuccauacgauguggcacgugacucguggagccguucugauguaccaaggcaagcgccucgagccgagcugggcauccgugaaaaaggacuugaucucuuacggugggggauggcggcugcagggcucguggaauaccggcgaggaaguccaggugauugccguagagccugggaagaaccccaaaaauguccagacagcuccaggaaccuuuaagacaagcgaaggugaggugggcgccaucgcacucgauuucaaacccgggacuucaggauccccuauuguuaacagagaaggcaagaucgugggucuguaugggaauggagucgugaccacgaguggcacauacguuucugcuauagcccaagcgaaagccagccaggagggcccacuucccgagaucgaagacgagguguuuaggaagcgaaaccugacuauuauggauuugcacccuggguccggaaagacccggcgcuaucuaccggcaaucgucagagaagcuauuaaaaggaagcugcggacacucaucuuagccccaacccgagugguagcuucagagauggcagaagcccugaaagguaugcccauaagauaccagacuaccgccgugaagucugagcauacaggcaaagagauuguugaccuuaugugccacgcuacguucacuaugcgccugcucagcccugucagggugccaaauuauaacaugaucaucauggaugaagcgcauuuuaccgaccccaguuccauugcagcccguggguacaucagcacacgggugggaaugggcgaggcugccgcaauauucaugaccgccacuccuccggguucugucgaggcuuuuccccaaucaaaugcgguaauucaggaugaggaaagagacaucccagagagguccuggaacaguggguaugaguggauuacagauuucccuggaaagaccgugugguuuguucccagcaucaagucgggcaaugacauagccaacuguuugcgcaaaaauggcaagcgagugauucagcugucuagaaaaacguucgauacugaauaccagaagaccaagaauaacgacugggacuacgucgugaccaccgauaucuccgagaugggggcaaauuuccgggcugacaggguuaucgauccacgccguugccucaagccugugauucugaaggacggacccgaaagagucauccuugccgguccaaugccggugacuguagcaagcgccgcucaacggaggggccgcauugggcgaaaccacaauaaagagggagaucaguauauauacaugggccagccucuaaacaaugacgaggaucaugcccacuggacagaagcgaagaugcuguuggacaacaucaauacccccgaggguauuaucccagcauuauuugaacccgagagagaaaaaucagccgcuaucgauggggaguaucggcugaggggcgaggcccgcaagacauucguggaacucaugagaaggggagaccugccuguuuggcuuaguuacaaagucgcuucugagggcuuucaguauuccgaucggcguuggugcuucgacggggaacgcaacaaucaagugcuggaggaaaacauggauguggagauuuggacuaaggagggagaacgaaagaaacucagaccaaggugguuggacgcacggacguacagcgacccccuggcccuacgcgaguuuaaagaguucgcugccgguagaaggucagucaguggcgaucugauacucgagaucgggaaacuuccucagcaccugacccagcgggcacagaaugcguuagacaacuugguuaugcugcauaauagcgaacaaggaggccgagccuauagacacgcuauggaggagcucccggauacaauugaaacucugaugcuucuggcccucaucgcaguguugaccggugggguaacacuguuuuucuuauccggccgcggacuaggcaagaccucuauugggcugcucugugugauggcuagcuccguccuucuguggauggccucaguggagccacauuggaucgcagccucuauaaucuuggaauuuuuccugaugguucuccugauucccgagccugacaggcagcggacuccccaggauaaccagcuugcuuacguggucaucggacuccuguuuaugauuuugacgguagcggccaaugagaugggucuguuagaaaccaccaagaaggaccuaggcaucgggcacguggcaguugagaaccaccaucacgcugccaugcuggauguggaccuccauccagccagugcauggacucuuuacgcugucgccaccacaauaauuaccccuaugaugcgucacacuaucgaaaacacaacggcgaauauuucgcugaccgcuaucgccaaccaagcagccauauugaugggacuggauaaaggcuggcccaucagcaagauggacauuggugugccacuccuggcucuugggugcuauucccaggucaauccuuuaacucugacagcagccgugcucauguugguugcgcauuacgcuaucauuggcccgggacugcaggccaaggcaaccagagaggcccagaaaaggaccgcugccggcaucaugaagaaccccacaguggaugggauaguagcaauugaccuagauccaguggucuaugacgcuaaauucgaaaagcagcugggacagaucaugcuccuuauccuguguacuucucagauuuugcugaugcgcacgaccugggcccucugcgagucaaucacacuggcgacuggcccuuuaaccacacuuugggaggguagccccgggaaauuuuggaauaccacuauagccguuuccauggcaaacauuuuccggggaaguuaccuggcuggcgccggucucgcauucucucuaaugaaaagccugggcgggggacgaagaggcacgggggcucaaggagaaacauugggcgagaaguggaaaaggcagcugaaucagcucucaaaguccgaauuuaacaccuauaaacgcagugguaucauggagguggaccggagcgaagccaaggaggggcuuaaaagaggagagacuaccaagcacgccgucucucguggcacagcgaagcugaggugguucguggaacggaauuugguaaaaccagaggguaaggugauugaucugggcugugggcgcggaggcugguccuacuauugcgcugggcucaaaaagguuacugaagugaaaggauacaccaagggcgguccugggcacgaggaacccaucccgauggcaacauacggauggaacuuagucaaacugcauucaggcaaggacguguuuuucauaccaccugagaagugugauacgcuucugugcgacaucggcgagagcucgcccaauccaaccauugaagaggggcgaacucuaagaguccucaaaaugguggaacccuggcugaggggaaaccaguuuuguaucaagauuuugaauccuuauaugccgucuguuguagagacacuggagcaaaugcagcggaaacacgguggcaugcucgugcgcaacccccuuaguagaaauuccacccaugaaauguacugggucagcugcgggacuggaaacaucgugucagccguuaauaugacauccaggaugcuguuaaaccgauucaccauggcucaccggaagccaacguaugagcgugauguggaccugggcgccgguaccagacacgucgcaguggaaccugagguagccaacuuggauauuaucgggcagcgcauagaaaauauuaaacaugagcacaagucuacauggcauuacgacgaggauaaccccuauaagacuugggcuuaccacggaagcuaugaagugaaaccuaguggcuccgcgagcucuaugguuaauggcgucgugaagcuccugaccaaaccaugggacgugauccccauggucacacagaucgccaugacugauaccacaccuuuugggcaacagaggguuuucaaggagaaaguggacacccggacuccaaaggcaaagagaggaacggcucagauuauggaaguaacagccaaauggcuaugggguuuucuuucacgcaacaagaaacccaggauauguacccgagaggaguucacucggaaggugagaaguaaugcagccaucggcgcugucuuuguggacgagaaccaauggaacuccgccaaagaggcgguugaagaugagagguucugggaccuggugcaucgcgaacgugagcuccacaagcaggggaagugcgcaaccugcgucuacaacaugaugggaaaacgggaaaagaaacugggcgaguuugguaaggccaaagggagcagagcuauuugguacaugugguugggagccagguuccuggaguucgaagcacucggcuuuaugaaugaggaucacugguucucucgcgaaaacucgcuuucaggcguggagggggagggacugcauaaguuagguuauauccugcgagacauuagcaaaaucccgggcgggaauauguacgcugaugacacagccggaugggauacgcggauaaccgaagacgauuugcagaacgaggcuaagaucacugacauuauggaaccugagcacgcccuccuggcaaaguccaucuuuaaacuaacauaucagaauaagguaguuagagugcaaaggccagcgaaaaacggcaccgucauggaugugauuagucgcagagaccagcgggguucuggacaggugggaacuuacggccuuaauacauucaccaacauggaagcccagcugaucaggcaaauggagagcgagggcauauuuucccccucagaacucgagacaccuaaccuggcugggcgugucuuggauugguuagaaaagcauggaguugagcgacugaaacgcauggccauuaguggugacgacugugugguaaagccaaucgaugacagauucgcaacugcucucaccgcccuuaaugauaugggcaaggugcggaaagacaucccccagugggaaccgucuaagggguggaacgauuggcagcaggucccuuuuugcagccaccacuuccaucaacugauuaugaaagacggaagggagauagugguucccugucgcaaucaggaugagcuagugggcagagcacgggucucccagggugccggguggucacugagggaaacggcgugccucggaaagagcuaugcucagauguggcaauugauguacuuucaccgacgugaccugagacuugccgcaaacgccaucuguucugcugugccaguagauuggguuccuaccucccgcacaacuuggaguauucaugcccaccaucaguggaugaccacagaggacaugcugagcguguggaaucgggucuggaucgaagagaaccccuggauggaagauaaaacucacauuucguccuggggcgacgugccauaucucggcaagagggaggaccaguggugcgggucuuuaaucggacugaccgcaagagcuacgugggccacaaauauacaaguugcgaucaaccaggugcgccgguugauugguaaugagaacuaccuggauuacaugaccucaaugaagagguucaaaaaugaaagcgaccccgagggcgcucucugguga
